United States Patent 9,976,180 (METHODS FOR DETECTING A GENETIC VARIATION IN SUBJECTS WITH PARKINSONISM) - sequence listing, part 21

SEQ ID NO: 329 - DNA, 1070022 bp, Homo sapiens
gcggccgcccctccccgattcccgccacctgccgcctggccaggtggaaggggcgctgccgcgagcctccgggcctcagggtgttccggggagcggcgccccgggtctctgggcccacccgccccgggcgtcctccgagagtgggggctgcgcccgcggggtcagacacctgttcggcccggcccggcgtggtcgccgggggccaggatgaaagtgaccgtgtgcttcggcaggacgggcatcgtggtgccctgcaaggagggccagctgcgcgtcggcgagctcacccagcaggcgctgcagcggtacctgaagacccgggagaaggtgagcgcggcgcggaggagtggggcgcggctgcagccaaggcacctgccaggtgcgacccggtggcgacactcaggggatgcagaaaacccaggggattatggggcactgcctgtagctgcagctgttgtctattgctaatatcagtgatgtgggtgtctttgggtgtttgtgggccttgagctccgagggtcgtgagtggacctgcagcattggaatctcttgggagcttcttagaactgcccaatatgggcagttctccaaacccaccgactcaggatctgctctttaacgagatccccaggtgattggaatgcccactgaagtttgagaaccactggtttagaacttgtttgagggaacgtcttaaaaggtgctgctcacctaagtgtgatttttgacccattaaggcccgcctcacttaggctccttggagttagaaagttgattgtgcaagtgacacatactcggaagttacaactgatggggcctttggagtttcagccttgtgagctgccctgtctcagtgacttgggcaggaacacaggtgggagcatgctgtttgcttagccaacctgtctacattttgagtgttttcagtttaatgtcacagattctatgaccatttactatgtgtgtgggctgttgtcaggtcctgagtgactattaaaatgagaaagacgttcctagctctgtagctgaagtcaggaacaagtataaattaagtgacaattttttttaagtgtgcaatacatgttgagaaaatatctggcactagaacttatgccaagtatttgggtaacattgggcctctgggacttcctcagtgaaacttttaaaggaaggcattgaataaccttttaattttttgaatcttcacatggaacattttgtatgtcccaaatgctcctcaaacagggcaagtcacaaattcttgttttagcggccaatggttctcttaatatttggtctcgtgccatgtgactaaaatagtgggttggtcaatctagtgatggaaaaacgtaagttttaatttcttttaacttcttatcggttatccaaagcataaaagtaattgtttcttacaagtgtatagcttaggggtttaagaaaatacttgcaccttctttgcctccatgaagaattattatacagaaaaaaaattcagctctggacagatacatgtgcatattgctttggatactcaagaactggaggagagtacaatgaaaggtctattaatatattaaatataacccctaaagatgaactctttactgatggaattgaggtggaggagggaaaaaattaaagtggtttataaagctgtgtgaaaatcaactgcaatgttatgtgtgtgtgtgcacgtgcatatgtgtttgccattgttaaaatagtgtttgctgtttaaatcatgtaattcagttaactgatgtttaaacaagtaaccaattgtctattaaatcatatttcactaacttttgaaagtgagctaagattaatagtaacaacattactccagacagattattgaaatagatctcattgagggattgtcttaccaaattgaagttactttttaactattaaataatttatgccctcaaatcttgtatatttagaagtttagtacagggggctatccaagtaagagataaactacaagcttgtaaataacatgaagagaactaaccagctgatatttaattcactataatttgatcttaaaaggtgttaaaatattgacattctggaatggaaacgtaacttataatatcacagaacaatgtagttgcattgatcagtttactattattaccagacttatatttttctgtttacatttatatattagtgaatgtgacatttaaaggtcacctgcagcatataaatccttcctcttattttcacttttaaaatttcattttaagaagtagtaggtgatgatttttcccctccccaagtattcttctcccatagttttattttaaataatattgtaatcataacaagatttaacgaatattaaatcgtattcataatggcactaaaaggtcaataaataccctaacaaattccatgcttttattcattttttttaaatgagaaaaggccagaaatgtcaaaattcaatttgaaaaacaatgtgtagtaaattcactttctgtaaatcagtgaatttctgcacttcgtaataataatcacactaacatgtaacatgtattgtgcttattctgtgcaggccctgttttaggaacttcatgcttatgacttatttctcccaacaaccttaggagataggtactattattatccccattttacaaatcaggggaaaaagagacacagagacatgacaagtaagtcgtagatttgggtttagaaaccaggaactgtgtctttagatgtttgctctcagccattaactgcatagcctagtactatgtatgttgttatgaattggaatttatccatattgtttgttttttaatgcttgatttaaaaagacatttccatctactaactgctatatcacatcaacctaaaaatagcaattttgcttctggaatagtgatgggatatccacaagtttctcttaattatatattttatgaggtctacatgtagaaaatctagtttctgaggcaaatattgtaggatttgcaaatcaactatgaaaaatattcctcagtctaactacaaatgggaaaatgggcaagatcttagacatccaggtggcgagtgctataaagaaccaaatttggtgggaacatgaatgtaaagtaagtccattattttctgaggcactgagtaatgtagatgggagaaagacaggtttcaagattgaggatgaagttgaggtttctaaagtttggaaagtaagtgaagtccaagaatgccattctatatttcgtggacagcgtctgagaagtaaccactacctgttgagaacaaagaaaacctatttgtggaatgttgggaaccccctgaatcaacatcagataaggccagaggttgatgcgatcctgaagatacagggggagcttttgggaaggctttaattatgctctgaagtctgggcctttgaggttcctgccaccatttgatgaactccattggaaacgtggtggactgagaggtgagaactgtgggattgcttatctccgaatcctgacactttatcagtgtcccagcctccaaatccaatttagtgaagttgttagtggagaagtgattgtcttcttatgtgcttatggtggggatcgttgagtaattagttaaatttatcatcaaaattatgtgtcacaggtgaatgggtaattgagctgtatcctgcagggactctcaaccctggctgaacttcagtaacctctaattttcacattaaacattttaaacattacaaatacctgtgtcccttcccccaagattctcattcattgggttaggagtgggtcctgggcataggtattttaaaaagcactccaggtgattctaatgcccagccaaggttgagaatcactaatctactctaatcttttcgtatggctgaactcattggattttaaactcttttgatggcagatactgtgtcttagatatctacacaccaatctgttattaagcaacagaataagcacaatacatgttatttgttaatgggattattattatgaagtgcagggcttaaaaccttgctgtctagggattcaaaccttttaagtgtctttcactgatttacagaaagtgaatttattacacattgtttttcaaaatgaattttgacatttctggccttttctcattaaaaaaaaacaaacaaataaaagcatggaatttgttagagtatttattgaccttttagtgccattaggaatactcctactcctacccttaaagaattcttcctatagaaggtgctcaaataattgcttaaagtgaacattcattttatatagacagttgtcccttagtatccataggggattgattccaggacttccctcggataccaaaatctgcagatgctcaagttcctgatataaaatgctgcagtgtttgcatgtaatctacacacatcctcctgtatactttaagtcatctctagattatttataatacctaatacaatgtaaaagctatttaaacagttgttatactatactgtttagggaatagtgacaagaaaattgtgtgtgtgtgttcagtacacgtagttttttttctaaatatttttgatctggggtttggttgaatccgcagatgcggaatgcatggatgcggagggctgactgtgtgtgtgtgtgtgtgtgtgtgtgtgtgtgtgtgtattcactgaggatgaagtgaataagggaaaggcttgtctagtaatgaggatgtatagtgtgttctggggttggaatgaatgagaaataagagcattgaattcgtggaatagcaggcatgctggaatttacaaaggccaatttgtggctctgactgcgtatgtgagtacacccttttttggaaaggaaaaattatatttgatagggttttcaagatgaatcttttctgtattcagatattttgaataatatgtttgttttacaagttgaggcagcttcccagaactgggagtagtctgattagactaacaattccattccctgattaactgtgggatcggaatctaagagaatttgtgtagttagaagaatctggtatgataatgtgtgggagtagcctggaggaataggctagaactcttgaatttctaaacttttcaggctttgatgccttgttacctaaatagattttaaggttcttgtatacataagctaggcccagactggattcctcaaatgcttttcaattgattgggcactgacttacttgagtgctttatttcctattcagacctcacttctttacagcatgtggacagaactgactcgccatcagcattacacatgcttccaacttggttttggttctgctactcagcttgcattgagcagcttctaagtttgcaaacagagggctcgtggggcctgctgtgacccacagacatatttttgtaggtctgctcagtgttatattttgacttagttgtcagcatttaaatattttgagatttcatgcaaaactccagattcctatcttctttgggggaaaagcaaattggaagctctgacaatgctgggctttactttcccacatagcaaccatcagttggagctgagacacctctgctctctttagaaagaattattaatgcttcagtctccattattgcttccctaacagtgaggataagttattgtcatcatgcttgactgtttttactctgtgcttattttctcacttatggccttaattcatggttgctatttggcctgctggtgggcatttgagtttgtgctcctggatcttctctcccctccctcctctttctctttctctccctctcacacacacatccccacacaccctctgtgtataatccatgcacatagggtttgctgaaccgggtttggctggttatctgagctgagttaattgccctgtgcgcgattgggagccacagccctgatttgtagcttgaggccctgtgcttaatcaagtggcttagttaaccaggaattcattcccagggtattctgtgctacagattccctttgaagaagttgggcaaatggtaatgttgtcagatttttgtgagactattttatgagtggactgttaaagacatctgaggagtgtgttaaacattcagagctttgggcctctcttggaaaatctaaagcagtgtagtgcagtagaactttctgggatgaagagatgttctagatctgcatctttcaagagggcagccactagacatatgtggttgttaagtagttgaaatgtgcctagtgcaactgaggaactgaattttaaattttaatttaaatgtaaatcgccacaaatggcttgccttagtggacagttcagatccaatgctcttctgatgggttctgtcagctgcttttggaaaccactggcttaaagaccagatcccaggcagtccttaacttgacattgctactcagttctgttgagaactttgccatcagaaagggatcttcagccactctttggtatccacaggtggtagagagagcctttaaaccttaaatgctccacctagacactagcacaaaaactagctgggtttgagagtaagcccaggttggcctcagtttacacctttggtgcaacaggctgaggatgtacatcctctgtctctggtactgggtggagagtgggccaagaaggagcagtgaacaaaaatctgggccatttttagtgagatttagatgcttctcgactgatagaaatactaaacaccttcagttcaattaagtcccagctatttatctttgcttttattgcatttgcttttgggttcttggtcatgaaatccttgcctaagccaatgtctagaagggtttttccaatgttatcttacagaatgttgtagtttcaggtcttagatttaaatccttgatccactttgagttgatttttgtgtaaggttgagaggtgaggatccagcttcattctcctacatgtggcttgccaattatcgcagcaccatttgttgaatagggtgtcctttccccacttaatgttttcgtttgctttgttgaaaatcagttgactgtaagtatttgggtttatttttgggttctctatttctgttccaatggtctatgggcctatttttatactagtaccgtgctgtttggtgactatggtcttatagtatagtttgaaatgagagcttttccatggcaaaaggaacagtcagcagtgtaaacagacaacccacagagtgggagaaaatctttgcaatctatacatctgacaaaggactaatatccagaatctacaatgaactcaaacaaattagcaagaaaaaaaccaaacaatcccatcaaaaagagggccaaggacatgaatagacaattctcaaaagaagatatagaaatggccaacaaacaagaaaaaaatgctcaacatcactaatgatcagggaagtgcaactcaaaatcacaatgtgataccacctcactcctgcaagaatggccatcatcaaaaaattttaaaaaaataggtgttggtgtggatgtggtgaacagtgaacacttctggttggaatgtaaactagtacaaccactatgaaaaatagtgtggaggttccttaaagaactaaaagtagaactaccatttgatccggcaatcccactactgggtatctacctagaggaaaataagtcattatatgaaaaagatacttgcacatgcatgtttagcagcacactttgcaactgcaaaagcgtggaaccaacccaaatgcccaccagtcaacgagtgggtaaagaatctgtggggtgtgtgtgtgtgtgtgtgtgtgtatatatatatatgtatatataaggctatatacatatatatgtatatatatggctatatacatatatatggatatatatttatatatatccatatatatatatatatatatatatatatatatatatatatatatacacacatatatataaaggaatacacctcagccattaaaagagagactgaattaatggcatttgcagcaacctggatgagattggagactattacggcaagtgaagtaactcaggaatggaaacccaaacattgtatgttctcactcataagtgggagttctcactgacacaaaggacttcagggactcagggagaaagggtgggaagggcatgagggataaaagaccacaaactgggtgccgtgcatactgctcaggtgatggatgcaccaaaatctcacaaatcaccactaaagaacttagtcatgtaatgaatcaccacctgttccccaataatttatggaaataaaaaaattttaaaaatactaaacatcttaagcacatgcttcctggaacctacactctcctgacttttttcctatctattgtccattctcaggctctttggttgttccttctttcctcctctacgtcttagcactacagtaccccaggactcaattcttaagtctccacctgtctctctctgcttacagtaatgtggttccaaataccactggggtagttccagcccaggtgtcttccctgaactgccagctctatatacggctttcttgaccctttgcctggacatctggtaggcatcttacacttatagcatgcccccaaatgaattcctaatccccaactccaaatcaagtcctcctacaatctaagcatgtcattaaatggcaaggccatctttctagctgttcaccagaaatgcttgtcatcacccttgaccaatgtttttctctcatgatccacatacagtcattctgcaaatctggttgactctgctctcatactagatttggaatctgactacttttcagtctctttcctgttagtatactggagcttgatttttattatttttttctttaaatagactttagtgtctccatttctgcccccgagactcccacattactgtctctccttaacacaaaagctagagtgataatttaaaattataatcaggtcatgtcattcttctactgaagatcttccaatggtgcacatctctcctaaatggccttggaagtgctacatgatctgactatctgtgcagaaaaagttaatgtagcaggcctgagactgctatccttagaaagccctgcttgcgaagcggggccttggctggtggcatctggaaagttagatttgtggagggctaccatcattcccttatcggaatggctcactgtgcaaaactgtttctgcaaacaatatggcttatgctgaacacctgctctttttctgggagtctggaatttttgtatatgctaagcagaaggtgcctatgtgatcagtctgcagtaaaaaccttgggtgcttagtcactaatgagtgttcctggtaggcaacatttcgcacatgtggtaagaactcactgctgggggaattaagcaagtcctctccactaagggaagacccttggaagcttgtgcctggtttcctgcagacttcgctctgaatgccagtttgttttgctgatttggctttgtatcttttcactaataaattatatccatgaagggcctggtacggtggctcacacctgtaatcctagcactttgggggctgaggtgggcgaatcacctgagctcaggagttcaagaccagcctgggcaacatggtgaaaccccgtctctactaaaaatacaaaaattagccagacgtggtggcacacacctgtaatcccagctacttgagaggccgaggcaggagaattgcatgaacctgggaggtggagattgcagtgagctgagagtgcatcactgcactccagcctgggcaacagagcaagatgccgtcttaaaaaaaatttatatccatgagtatgagtatatgctgagttccttgagatctcttggtgaatcatcgaacctggaaggtcttgaggactccagcaccctatatttgacctctctgacctcatcatctaccacacagctgtctgttctcctgtctcagtcacactgatcgcttgtcatgttattcaagcatgccagacagactcttacctagtgccgttttctctcttcctaaaatattttctctcagttatccacctatctgcttctttcatagtttccatcttaaataattgttttcttcttcaggaagccttcctaaccaccctatttatgattataaccttctgagaaccctttctattgcccttccctgatttacttctatctacagaccatattcttcctaccataccacttattttaactgtatttcttgtctccatcactagaatattaacttcaataaaggtagagatatttgtctcttttgttcatttctgaacccttagattctagaagagcaccaggtcatagtagggcatcagtaagttcttttcaaagaaataattattttaccatgcatccatcaccacctgttgcagctatctcttgttgtattacaaactatcaccaaaatgtagtagctgaaaataccactcaacaacatgattgtgtaggtcaggaatttggaccaagcacatgggggaagtctctgtgtgatgttttctaggtctgggatgctcaagatggcatcttcactcacatgtctagtgcctcagctagaatggctctactagctgtgaagataaagcagccactctcgggttttgatgagtttcatggcctcctggatgataaggcacacacgtgaataagccagttttgctttagtggtatgtttgcagggatacaatatagacaaataatgccctttgaaagagaagacactaaagccgttttgaaagatgatgaagaattttccacgagaaaagtgagataagacattctaggtggagggaaaaaagtggttgagggagttgtgaaaagttgagcgtagcctggagaggagtgggtgcacacactaatttggaccagatgctgatggtccttgggtgctgccctaagggattttcatgctgtcttaatgtagctctccattttgttacgaatatactcacattttgcttaatttgcatgagtttaaaaatatgtgtataaacttaaaatggagcattttcagaaaattggggaataaattacctaactttgtagtatgtctgttaaggcctcatcacttggttggttatgctggttttcacacattcccctgcaaaactgttttcaacaaaattatcaagatctagtagctaaaggccatggttaccttttacttcttgtttttgatgatgtcccaccttttaaaactctctactcatgggcttttcaggatttttttttttttgagacagagtctcacccaggggcttttcaggattcttaaacatctgtcttctttgagtcttcacagatgccctctctgccatcttcttgtatgttggtacactggggttctggcctcgtcctccatgggatctcattcaccacatggcttcacctacccgtaaatacacacttctagccctgaacttgctccagatcccaatatctgcctgcctctggacttcattacctggatgtcccacagacaattcaagcccactctattctctgtgaatctgcttgccccattccttgtagcctgttactgcgcacatggcaccatcattcacttggttgtctaatctagaaacctggatatccttcacacctccctcatattccaccacatgtccagtcgctcagaaatttcctttgatgctttgaagttatctctcttggatctgcttcctccttatcgtctctacatcccaagaacagagagtgagtcttctttattttcttatctctgtttttagcacagtatttgatatatagtgtagatactataaatgcttgctaaactttgtcaaattccacatttttaaaataaaaatgagaatgagcttgtagtcaacatggcgtttgtaagtttggagtctatatatggtagatatacatatttttaaatctaagtgcaacttttctcttgattatcttgaaatgccttatcatctccacatttgctgtaggcagtagtttagtggtccattatatctgccacactgattgtcttaaataacagtttcaaattctgacaggttgacttgcttcttagatttttcagactgagtgctctgtagttatggattttccatgaagcaacataatgtttttgcttcatgcaggtttgtgtgatgcagtctcttgtgtttgaataatgtttgattttcagcattcattaatttcatgttgattttaaaattatctggactacctcaattttgatggattctttatttttgacaggcatgatatctctgtcttaggagctactaaattgagcctgcctcctgttgctgaactctcgttttttggattgcaatgtggtggaattgcaggatatcaagacaggccggttaaaaaggttttctctcagtttagtctctatcagatgcagtgccaagtatcttccagataaatatgtcctgcattgctcttgtccgctgcctcaagttgaggatgttaaactctctgagttgtccctgtttgcagatgacatgattgtgtatttagaaaaccccattgtctcagctcaaaatctccataagctgataagcaacttcagcaaagtctcaggatacaaaatcagtgtgcaaaaatcataagcattcctatacaccaataacagacaaacagccaaatcatgagtgaactcccattcacaattgctaaaaagggaatataatacctaggaatcccacttacaagggatgtgaaggacctcttcaaggagaattacaaaacactgctcgacaaaataaaagaggacacaaacaagtggaagaacattccatgctcatggataggaagaatcaatatcgtgaaaatggccatattgcccaaggtaatttatagattcagtgccatccccatcaagctaccaatgactttcttcacagaactggaaaaaactactttaaagttcatgtggaaccaaaaagagcccttattgccaagtcaatcctaagcataaagaacaaagctggaggcatcatgctacctgacttcaaactatactacaaggctacagtaaccaaaacagtatggtaccggtaccaaaacagagatatagaccaatggaacggaacagaggcctcagaaataacaacacacatctataaccatctgatctttgacaaacctgacaaaaacaagaaatggggaaaggattccctatttaataaatggtgctgggaaaacaggctagtcagatatagaaagctgaaactggatcccttccttacaccttatacaaaaattaattcaagatggattaaagacttaaatgttagacctaaaaccatgaaaaccgtagaagaaaacctaggcaataccattcaggacataggcatgggcaaggacttcatgactaaaacaccaaaagcaatggcaacacaagccaaaattgacaaatgggatctaattaaactaaagagcttctgcacagcaaaagaaactaccatcagaatgaacaggcaacttacagaatgggagaaaatttttgaaatctacccatctgacaaagggctaatatccagaatctacaaagaacttaaacaaatttacaagaaaaaaacaaccccatcacaaagtgggcaaaggttatgaacagacacctctcaaaagaagacatttatgcagccaacagacacatgaaataatgcttgtcatcactgatcatcagagaaatgcaaattaaaaccacagtgagataccatctcacaccagttagaatggcatcattaaaaagtcaggaaacaacagatgctggagaggatgtggagaaataggaatgctattatgctgttggttggaatgtaaactaattaaaccattttggaagacagtgtggcaattcctcaaggatctagagctagaaatatcatttgacccagcagtcccattactgggtatatacccaaaggattataaatcatgctgctataaagacacatgcacacatatgtttatggcagcactattcacaatagcaaagacttgcaaccaacccaaatgtccatcaatgatagactgggttaagaagatgtagcacatatataccatggaatactatgcagctgtaaaaaagggtgagttcctattctttgcagggacatgaatgaagctggaaaccatcattctgagcaaactatcacaaagacagaaaaccaaacactccaggttctcactcataggtggaaactgaacaatgagaacacttggacacagggtggggaacatcaaacactggggcctgttgtggggtggggggtctggggagggatagcattgggagaaatacctaatgtaaatgacaggttgatggttgcagcagaccagcatggcatatgtatacctatgtaatgagcctgcatgttgtgcacatgtaccctagaacttaaaagtataatagtaaaatgtgccatgtaatcagtgaggtctcagtcagacttccaattaggggatcctgtgtgatgattgcctgtaacaatctgatcatctaaaagtcactttagtcacatggaggaagatttagacagtgactttgggtcagtattgtgttttttgctgaggatatagagtaaaataagacacagcttctgccaccagtgggcttatagatttaacaggcatagaggagcatggcaacaaatggcatggtatgatcaaggtgctttggggcaaggggaggtggggaagttgagcaggtttcactccatgagctgtacgtggccaggggtttgaaggatgcatggacagttgccagggaagtaggagtggaagatggggcaggacatgagggaggggtgggggcagcctaccgctgtttgaaggtaaacatgtatgttttgtttgaaggaggaggttggggagaagaggatagaattgtgggaagtttctccaggacagttgtgggacgggtagtagggaaggagtaagggtcaaagccagagttaaggaagcatttggggcaggatggagatattgttggacctaccttttttattgattgcgctagagagtggagatagagggagctgggactggaggtggaggaactggctcaggtcctgctgttggagtggaggttagatgtattgaagcagaagcagaaatgagctttgaggtttagggggcaaagtaattaggcttgggggttgactctcagtgggaagagaagtgtaggtggaactggggagagggcgcagtctctgagacatttcagtgaatatgcctgtgttctggccacccaggctggggttccgagataactaagacatggcctttgctttacagaacctgatagatagggataggagaggtgggagactgagaacagatgaaagggttggtgagcagtgtgagggcctggagcaatcagaaatcctgagttcgtaaagatgccaatcttttgcaccagttgttcagcattggattagagccttgattcaaggttgggattagagggcaggtgtgggaacaacctggtgctcagaaataaaagttgttaggctcagttaatgaaagtataaattgatatgggtggcttttagactttggtagtcacagtggctggaaatcttcctttgttcctccggacccgctcttgtcccttttccagtcccctctgtgacccaggaggctgagctgagtggactttcttgccctctggcttctagttagggtcggccattggggaagccccagtgagagaacaagagggtgggcagctccattcctgccaggtcactgtgggctggctgcttccctttcctaaagtccacagctctagccctatgtactcatctcccttgtattttttttttttttttttgagatggagttttgctcttgtcacccaggttggagtacagtggtgcgatcttggctcactgcaacctccgcctccagggttcaagtgattctcctgcctcagcctcccgagtagctgggattacaggtgcacgctaccacgcccggctaactttttgtatttttagtagagacggggtgttgccatgttgggcaggctggtcttgaactcctgacctcaggtgatccaccagcctcgggctcccaaagtgctgagattacaggcgtgagtcaccgcgcccggccatctcccctgtattaaggtcactcctttacctggcctgttgggtctcaaacaatggcaagggattgccgctgttaggaccattgtcccttgatggtttactgccaaagtttggactaataaagacagaaatatttgcctgcatgactcagtatctacatacacacacacatacaacaaacccccgtgccccacccccagcctgaaacaaaagtttcaggagagtacttacctttgctgtgaatgatgccctcagatttctaaattctattttgtttcactgaaaaagtagttggggtgtgctaaattgatttcactaatgggttagggcccatagtaaaaaaaccactggagcttcctgatgtttatggacacaggatggaccatcagatcaagtgactcagaaatcctcacagcgctaagatctgattgcttatagatttatccaaagtgtgaggctgaagttaagcttctaaaatgaacttaaactcctaaaatcaaatgacattgtaggtgttaataggtgaatttttctgtggattataatgccacgtaccttatatgtgtaatagagataatttttggatcttgagacttgtgtatggctagtgtgtgagctaagagtcatcctggcccagaagtcgctgtggctttataaaatcttcgagaaactgaaagagttttacttgtcatcttgtttttcttttgtcatgacatggtgatagtattggtaactttaaatattaggtctggattacttccttttgtagcaaagagatgaggaagtgtaagatggataaataatccttgcctctgtatttatagacacatttatagagattcagtgggcttgagttttgacagcagtgtttgatcagaaacattttcccagaaccttaaaaaaaaactgcagttcaaatatttctaataaaaaaaatttttttttttcgttgctgtaactagatttgcatttccgatttttctctctcttgtttcacttttgtctgtggctgaggaagggccacttgggaaatgcagctgtgggtcgtaaggagtccctcactctatcgctctgtgtttcctggggctgccatgacaatgtaccacaaactgggtggtttaaaacaagagaaatttattttctcacagttctaaagtctgtagattcaaatttaaggtgttggcagggccacgcttccttcaaaacctctagagaaggattctttcttgcttcttccagcttctggcagcccagggcatttctgagctatggcagcataactccaatctctgcctccgtttttacatgccgtcttcccgctgtctctctctctctctctctctctctctctctctctctctctctctctctttctctcttctccctttataaggacaccagtcatactggattagggtccaccctaatgacctcgtcttaatttgattccatctgtaaagactctgtttctaaataaggtcacattcataggtatgggtgggggggactgggatctcaacatactgtgttttggaggataacacacttcaacccataataatggcaatttgtttttaatgcattttttcttgcttttccactaagacacattgggggaattctgttgatttccccattgcctttcttacaatgttactctctttatttcttatatttttgctccaaaatagtccacatataataatcattctgtattattgagaattgaaggttattggtgtgattgacttatctactaccttctccatgtaaacattttggtatctgcttccttgttctcatttaccttttcagttgacacttttgagactcatgtatgtcctaaattctatctcatgtcacatcctttgtggtctgctttattttttattttttgagacggagtcttgctctgtcacccaggctagagtgcagtggcgctatgtcggctcactgccagatccacctcccgggttcacgccattctcctgcctcagcctcccgagtagctgggactacaggcacccgccaccatgcccggctaatttttttgtatttttagtggagacggggtttaaccgtgttagccaggatggtctcgatctcctgaccttgtgatctgcccacctcagcctcccaaagtgctgggattgcaggcgtgagccactgcgcccggccagtggtctgctttattaagcattgattgaagcccagtggctggtatggattacattgctattcagtctgtaattacgttcttttacaggtggcaggtggagtgttttggagcatgtgtcatgtcccccacgtagctcagttcctttccttcggggcttcacatgcatacattttgaaatgaagaaagccataagcaggtgccagatgagtttcctgggcactcagaaggaagagagcctgcagtaggctggaatggccaagtgggaaaatggacagaatttagacaaatgcagtagaggatgagggagagtgtatcatgtggcagagatgatggaagtacaagcattgtagtagttcttaatttgttgatcctaacacccctttgccctcatattttcttagaagacctgagggaacgtttcatgtgcgttatatctatatttatcatattataaatcaaaaatgagaaattaaaaaatatgttcaattgatttaaaataacaaagtgcccattacaagttaaaatacttatttttaggaaaaataactacaaaacaaaaaaaaatgtggtgagaaccatagcactatataccatttttttgcaaatctctttaatgtttggcttattagctggattctcaaatctgctttctcattcaatctgttgcaatgttgttttgatttaaatatatgaagaaaatcctgcctcatacagatatgtagttggaaagggagaagcattttaatagcttcgtcagataattgtagatatgctttttgtagatatactacatgaaaattcagtaagttatagtttctttttcttgcttaaaaatacatttattatatcacagtttctatgggttagcagtctgcacacagcttagctgggtccttttcttagactcaccaggctgcaatcaagatatcgcctaggctatgctctcatctggaggcttgactgggaagaatctgctccaagctaactcaggttgctagcagaacgctttccttgtttctgtaggattgaggggcctagcttttttctggctactagctagaggccaccttcagctcctggaggccacccttctttcctagaggtcacctgcagtttcttgtcatgtgggctttcttaacccaactgcttactttatccagccagcaaggagtctctagagcaagtcagctcgcaacacggagtattatataatacaacataatcatgggagtgacatttcaacatggtttcttaaaggttcattgcaatgttgaatttggaatcacaaccaatgaaatattcatactccattacaatgcattggttcatgtggtactttgactgatcttgtattcctgtgtgatttaataccatacattggtcatttggaaactattagttcactgagttgtatcagttttccaaacgttgacatatttcattatataatatcaaaaactacgcatattaacattactatcaatttcatcagaaacatctaagtattgagaagctatcaagctcacagtggtggatacaggtgttaaaaatttttaatttttggattatgattgacaacaaatgctgtcatctgttttccttcaagtgccgaggtgtacatcattcattctcaagaaatacctatcaaaatctcaagaataaatatccagagttcatctgccagtcattcccttcaagcaaaaatggtgcaccataaaaaaaccagttagttcagcctgcagctcagtcagtcaatcaatcagaggagtgcttttctctgaggtgaccactgtacttcagtatgcggcagaatgctttatgtgtacttcccatttccttacacacaatgtcaaaaacatgtgaaatcaaaggtcaagagataatgaaattttacctgcttcatcaagggcatgcttacattattttttaactaccaatgagtggcagtgaataatattaatacaatgactgctagtatagtttagtgtcactacctccattcaagctaaggcatcagtagtgccagtgttgaacatagttgtttcaaggataaaccatgagattccaaaagttattagacacattgactgtttaagcaccagtgtttattttcagaatttcacatttaaaaaaaatcttcaatcagcatcagcaccaattagtcattttataatccatttgtaaggcaaaggtacagctctgcagttgggatgtgaactcagtcgtcatgtttgtagacaaacctttcatttgaggagttactgtgtcattaggaaatggcactgccatgttttttttaaactaacttatccagcaggccttcagcaatgtcagtggtacaaagttttcttagtgtctcagttactgtgtgtttttctccagctaatgcagtatgataccctataaggtctttcagtggctttttctcttctctcttgaaaaactacaacaacgtttgtcttataaagttctcatcatgtctgcattaaaaaaaatcaattccttttcctttaaatccttagtgattattttcaaaatgatgttgcaactgaactatttgaaaatattctgttgcgtaagacatagtataaattactaaatatctataaagacaaggtaaagacaactttgttaatgtttttgtttatttataattttcctcagggttgttttgattttttttcttaagtagttgcttcccttccatggatcagaggcctctaatgtgtcagtttcatcttttttagtatctttaggcataaaaagtatgtatacctgtgggtaggaaagcaggctttctaaacctctttttttttttttttgagacggagtctcgctctgtttcccaggctagagtgtagtggtgcgatcttggctcactgcaacctccgcctcccaggttcaagtgactctcctgcctcagcttcccaagcagctgggattacaggtgcccaccaccacgcccagctaatttttgtatgtttagtagagacggggtttcatcatgttggccatgctggtcttgaactcccagcctcaggtgatctgcaaccccttagcctcccaaagtgctgggattacaggcttgagccactgtgcccaggctctaatcctcctcttttatgttggatttttttttcgttaaaacgtacataacataaaatgttccattttaagtgtatagttcagtagcattaagtatattcatattgttgtgcaactgtcgccaccacccacctacaaaacttgttcatcttcccaaactgaaactccatacccattaaataataactccctattccccactcccccaggctctgacaaccaccatttactttctgtctatgaatttgactactctagatacctcagaagtggaatcgtgcactatctgtccttttgtgactttattatttcatttagcgtaataatgtctttggttaattcatgttgtatcatgtttcagaatttccttccttatcaaggttaaagaatatttctttgtatgtatgtaccacattttgtttattcatttatccattgatggatgcttggttccttccacttttggttattgcaaatagtgccactgtgaacatgagtgtacaagtgtctgttctactctctgctttcactattttcgggtgtatacccagaagtagaattgctggattatatagtaattctatgttttattttttgaggaatccccctactgtcttccacaatgctgtatcattttacagtcccatcatcagtgagcaaaggtttcaatttcttcctatctctgccaacatttatttctgttttaatagccattctaatgggtgtgaagtgtctaatctcttttaaggcaacaatccatctttaaatataaaaagttagatatttattttagaatgatatagtaaattctaaattatagttttcatacaactaaaatatttagaataatttttgaaaagatttaaaatactattgtaaatctgtgaaatgacaaatcaaaagggcaaataaccttttagacttgagaaagagttttgactttgcagattttcaaaaaaggtattgggatacctaggggtttgtagaccatacctgaagaactgcttgatgaaatatagtattagaaacatggtctcagcttctcatgaaactctttccataggtggataaataatgatttcttttgatttacaaatttgtttactaagaacttaaaaaatgttttttcacattctacaacaaagattttatttaacaataacagaaaaagaaataacaaatcagttgccatggaattaaagttgggaaagaagaatgttttgttcttgactgggaaaccatttagaactggcaatagaaggcaggaataaattgtacttttctgacaataggaatgttttaagtctgttcttaatctttaaaaaaatttttttaagatcatttaaggagggtgtatgtatcagttttcaagttaagagatttctctgaagcagcaattacaacacttatttaaaatatttgaaatatgttgttagaataccaattaggtaattacaagaaattattgaaatttcattcaagaaaaaattacaggctggtttcggtggctgacacctgtaatcccagaactatgggaggcccaggtggatggatcacttggggtcaggagtttgagaccaacctggccaatatggtgaaaccctgtctctactaaaaatacaaaaattagccagatgtggtggtgtgtgcctttaatcccgactactcggggggctgaggtaggggaatcaattgaacctgggaggcagaggttgcagtgagctgagattgcgccactgccctccagcctgggtgacagagtgagactgtctcaggaaaaaaaaaaaaaaattgcaggaaaactcaggcatattattttgttttataacccaaatatatcattgctttaaatgacataccaaaacccatcagcatttaaataagcttatttctttttcttcccatcagccatctactgaatattgggagtgtggtgctgaaccgcagcctcacctgaggtcaggggaagactcagtttttttgctttcactgcacagtttgcatatttaaacattcttgaaaagaattgctctaaatatcactaattatctccatgcgtatagctcttatcttttatttttcatgaaaccaaaggttgtgatctctcatctttacaatatgacatctttttacttagatttagatgctatatgaaaccgtaatgcctctctttaagctccaattcagatagtagatttggatagcataaatgtttaatactgtatgtaaatgtccacatataggttgaaattataagatgtgtaacatagagtagtaatcatcaaataggtgacagatatccatgtggctattcattggggaatgtgactgtgaatcactgtattaaattcacctcctgcagtcatgggctaggcggtgtccattggtgctgcctagcattcttagttttggccattttgtttaggtagatagttgtctattaagcaagatacttactgtgtgttttgtaactaaaaattgtttgagagaaattttagatcttccctttggtttcaacattatgaagtatgaaattatgaatagtgctttagattgtcccatgcagttaatgatgaaaaccagttggagaaggtgatgagagcactctaagaaaactacttatttgtgcaaaaaagtggggagatgatgcttaatgtggggatgcttcattgcacattgggccacttgttgctatagtctcaaagatcatgatgttaaacatcatcaagatgatacaaaatcaaacctttctctgaacgtttgccatcctgtctcctgtttgggcctggaatattgagctgagattttgtaagtgtgtggcaaaatttataacggggctacaagacactcagagtaatggttccaatgactggaggtgtgtgtgctgatcattactgttggagtcaagatattggggcctcctttgtgaaggcaaggtctgaaagggaatgaaatttcatagatgaaggctacaaagtcacaaaatgtacagtaaagtatgaattcacatctgcaagggagagcttgttgtactctgagtgagccaagtcttgcttccagtgagtgtctggttcattcctcacataggcagcataggtgggaagtataaagaacttggctgtgtttatgaaagagacagctttaacttctcagtggggctggactgtagctcacctttagggttgatgttgggaagacaaataggctgctttgtgccgccttctgtattagcaaggcaaagaacagcttgacagtttctttgctcttctgacatgattctgtccatctagctggaatagggggctcaatttctgaggacaggtagctgagaatattgtggtttggggacctctcaaaaatacggagagtcttgtttgcctggataggagctctattccaaaggtgagggaaggaagtgataatgacttgttaaaagcaaccttttaggtagattgaccaggggcagagtttacaggatgaatgggaaatgagaaagagtgaagttcaaacaggtaagctgttgtaactgaggtgtataagctgttataactgaggtgtatgagctgttgtaactgaggtgtataagctgttgtaactgaggtgtataagctgttgtaactgaggtgtataagctgttgtaactgaggtgtataagctgttgcaactgaggtgtataagctgttgtaactgaggtgtataagctgttgcaactgaggtgtataagctgttgtaactgaggtgtataagctgttgtaactgaggtgtataagctgttgtaactgaggtgtataagctgttgcaactgaggtgtataagctgttgtaactgaggtgtataagctgttgtaactgaggtgtataagctgttataactgaggtgtgtaaatccggctgctgttagttctgatttctggatactttatttctactacttcaggcaatatttagagtagaaaatccactaacttgcattggctggcaaagaaggtgaaatagatccatgtggggttttgggaaaaacactgaacttggcatctggccctggggatagccctgactcttctatgaatatgaactagctctgaaaccgtgggcaaggcccttgaactctcaagacctcaggcatagagtagcttatctctaaagctcatccccagccataagagtgttttctagtgtcttatttattactttcaagtacacatttctaagtactaataacttttacatgctgccaaggagtggtcttttaggggcctattatgatgaagtatgatgaatagataactcatttgtaattaactgtgtgtatgtccatgcaaacaatttctgagctctaagtttctcataataattcccttcccataagtagggttaagcccttgaaattttgtttgcatttttaatttatacggaaaatgaatttttctgagatacctatatctcgtctccctaattagattgtaacctccttgaaagcattttgctttgttttgttgtttgctttttggttttaatccattataatgccttaaatagcactatgtgtattagggacttaatacagtagtagatgagtgaatgagaagttagagcataaactttagttcagaccaaattattgtgaactttgaaatattgtaacagaaattaataaagatgtaagtctatgatcttatattactgtccttaattaaataatgtgtgtgtgtaattattattgccgtggctacatgtaaatgtgacttaaaaggtcaatcacagtgaactgctacagaaaaaatggtaggagtggattcataaccgtgtaactttttttctctatactgaaaggaaatatcattttctccccaagatcagtctttgagtaactttgcggatctagaatagtgccttgcaattggggaagggagaaagggaaagtaaactgaagagttcagaagtgacagtggtcagttacatagagaacaaagtactttgttagttttctggccagatagaaaagaacacttttcttgactggagatgatttctgagatgaaagctttctaagatatggggtgcctggcctccacatctagtttctttgggagccagagacaagaggggataaaaagagaagcttgaaggaggaggaaaaggaggggagggtacatgtagtgggaatgaggggcagagtagcagacattattgcagaaaagtgggggaggaaagaaccaggctggaggggctccatagcctggaaggaagcagccctctccctacaccagtagctccctcaacctttgttctccttccacctagcatattaattgctgttcatgatgataaatctgaccactagttacagggaatggggctttttaacctatattttaggactttgcatcataagccaattaaaagagatgtctagttatttatcagaaatatttctataaatacagaagctgtgtatttttttcctgacaatatcttagttgtttggtcctttaaggaactgagcttagtaggtaaatactctagacagctgtgtaaattttgtaaataaaaatcagaaagctaactattcatttatgtagccagcattcattggctggcaaacgtgtcagaaactttgccagccaatggaaatacaataaagatactatgtagttcctaccctcttgtaggaagctataattctgtctgatggtgcacatcacttataaagcaccatgtctcagagaggctgctttggaaatgaccactctcttcttgggaaattgggatttcagaaggcctcctggaagagatgaaacttgacttctctgctatcttaaattattgactcaaatgtgatctgttagctaaagccacagagactgtgtgtcaacataggtgactgaggacagctcaacttggctggtggctataccattcaatccatctgctcttctcttgccaccctgagtccggctgtatctcaagtgtgatgctggagtgaaatgtaagaggcactctgaaattgacccaggtctctatactctgcagtctctatactgtccttctcataactagttttcactcttgatatcttttccactagaatgtaagcagatttgtgggcaagataaccatagcaatatggtagtggtgatggtgatgataatatgtaaaattcatggagcattactgaacaccagtatgtatgcgtgacctcatctgatgcctataggctctgcagctggtagtggggtggaggggctgtcattctctcctgacttagcagtgatgtcattgagacttaaagaggttagatgaccctcccatatcagtcagcagcaccaggagagagatggttacttgtcctttttttgtggatgtgtccatacaacttccctgccacatgcccagctaatacaggtttttgtttgtggtaagtaataagcgacagattctgctctgtagggtgagtaagttccatggtttctcctcgttgtgattggtataccatcagagtgtccccgatgcccttgggtactaaggcattgaaatacacatcactgtttgtccttctgccttgctcttctcctttcattttaccagcaaagactgttttcttttgtcagagtctacagctcagcactcctgcttagtttctgctcttgggcatcacctctgtcactgtggctcatccccaggccctttcagacactgatggcacctgctgagcccagggttaactactttctttactcctctttattcctctactgtcttatagcgtctccaagtatgtcttagcagccactgcaagaggttggccagctaggtaggcatttgttttgcttgacttgaccagtcactcactgtcagagcatcttcctatttgtggcctttcttctgggcttttccctcggtgggtgtgggagctcaagactgctactttgttctcagaggttgttgtttgtttagttattgtgtacagctgccaagttggagctgtttaagaaccatgatatcagaaagatgcttcattgcaatagtagctgttgattagaaacaaaacaatctattaatttcctaactttattatcatttatgttctatctccttctaaaagaaattatgacaaagttttcttttttaaatgaatcccaactagcagtgatctcatactttattcataataaattttgtttggatacatgtattttatatttttagctctctggttttgacagaatgactttcccctcctttgggcaatttgaatgttcttctattatgtagatacttaacatctgtgagaggttatagattcttgatttttacacgatggtctaagggagacatctcagtatggacaggcagcatagcgtgtttgtcatttgtgtgggctcttgagcaagattttctagattgaagtacaagctctgccatatactagttgtatgatcttaggcaacttacagtcactgtgcttctgttcttatctgtaagatggcgttgcagggttgctgtggaacgctaaatgaggtcacatttctgaactgcttatatggtgctggacacacactaacaatctaagtgtgtcttctgtatcatgtctgtgtttctcaagcagactttgagcaggtccagctatggtatctcttcccagtagctacatggggcccaacacatagtttctactcaggtttgtgagtagatacatgaatgtataaattaacagcatacgctttactaaatttccttagttaattgttttttatttaataagttgttcttccaagttccagttctctactcttcagatgactctgctttagttatgggttttttattgattcattataattactttgctgatgtttttttttctggctgtcatagcaagcagcagtcattagctacaagaagactcagcaatttagtaagaactgtcttggttttgagttgtctaccaaatataacttaacctaagacagtaatatacatggtttcattacaatctgtatattgttaaacatgcataatttctaaatttatgcaaacaaacattcattgctgtgtgtctcctaatgctgtacttgaaatgaatttgcttttggttttaaaggcattcatttaatggttggagtgaacctttaaaatattaattgcatcttgcttttaaaaatttagacattaagccactcccatgaaaactcaagttataaagaacctaagaattatttaaatagttcagaaaatatgatatgtaggcttcttttaattcatagcaatatgtaaattattgaccctctgaaaccccttgatgctaagaaagcagttctcgttttcctcttccattcgttgatacagctgaactggcattttctcttcccttttgtatagaatggacttaggctggaaatgcttttggatgatgtggtacttgcgtgtggtgtcatctctgctagagatgcaggcccctgcctgttctcctcctggctctctctggctgtggggctcaccagtgctgagacagctggagctgactggagtcagcactgtaatacactgttagaggttgaggataggtgtgcttggttgatttaacactttatttacctggtgagttcagcttttgtggtcttggatgattcctgtgctttgttcagtagaatcagtcttcactgtccccttagatataagcccctgtggagttccaaatctgttagtcctgtcctgtgatttggttgctcaggcggttcttgcccttgctatggggagccttgatacatggcttgtaggtcctgccatgttaattgactgttagtctaatatcgtatctctgtattgtaaggttttcaggttacaaacctcttatctcttccttctggggacccacttccccctaatctcccttattttagagttactgaagtagcaactagaaccttgcaataaatagctctctctgccttgacatcatctagcctttggtctgatttttgaatatttgatttggatatttgactctttttaaagttacacagtagcttgagggtgccctaaagagaactgcctctggccagcaggctggggtgctgctatttttgaagacaggccaccctaaccttgctacactagaagtttgtgcgcaagtaccctgggacacaaggtacatttgaatgtgtctctgtaatcaccagcaaaagaaggggagttggatctaagtttacttttcttatggcagtatctgttttgtaaatcaatgaatacccatacattgttgcggcaaagttttttttccagttaaaaatgataactcttctatctggtggttctcaacatgatgacagcatgcatgtgtgtgtgctctttttttcaattaacaataaaataactcctctaatgctgatgcaataggccggtggttctcaacctgacagcaggatgtgtgtgtgtgcacgcatgtaaatgaatatacatgcttgagtgtggttatattatataatggaatcaccagtgagacttttccacaataaacatgtctagtttctacccactcccacacatttggtttcccaggggtggtggcgagtgtttgagtcatctacaagttctcatctgcttccccttatggtgtctttcaggcacactcatgagagggttgtaatcatttgtcatggatcataacaacaatatggaatacaaccataataacatatactgagcaattactgtgaatccactgcacaatcagaaaccgtgccgtgtttttaatggatatttttctcttgcactaagctagggcattgacttcataattctaccatgatagtgtttgaatttgaaataaaacttgaaaaaaattatttttcttggggggggatgggatagttgggtttcgtaaattgatcagagtgtattgtttttaactctaccagagaaatcaaaataacttatttacatatctttgtactgcaggctagagctaacaaatatttataatattgtgtggcactattcatactacatggcagatgaggaaccttgggcatagaaagttaaatgatatgatgataggaatacctagtgtttaatgtgtgcttaatatgtgccaggcactttctaaacactttgcatatgttaatctatttaatcctcacaacaattccaggaaacatttactattatcattattattttgtaggtgggtaaactgagtcttagaggtttagtacctagcccatggtcacccagctggcaatcggcagagcccggttccaagcccagcctgtctggctcatgttgcacaattcccttggaataaaatggggatttgaactgggtcttctgcttcagtactttctcttagagctacattgccccggtttttaaagggttttctcacttttatttggttttaatttttttagagacaaggtcttgctttgtcactcaagctggagtgcaatggtgggatcatagctcaccgtaaccttgaacacctgggttcaaaggatattctcacttcagcctcctaaggagctgggactacagcatgtgccaccacacctggctaattttaaaaattgtttttttttcttttctttatgtttctcatgctggtctcaaactcctggcctcaagcagtcctcccaccttggcctcccaaaatgctgggattatagacatcagccactgtgcccagccagttttctcacttttaaatgatggtttgtaaagagtgatactttatttagatcagtggccctcgttgggggtggctttgtcccctaggacattgtgcaatgtctagagacaattttggttatcacagcaagtgagaaggtacttttggcatctgttagagtgaggccaaggatgccgctaaacatcttacaacgtagtggacagcactacccacagcaaagaagtgtcagcccaaatgtcggtagtacagaggctgagaaaccctgtttttagagtgttttgcatgatgcctttttctctaagaggaatcaatactttagtgtacagttctgcaagatatttttttaggctgaagagtaacaaggaagcagggtagagctgatactaaacttacatagggagcgtcttggctttgagactcttcatccatgactggattagttattttaaaaactctgcttgcgtggactcacaggatcacaaattccaaacttaaggacctttcatcttctggaatatagctgggcttgaggtattatatggagtgtgtgtctatgggcatcggtgtggtgaatacttctttgtatatatatattttttgtgtgtgttgtacaagagtgacttcataaaaggtggctcttgccagaattcagaacacagcaggtaatgtacttactgaagaggtaagagcatgagtaattcttgtctcatgagaaagatgtaaactagtttattataatgatgtaatatttgggtgcctgatttatcatccccatctccaatgatgcaaaaccttaagaactacacaggtgataaaaattcaaatggtgtctttgaagtccggcctattcccctgagcagttaaaagtgtcacctttgtcctgatacgttgctgtttgtggatgtttccggagatcacggttaaaatcttgaactatgcactctactatgggaagttttgggatgtttattccgtgagagaggtcataatctgggaagatgagagtcattcagctaatagggcaggaaaatatcacagtcaagctgtagacttgggatgatgggagtatggaagagatgattcctcctgtgtactgaggggaaccaggagagggagagttgtcaggaagcgtgtggtctttgaactggatctcgttttaggagaaacttgagttgtcccggttgagaaccagcttaggcaaaagtgtggccactttagggcaggctgggggcggggatatgaaaggaaatcatcatcatcatcatcatcatcatcatcatcacaacaacagtaataatcataatcatggccgccattttgtgagtactgctctgggaaggcacactctagaggttttaagatacactcatttaatccttgcagcaatctcatggggttggtattattatagctgttacagacaggaaatccagggtctagtaaggccagggtccggtccctcctgacagtactcttgtgcccctcgagcagcagtcccttctggttcattcttggtggttcccagggagcgcgaggaatgatgtcagcagagccgtgctgtgactggatgaacacaaccctgggaacaatgcctttggcacagctctttaaaaagaagtaagttggggcttcatctaaggaaactggctctgttctactcagtctcgtaggaattcttagaaatgttgtgacctggaaaattggagaggtatgatttgattaatttgcacatttaagtatgacagtgtaactagagagtaaacaaatggtaattatgccacaaagctttcctccaatggagagtcagggtcaaggcaatctggaatctttggcttttcagattagttgtgaacatggaacaacaagctcattcctcccctctacccagggtggacccctgtgtgggggatggggaagtagttttccttgcttggctacaatagcttagattaccatacactcatctctgacttagattttataccttcttttcccccatcctaccctgtgaagacaattgaaggctagggtttggttaggaaagtagcaagttaataatgtatcagaaagttgttggcagttgtgtttccttgaatgactcttctttgaagctacattgttacagtgatgtgtgtaatttgacctactgttcaaaaagaattcatttccatcccttccttgttcgttcattcatcatgcgtttatagaagccagtccttgacccagggggacccatagtctagactctggaggagagcacaaacatgggaaccagtaagtatagctgtggatgtgaaaagtaaagagacagaagtagagagcttccttctaaagagagaggggaaagagtgggaggcagcctttatttctaggggtactttctctctcttgttccatcctccgtcctggactgataccctccctgccctttgcatccatgttttttttccctcttatccagagtgagtctcctgggaaacccaggccttctttctgggagctcctctctcttcttcgtcactcatgcccagggtcacactggagcttcaccacctttttctgatactgataagtttcttcagctttgcattcttgcctcatttttctgtcatctgaccctagccgatcctatcacttgttatggaggtagctagaagcacgtgagatatggaaagtgttgtactggaaaatacacagcagatatacaaataactccacctgggcgagggagcattttcttaggctgggtatcaccttgggtttgaggtgcaccttctccctaggtgtcattttggagtccccgccttcttaaaaatgtgctatataagtattgtccacgtatgacctcattaattcattgaatatggcagaattgattgattgggatttggaagggctctataagagagactgtgatcttgtcaatctctctaataacaatctgcgtgacacatacaattaatcccttccttggaaaggagttgggggagtagaatcataaatttggaagcaaacatatcttttgttaaagtatatttttaaattacagtactcatctggaacacaggtgacatttctatcagcagaatttcaaatttatgcagactcgttattctgctttgaaaagctttatttcctttgctaactaccagatgggatattatagttatgaatccctaattctaatgaaatacaagccaatagatgtatcacactacgtttttcaaaccatagactattacaggcatgaagcacaagaagtctaacccattttaaactgattaatttaattaggagacaggtttggaggaacagaaaattgcttcttgttagttctctgagcactgcagttataagactgtatgctctgctctaacacaggtctgttctctctgaggtcatctaattctcctaaaaggggttttagatgctgagttgcatttgtaagtaaattctttattctttttctaccttctttcttttttattccatagtcattaaagccttgccgtgttcttgttatgaactgataaatgctttgtaattactctgtaactaaaaatgttaaacttgaatggttatatggattttttttttatttttttaaaaactcactggagaaaggaacagtgttgtgggggtataaaaagaattctgacagagaagagcagaaaacagaaactaggtgtggtgggggaggaatggcagaagtgccagggtctcttggtccatgtcttgagcatttactgtttgccagccacctttatgtgggttgaccatatataccataccagggcttgatatccctaaatcctcaaaaaactccatgaaattgctacctgttttcaggatgcaaaagctaaggcacaaaaatgttagttatcttgctcaaggttacacagctagtaaggtggagactaaatttgaatccaggtgggatgattgcatcctacaaagttcttgaccagagaactaatgtggggttggacccacccaagttccagtcctactctgctgcttcccaacaatgtgaccttgggtaaagttattttaacccctttgagacttttccccaatttgtaagtgggtttaaagcacagtataaggttgccgtgacttttaaatactgtgatgtgtattaatggtttggcatgcagaaggagcttggtgaacgttgcctttttgccctttcatgtcatgtcctggggaagtagcagtgacagcctgcagcctctgttcttctcgaatgttcccaaggtatgaggcacctctgagaactcccagagctctgcataggttgcttaaacgtacagcccactcaatgagataatttctaaggtttcttcttgcccttatctttagtgactccaaagtttaattttcataaattcatgtctacctagttacatcttgcaaagtgtaggactgcctttgcagttgatctgtcagtttgtgtgtgtgcacagctggaaaagtgtgttttccatgtagaatgagagaatttgcctggcactgtcatttatttttcttaaggaaagataaaagtttagttctttgatttctttcttgggattagttttttcttgactatcaagaaagaagggaaacaagtttgagtgaaaatagattgaggttcccccccctcatttcacactattaaaagagtgacacccaacttcttaggtttctcttccacagcacgggtgggttttgtagattaatgtatgctactgagatgttgagtcagggttggattagggaggagctcccctccttgcatttctcccactctgtcctttcagtccctcaaccagctaagttcatgcctgtagttggttagaagggaggttttctatacagcttgagagaaacatttaacagggtatcttcatgtttgtgtagatgtcatttgcttcattaaaagcaacagagtgactttttaatgattgccattctaactggtgtgagatggtatctcatagtggttttgatttgcatttctctgatggccagtgatgatgagcattttttcatgtattttttggctgcataaatgtcttcttttgagaagtgtctgttcatgtccttcgcccactttttgaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatctcaagaacaaaaaaccaaacaccgcatattctcactcataggtgggaattgaacaatgagatcacatggtcacaggaaggggaatatcacactgtggggactgtggtggggtggggggaggggggaggggtagcattgggagatatacctaatgctagatgacgagttagtgggtgcagcgcaccagcatggcacatgtatacatatgtaactaacctgcacaatgtgcacatgtaccctaaaacttaaagtataaaaaaaaaaaaaaaaaaaaaagcaacagagtgtatacctgtgacatttactaatgtgtgaggtgtctgaggaccacctgcgtgagaatcccctcgggttattacataaagagattcctggcccactacagacccacagaatcaaacttgtagtgtcattattttgtgatgtgaaaatattcttttcgtgtattgatcaaacctctgtttgagaagcaaccatgcaaacttatcacatcatttgaccttgttcagatcttggtgcacacattttcagggctaattttctcccactgcagcttgctgctgccagtgagggcctgcttgcccaagttcctggtgacctcactggtaggctgggctgggagtggttggtgacgttgccagggagactgaagttgggggcatgcagcctgtgaagccaggcaaggctggagccaggaatttgtagttcacagaattagatgcaagggtgaggtggtttgtgctcagaggagatgaatttaccaatcttagtgggcagaggagagaaatgggattcaaataactgaaaggagaggtagcaggagactccaatgtgatggggatggagatggggcaatagggccagaccttggatcaggtcttttcctcaaggtatttatggtatgacttgacagtctagctactgggaatttttgcggtaattgaatatttagacattgagtataatgcattatatgggttaagtgtatatattgcttatataagtaaagagtataattgaagatagctagtaacagctaagagtatagctagtaaaaacatactagaactaaaaataagctcatttctgaaaaatgcatcctttactaccctatacctactattttagaacattctagaaaatgtaagaatacacaagcatacgttcttacattctagtgcagtggtccccaaactttgctgcacaaaagggccatctgggtaataattttaaaaacataatgatgtctggcttctactcctagacattcttatttaaattctatgggatatgatgtggacattggggttttaaaagctctccagtccctcattttatagatgagaagattcaggactagcaagattgtgaatttttccaaggccacgtggtttaatagtggagaccggattgaataaagaaaggtcttctgactcttagctcagggcccagaaaccactgggccttccaaacaaagggaatttaagacagggcattgtcgacacaggtgatgcaagagttgaaaaggcaaactccaaatggtgaggaactcagagaccagcaacagcaggaagcaactgcatcatccgtagggttggagaaatgatgggagcaggtggtgtttctggatcccagagactggagcaaccttggagggagctaggaccaagatggtagtggaagactgtgtctgatgggagccaagactctagagggggctagagatgccacctgaagtgcatgtgttgggtggatacccttgcttctccctcttccctcttgttttcttgtcttccaccaatgcttcctattggcccagaccagttgggaagtgtggtttccttcaggacaatggaggcagcagacctgaaaacaacccagcagtaactagccctgtggtctttctaatgtactgaggtcttgtgattagagcagaactccatttggacactgtttctctttctttcttctttttctttcttttcttcagatcttgctctgttgcccaggctggagtgcagtggtgcaatcatagctcactgtaacctcgaactcctgggcctgaagtgatcttcccatctcagcctcctaagtagctgggactacaggtggatgccaccatgcctggctctttttttttttttttttaattttttgtggagacagggttcagctatattgtcctggctggtcccaaactcctggcctcaagtgattttccttccttggcctcccaaagtgctgggattacaggcatgagacaccacaccagtctaatgggcagataatttcttatattccttttcataagtggtgtgattgataggcttctaggttgctataatatacgtctgcacattttcattaataccttctttctgtgacgattcacctctctcccattcaacatgtttacatttttacattttttatacttaaaatatatatagttttaaaaatacgcattgtaatcttatctgtgctaaatcttaaacatttgttcctttgaagactagttacttcctagatatattgcctaaagccagatgatcctatgcatgcatatgagatgacagatcttactttactatatcatttaaaagcatttttaaagaaaaatggaattatagtacactgcattttatttgttctgcctgatgggccaagtgctttgcacccagtggagctgagccttgccagcctgctgttataacagtagctcccctgtagagctcagcattctttagacttggctaatgagtctgatgtcataaagggagctttattaaaataaatatggtaccatattttctttctaatggcattctgattaattccatcataaatgcatacctgacactcttttaattaattgagatagcaaagggattccagctagtgatattgaaagtgtagacggtgttttcaacagcatgttcctaccctgacaccagtatcagtgtttagtattactgtagatcagaatctgaagacctatgtctattttaacatatgtcactgaacggctgtgagagtaattaaagagtaatgcttgcccctgttttgaggatgtagctacttaaacactaagagattaaatgttgccgaaggctaccagcaagggagttgtggaggcagggttagaactggtttctaatttctagccttttgcttaaattgccaaccatgggtcccggtaatgtgttctgactttattttccttcagacttaatctgcggttaatgatagctttcacaatcagaaagaacatgtaggtctcgaatttatgacttccataaatctactactttccaacatacccacaaggatggtttggcagagacacagcttgtggtacacctattatcctttagttaattgggctgtttttactatttgggagatcctatattttaacatagtacgtgaaatattaatagtaaatatgaaatataaatttcaaactttaaacattttgtaccattacctaatttttaaaaatgcttatgactaaacctgctgaacatggcatgttcgaatgattattttacttctgtggtctattcctctcagaaacattgccgtccagaaaaatctaatgatttcttcttgtggaatagtggaatgctagataatggcacaaaaccagatccttcagactgtataaatgcaatgtaaaaatggagtggaaacattcagttttaggaagttagtgactcttcatgtcctgtaaaattgtgtgtatgcatgtatttttttttaaatgccaggaggtttgccaatgggactatagaggatatgccagtgagacagagaagatatgacttatacagacaagccagaatgctcattatcagagggatatttgtaggataaatcttatcttttacaggacgtaagaaagataaagaactattttatggtggttaattcagctcagattgctgcattatttaaaactgtgagggaatctttaaaaaaattcaattttctatttcccatctactttaattactttcagcgggattttattcattgtaggcaatgaattgtccacggataaatggaattgttggtagtcactttcactttggagctcttctataatcgaaatatgaagatatttgcattgctttatgaggacatttaaatacaagaagtaggtttttatatttcagattgaaagcaaagaaagctacctcactgattctaaattcactttgtaaaatctcgaattactgaaattaagttcattcagctcaaataagccaattgttttccctttgctccaagggagaagagcaggctctgtaccatcttgattggttttttatttgctcatcccctgatatgatttggctgtgtccccacccaaatctcatcctgaactatagttcccataatccccacatgtcatgggagggacccagtgggaggtaattgaatcatggcggtagttacctctatgctgtttttgtgatagtgaatgggttcttatgagatctgatggtttaataaggggttttcctcccactttgctctggacttcttgttgccaccatgtgaagaaggcctccccagccgtgctgaactgtgagtcaattaaacctctttcatttataaatgacccagtcttgggtgtgtctttattagcagcatgagaatgggctaatacatcccccttttgtaataccgtgagggagggcgtgcattagaattgtggtattccagtaggaaaatgaatacaccataacaagtcatggtatctgactttagaacacaaaccatttgtttctgatgttgatgtgcagactggcttccgtgacttggacttgcattctcttggtcatgtcagatttaagattcttttatgcagaacaagctaaacaatatcatggagttataggaacctatttattgtacatgtaatgagataaaggtggcctgtaataaaacagtgctttttaatattgaagatgctgaaactcctggagaagcaggtaacctgcgtatttaattcaaggactgaatcataagagctcatctttgggaaggagcttaccatcatttaatgctggatttttaccttgcttcctacagaaactattccccccactttgatatgcaaatatttccattgggcttttggtttcttttacagttttccaaggcactacatcattgtatttggtaatttcactttctttgtgtaattgttcctaatctttattctaaaatcttatcctacaatagttcaatgaaaggtgcttttctttttcttttaatgtttggaatactgcacttaatggagattcccatgtttactttaaaaatattcaaattttcagaaaaatgtattccccactttatccaaatgaagagtagtcactgcagaaatctttttattagaatcatagcattaacattggaaattatctacatcagttcccgttcaatgcagaagtctctaggcttagttttgtagagtacagagagggctaggcatctgtacttcaatctacaaatcctcttttcctcaacatccctcctaaaatgtggtttcaaggtggctatggccttggttttctttctttctcaagctcttcaggatgccacattaaaaaaaaattgacagatgtgataaaaattttgatgttaagacccgataaatatttttatagatgcctcaccagtgtgcttaagggacacccacggaaggtagactggtggaggcttaggacagtactgtctccctcaaggagctgtatatacctggaattatggcacatgctcacatggcatagttaggacagaacataagagatctgtgattaggtggcaaagcatataaaacaactactagaaaatggtcatgggaagggaggggacagtgttgagccttggcaaatagatattggagcaaatgatttgcaaggagactgatctgatggaacagtattcatgtttgaggctggtagtaataagatgggataaatcaaataggacaaagtcactaacaggcctcaaatgtcactgtgccgattttgaacttgacattgaagttactgggagccagtatggactttcgagcactggttgactaaacgaaggcagaacttttatctatttcacttgcttagaatgcctagcaatgtgaaaacagttaaatctagaagaccaaatatagctgttgcacaaggttctagaagaccaaatatagctattgcatgaggttctaggcactgagagcaagtttgacctgaagaggtccagctttggatggatggaccagaaaggaaaaaaatcaaaaggatttttggtaattggcaacgataaagaggttttgaatctaagataaccatgagttttggtgcaaatggcaaggacaatgttggtgccattgacaaaattaggggaattattttgtttcttatttcagcactgaaatatggaaatttaatttgcttttgagcaaatcaactttttggcacagtcccttgtttcaatacttaagaccaggcccagtgagcagatgggagatggggacttgcttctggagaattagagctttgagttctagtctgccattgatcgattacaatcaagcaaatcccttcctcccttgatatttcccacatatgaaatgggaaggataatgggtttctgcttagagggtgattgtattagtctgttctgactgctataacaaatatgccattattatcacaattctgaaggctgaaaagcttaagatcaaggtgggggcagacccagggtctggtgagggcttgcttccaggtttgcagatagccatcatctctctgtcctcacagggtggagagcagacaatgaggaaggtagctctctcctgtctcttttataagggcactaattccattatgagggccccatccttatgacttaattaccttcccaacgccctgcctcctaatacatcccatttgggatttgatttcaacatatgaattctggggaaacacagatgcgcagtttgtaacagtgattgtaaaggatgtgcaaagaaacgttggcaagaatgctgtgcaaatggacctgtctttatgcatactctcctttattgttgatgtgggtgttaaagcccatgaccagtcattaagaacccttactccactctcttctgggcatatggcaagtgagattctgactttaatggctgggatggggagaaaggagctgggaacatatgagaaggacctctttgtcttgtgtctgtttcagcagcaagagagaagacattgcttgcagccagaaggaaagggactgtctccaggaaaatgtagcctttagttagcagaacttactttagaaggactaggactcaggcttttaaataaagtgttgaagtctctgttcatctgcatgtgtgtgttgaaagaattagtcaaaatatctgaccttcactttttaggactgaatcaccattctttgctaaaaaccctgagtatggagtgataataacaagaatcaaaaggtgttttcaagttgtatatacaacatagatagggttttgttttaaagataggcagtgagactttttctgtattgtaattttcattagcattttgtaataaatttagtatctccagttggggttcaataacttaaaatgagaaaaattgcaattttaataataagcacaggttgattgcctactttgtcttttgtattaaaatgaatgttgcaattactgtgtattaatacccagcaaactatgtttctttttcatctggaactagaaagtattacttctaaacaggcacacacaatttatccttgtaaataaaataattctaagtgtgcatgtatatgtttattatgaagccatctttcagaatgcaccaaatggaaggagagaggagctgattgtcttttattgtggggctgacagaatgtttattaatggccatggatttgaaatgagcatcttactaaatggaagtctttggccaacctctgacccttttgtcttaaaggtttgagaacagataatacgaaagaataccagcttttttccagatggctgcatgcctgatgttcctttatgtttagctgtcattcaaatatgaatgcccagtgattataagtgtctctttctcttttctggactgaaatgaaaccttttatgcattgtgtgttaaaacagattaactgtttggctcatcagtagggaaattagaacaatagctgccaattcaatggtatagtagaagaatgtcctttggggccaggggctaaggttcataagcaaatggtatgtacaagtgtcagactggggaaggacagacaagttataaaaataattcgcctgaattttaattttataactgcgttggagtagtaatatcttttagaagcagggaggatttagataaatttttacgaacttttacatattttttagttgctccattaataatttcttggagtgctgttgtacacgatgaatttaaaatgatggatttatagataatgtgtcttatgaagacataatgcagaattactgtatgtttccttaactttttagtgtgctaaagttgtcttttaaatatatgtatttcataaggtagaataatggataatttgaatgtcatttttctaccaatactaacacttttgtaatctgaaatggaagtcaaggtggacagctatcatttaggtatggttgcaatgcagacctgcccggagggcaaggggaaaactggtgacccctcagtgacctttgtaggagatggctggaggccaaaggtctgaggggaccaaccgcatcaatttaggaaactagagtactttacaaaatgctagacaaactcacattgttagctctgagtagtaaggtggctgtcattttccatggaaatccatagaatgaggaaactacagtagtcttatgacctagtggacgaaaaagagcacatgtgagcttatttaacccctatgtaaagagattattttggtaacaagaggtactttttatgtattgtttatagaaaagcacaaaggaaagcctaccatgaaattctgttgttttaataacaattgtgttttctaaaacatccaaagatgaaaataggcttaaataaaataggcagctataccactttgtaaaacttattgtcatagtatatttttgatattttcacattttgttttgtattatactttttaaaatgattttatgcccagctaatttttataacagctttattggtgtataattcacatcctaaacaattcacccattaaaaaatgcagaaatcaatgacttttattatattctcagagtatttgcatccatcactacacagttttggaatgctctcatacattcttccccaaagaaaccccactcttcttaccagttatcccctattcccaccagcccttgacaattactagtctacttttggtacttttggtccctatgaagttgcccactctggacatttcatataaatggaattgtacaatcaatatgtggtcctttgtgattagcttctttcagttgaaatgttttcaaggttcaaccatgttgtagcatgtgtcagtatttattcccttttatggctgaataaattctattgtatggatatgccacattttgtttatgcattcatctattgggggacatttggattgtttccactatatttatacttttgttaattaagtgttttttccagtgaatatttatcttgtacacaatatgacttctattaggttttaagaggttaacatctatgtacgtttcatgtaagattatggtgactaccaaaagacaactgtggagtcaagggctactataacaggtcttgcacaaaatccaatcaaacaccatagacctctaggatctaagcatcctcaacgtagattgaggatctccagaatggaagaaatgcttatggttagcagtagagtggtgggtaggggagggggcttgcgcatggagcaatggcagatgagctacagtatcttgtaatatcctccacagtaccataccctgcctagcatgcagttggcattcagtaaatacttgttgtctgagcccattttgtgtaatgccacaccaatttaccatcttccaaggggcaaattttcgaatagtttgcaggctctcagctctcccaagactaactaatatcctgcaacttaaataagattgttatcttgataatgattatagttgcagagtactcagtagtttatgaatacttttatttggctctatttaattttctaggtaaatactgggtagaacagggagaaatctcatttgccagaaaactcaggagtcagaagtatcatttctattaaccagcaaagtcaaacttcactccaggtcctgcagctgcagaatttgtgcttttcttcaaatatcctgctacttacacacctctctacctctgcctttatcttgcttctcctctttttattaactacgaccagcatccactaagacttttgtggggacctctgagggttttagtgtgaaaacaaccttactgaaaatgtacactaaggagttccacagttgtgtcttgactgtttccttgaataaattctctgtcttacgtaccaatattaatagtgattatggcactccaagatgccacacagtggttccatcaacactcggtccctgaaacagaagtccagaactgaataaatgaaatggagtctatgattaaataattgcagtaaagcagatactgggtaaaaggagttggcaaggttatcttcattgatacttggagatgaggtcgaatgctagtgccaggcgatacaggactggactcctgaaagggcattgtgttgccctttcactcattactgagtgttcctgtgcatttcagtaaatataacatctatctataaaagcatctgttagcatgatgagaaacaggcaatgcctattccttttccacagagtttaccaacatactttctcacaataatagcaaagaattaagataatcatcactctaagtaggatgtgaaagaaatttagagaaggtgactagtgattatgcgtggagaacttgctgtattcaggaatgtacttttatctctatcttaacaggtgggcaagcaagggttaagtaattttgcccaagatcaaacgtctagaaaacagtggagccagactgtatccatgccatgaaactccagcattcttatttggcatcccagtgctcagctgccacctgcagttgaccgtaattgctaatcaccccttcttccctttgtcactgagtcctgtgactatgcttctgaagtgaaagtcatttttcttttttttctcacttcatacctctattggtggttattttattctctgaactataaaagtaatgcatatccactggagaaaaattcagaaaataacgtataacaaagaaattaaaaagtacttgaaattctgcagtgtaaatagcacagaattaaagacatatggaagcctcagctatgttggtgtttgtgaagtcgtttgatcaggtgcttttattcactttctttcacaattgctgtttctaagtgcaaaaatttcagtgatgcctccagtgatctgactagagaaatgtctgttccttagcatcatgggtctactttataaagtagaccctctctgagttgttagcaagtgtgatgttgttttgtagggtactcagatgctgtattagttcagaatatcctgtttgacccttggtgtacctgaattagaccatgaaggtttctttgtttctgtaggaaatttcactcagaatgtctgcttaagaagtcatcaccttcttctatggtctccaaaggagagcaaagtctactccatcctctgtcccatccactgccccttgccccactggctggactcgggcagtggaaacacttctctgtctaaaccattgacagtggacctcatgatgaggccaagcattgaagagattagaaattgagatggagtttggtcagggctttgacaaggatgggcaccataggaaatagtgtgtcccaggcagtggttgatggtttgactcttctccatcctgtttcttattgctgttccatcagtgctggtgacactgctgtctgtgtttgtagaatgctggtgatgaggaatgaggacagcattgaaagacgaagttgagtggggaagaaagaaacagtttaccaaagaatatcaagcattattagttgcttattaagaagtgggacatttctgtatgttagtcaattaaaaacagtcactttgtgaggtctttttatcactttggagctgaggaaatgaaaattcagaaaagtcaagtatgattttgtaaagctgcatgtataaaatgagcatgtactttaaatgtttcatttgttcatgctttgttttacgttttgtaataaattgagccttggtcaaagttgaaactcagaattttatttttaaaaggaaatgagagcatgctatgctattgggctcaatttgaattcttcagtgaaacaaagaagtagaattttattcattcattcagcaaacttctttttttgagcaactgattatttgcaggtgctatgctagatgctgcaagcaaaacatgtgctctgctatcatgcagcttgctgactgctgggtgtaaagacaattaagtaaaaacaatagagcactttaatgagtcttgtgatgattttttttgatagagaataagtttcataaacaattacatttagaattatgaaatcgtgagataaaggaatataatgtcctaggttattgtctaataaccatgatttcctccttttttgctttgaacaaactttttgtgaaaaatttcaaactcatacaaatagaatagattatgagccttccttaccccacaagtatccatcatccagctcttcaaatcattaaccactgatcaatgtggcttcattgtttttctttcatatttttttcctattttgttcctatttgtttttcttttgggagatgctggaagtcttggagcagggctttctgtgtaatagtggagccatactgaaaaattatttttcaaatttttgtatccttttttgaaacctgacttcagggttcaagggtgaatcctgctgctcttagagggaccttcttttgctgcctttagaggattgtttaccttgtagaaaagtatatgaagtgttggtttggaaaaagcaaacacacttgtcaggtgcaaaaacatagaacactcccaataatctttcatgtaagctaaacttggccaggcgcggtggctcatgcctgtaatcccagcactttgggaggccgaggcaggtggatcgcctgaggttgggagttccagaccagcctgaccaacatggagaaaccccgtctctactaaaaatacaaaattagctgggtgtggtggcacatgcatttactcaggaggctgaagcaggagaattgcttgaacccgggaggcagaggttgctgtgaggtgagatggcaccattgcactccagcctgggcaacaagagagaaactcactcactctctctctctctctctctctatctgtctctctctctctctctctatatatatattatatataatttttcatgtaagataaacctaagaaaaataactgcatggaacattcgtatttgtggtctctaaattgtgtaaaggcagcaatttcaggcttttaaggaatcaagctggctgcagaattgggtatgggaaattagcttgtctaactcattggcttgatttttgcggtgcccatgatctttgatgaggactttgtattccattgttctgtgtaatgcttccacaagtcatttctgcgaatggatgaatttttcttatgtggcaggagccgatgcgtgttttttttttggtagcgatcttaatgatgcccataggataaatgagaaattctcacaaatcctcactaataaatatggacacttaaaaagtctccaggtgtggatgctttgtgtttactgctgagagtgcccctgaaaatgctttttaaattttcttgcctgtccaggtaatgtgatgggaactacaggaagccagtttaagtgtcaatgtagcctagaatatggagaaaaggcaattgtttgcataatattctactgctaacatgtgtgaatgtgctttgcaaacttatttcagttcttgaacatctcagaagggctggggagcaggtgatgttgacccttttttactcttaagtaaatgctcttaagtgggccagtcaatagtgagctgggaccagaactcaagtcttctgttattagcatgtgttgctgtccagagtagagcctggtacattataggcacttggtaattgaatgaatgagtgaatgaatggaaatactccaagtcagctttttgcagaggatgcctttatagacccttggtattatgaagagatctttggaaacatgttttatggaaagataatttaggaaatatttgtctctggaagagtcactgaatatgtaaatatatcctgcatcaaagaaatcactgtacctttgtttagtccagtgtttaatgattatggtgccttcctatgtagcacatctattaatgtcccatagaattattgttatgtgtaagagcattttggaaacatagctccaaatgaatagctttctagaggggaatttgatattgaccagttaagactatcaaattaaaagttaaactcagattgtgaccttctgcttttgtctcatttactcctttgtttccatcctgaagttgcaactgtcatctctacgtagattatttggactttaccttttctatcttacctgtttcctgggtagttcttttatttgtgaatttaaaaaaagcaaactttattcttttaagaataatacatgttcaagttggaaaattagaaaatataacctggcaaaattaagagtataattctactcataatcccactatcagagataactgttatttatgtgctgttgtacatatcctttagaactcaagactacaggggtagtttatctgggttcaagtcccagctgtttctcctactggctgtgtaactttgggcaggatatttagcctatagcctcgatttcctcatctgtaatatggggataattatagtgcctatatgatagggccattatggggattaaatgaattaatatttataaaagattagaacaataccagacacatggaatttatatatgctaaattaaatgtgtatgtatgcaagtatgtatgtgtacaatattatattgcatgcatatatcacaaaattaagcagtaccccattgttctatattaacaatttgttttaaatttttcacagtaacaaacactctgtagtaaacattcattctccctgttttttacgtatccatcattatttccttaagtcaatttcttaatgggatctactagatcaatggatgtacatgtttttagaactttgatatagtctttctagagaacttggtaagagatcctgtcaatgctgctaatagctgtgtttgagaatgctgtctttttttcttttcatcaatatggaagataaaacatttttcccatttaaaagacattactaatgaagttaattgttgctctatggatagattttgccacttgtatttcctttttggttgttgctatttacagtttgaaaaaaaaaagacattgttttttctttttgcaagaaccctggtgatctttcgatacatacagtgaaggcacagtgatcagatcagggtaattagtatattcatcatcttaaaagtctatcatttctttttgttggaaacattcaatatcctcttttctagctatttgaaaatatatgttattgttaatcataatcattctacagtactttagaacactaggacttactcttcccatctagctattattttgcatcccttaacaaatttctccctacctcttttccccctacctatccctgcttctagtatcctctgttttactttttacttctatgagatcaccattttttagcttccaaatatgagtgagaacatgtagtgtttgactttctgttcctggcttatttcacttaacctggtatcctccaattcaatctcttttgcctagaatgacaggattttatccttttttatggcttaataatattccattgtgtatatatgccacattttctgtatcagttcatctttcattggactcctaggatgattccatatcttggttgttgtgaatagtgctagaatagacatgggggtgtaatatctctttgatacactgatttccttttctttggtaaatgcccaatagtgagattgctggatcatatggtagttctatttgtagtttctagaggaacctccatactgttctccacagtgactgtattagtttccatttccaccaacagtgtataagtgttcctgtttctctgcatcctcactagcatttttttttaatttttattttttgattatagccattctaactggggtgacatgatatctcattatggctttgatttgcatttccctcatgagtaggatgttaagcattttttcacatattttttggccatttatatgtgttcttttgaaaaatacctgttcagagcatttgctcatttttaaattggatttttttttgctattgagctctttgagttcctatttattttgaatattaatcccctgtcagattgcatgtattttctgccattctgtaggttgccttttttctctgattgtttcctttgctgtgcagaatcattttagtttgtatataatcccatttatttatgcttttgttgcttgtgcttttgaggtgttattcataaaatcctttttcaaaccaatgtcttaaagtgtttccactgtgttttcttctgttagtttcatagtttcatgtcttacattatgtaagacatttaatccattttgagttgatttttgtatagagagatgggagtctgttcttttttccttattgatacctagttttcctagcaccatttattgaagagattgttctttctttaatattctttgcacctttgtcaaacatcaattagctgtacatacataggttaattgctggtttcactattccgttccattggtctgtgtgcctgcttttatgccagtaccacgatgttttggttactatagctttgtagtatattttgaagtctggtactgtgatgcctgcagctttgttctttttgtcatagggaaatttttaaatttttaaatgaagtttgcctagagaggaaaaatgtttttaatttccttttttatcctaaagtagaagtgataaggtttcagtttttaaaagtaacatctcattcacatttcatgcttttgtgatattgacctgtattctttccatcattgactagcctctctttcaactcatttacaaaatgagttatatagaatgtaatatatatacataatattaaatgattgtcatgtgtggacttactgagctagatagttgaatctttctgtccaactgtttagtttaaaataggattttttttttctgagtaaatctattatggatgaacttggggattttgtttgtcaacccattggacaagaatggagtggagaaatttctttcagggactgatcgttaagcacatttcctggatacggaccttaagacctgtattttaaaataatggaagtaaaatatctgatgcatggaatcttctcatgcatataacctcgttttctactccatttatttgataattgtttcatcatttcagattcaatttgtaatagcaatgaacactctttaatatttttctaataaggattagttggagaggttaatatggtcagaaatttaaagaagcccagagtcatcttaatgagtgtcaggtaattaacctacatgaatagattaaagaaatcaagcaggcacgctgatgggttttcctttcaagttcaaatttagaacatcatctttgcagtggttaggtcttacatgttagatggtgattgctatattgttttttaatatataaaaagcttaattgtgaaaccttattagaattcctcatcaaatttgcttaattgaagaatgattatggtatgtgatatgaattttgaatttttatatgcaaatgatatttttaaaataaataggcttcccaaaatgattttcttcatgaatcaagaaccagtgctttaatatgtagatctcttgttacaagaaaaacaatcaatgtagagcttaagcagttcgtgaactgctgaatttaggcgtaggaaacttggtgaaagtgattgtcactgttatcccaggaatgctgttcaaatctaaatgaaaatttatgccagtggtcactgtaagactaaaaggcaagttctggaagtaatcttgagtagttcaaaggcaagatttcatctacattattcaaataggtagtttctcttcttaaggaattctaggcatttatagaaatttctcctttgtttaattacaatgaagttgatataagctgtttgtgtttctggcccctctgaaggtggtgtgcaggtagttgctatcctttcttttataattatggcgactttagacatggaagaggctaaaaccagagatcattgactttgatcctgtcattacagggagttatttctcatctagggtagatagccccatcttgaagaatgagacaaaatacaaatttggacctcagctctgtcacttgccatttactccttgagcctaaatattctgttttgcacaatggagccaaaagtctcatcaaatggacagaataaatgacatattgcttgtgcaaacactttgttgatctgctcaacaatacaagtatcagatgtttcattgttgctttccaaggaacttctctcctctcactcctaggtgtgtctcgtccaagatgtgctcattttatttgaccgtcttttaattttcagtctcttaattgagttctgttttccccaaccctgcccaaggactttcttaaacaatagtacaaagacacagtttaaaaaaaataaaaacagtttaaaaaaaaataaaaacaaaactgttgagttcaagaggaggcaaaatgttattatttctacacacaccattcctaatctgtggttagtaaaatgtcagtttaggtcagagccttgtactttaatctgcattatggcccgttacctttttccattgtcacagactgtatccccaactctcattaatgagggtccctatttaaaagagagatcaaatcaacccttattgtgtaaagggctctgtgttgattgttggtgggggtgggtgagatacaaatataacgtacagaccatccttatacctcttatcatggttagaagatggcatattgtgtaagccagttgttgatactctaagtgtctcccgaccactcatttggtcgtttggattttataaaatgtattctatttctccagctgtgtttgtgatggataaggagctatctttatgccactctatattgccatattgaccaacacaattgtttccttagcagatactcaatgaatgctttgaatcaagctgtagaatcagaataattgaaataaaccccttgttacttttagaaaaacaattcacaagactgatattactgatgctaggtgataatatcctatgaaactctaaagagggtccataaaagagccttcctgctcagcacaggaatgaggaagggtagatagatggaacgttctttaagtctgaaaagttaaaggtactgaatccttatcacataacctgaggcatctaatttaattttcttttatgccttttttactcctattttattaaatttgcagtctgtcaacctctttgagaattttcttaatttttctggatctgacttcctaataacacgttttgtattagaaagactttattttagctgcagttgaagtaatttgtaggtcatgattaattcaccagtattatttcaggaatcctcatacaaactgtttcagtggttattgtttgttcatttctctactggggcaagttaagtactgagaagtaaagtaatccacaaagtcagtggaaattgtttggatctctgaggactatcaggaacagataatgaaaacattgaaaacattctactttaatactacttttttttttaaagatcataacataggacatttttgtcgtccttataatcatttgttacaaaaacataagaccttaatgtctgttaactacaccttgatttaaaaactccactttacagaccacacttgatcactccagcacaattgtatttggcaaaggggactcacagggggcacaaaaagaatatgaaactaggcttgtaaacccaacagaaccattggaagaatgcttcaaagttggaggagtgcttcatgtttgtgtgaaagatctgtgtttattttctggctaaattcccactttaggagacaactttacacctttccaggataatcccgcctgggcacaaactgaagtgatattatctggttcatccagctttctctttctaaatccttgggtaattttgttttatcagattcataactccctggcacatagtaggtcctacctgctgggtgagtaataaatatttgttgaagggttttggtcatttctgttcacacttgaataatatgtgatgaggctgagaagacaactgtggaggcgattacatttgtcattagtgacctcgtttctagtccctgaatgttaactgttttcagagggaatacttctcttataggaaataaaacagtctactctcctgtgcctttgacatcctgagtgcttttcctcaccactgagaattggacagtgaccatgctttgttagagaaggaagggtgaggggttattcatgttctgtacattccattctggaattcttggtatcagaaaaaaggttttattattagctcagtaagaaaatacaatctgcagtctgtgtggtggtaagtgtcctggcataaaagctaagcttttaaaaatttatgtttcccctttaaatgctgttttaacatccagtctttccaatggacatttttagagcacagatatctgctcctgaaagtcatatgttttaaactgtttcctgaaacacgctgagattaaaaaaatttatgtaggttttgaacttctaaaatgactgagtatttaaactttaatgtaagaagcacctgcatggtaggatttgctgaaaatgctggtcttgagccatatgcacagattctaattccttcagggtgagtggaggggctgaggatcctgagtgattttgatatagtagattgatatttagagttcctttaataaacagtgcattccagccttctactccagcatagcaaactatcttaaaatgtattgccttaacatatttattttatgatatctcttgggcttgtgggtcaggaatttggatggggtattcttctgttccacacagtgtcaactggagtcacttagtgatattcatctggtgccttgtctggagggtctacagtggcttaactcacatgcctggccccttggtagggatgactggaaggctgggcccagctgggaccctctttgtgtagtgctgggaatttttgacaaagcctcttagcaaggtatttgtactactttacaaggtaactctgggctcttaggatatggccagacagagtgcttcaagagagccaagcagagctgcaaggcttcttgtgacctggtgtcagaaatgccagtccatcgtttctgccacaatctgttgatcaagtaagtccgaaagaaggccccaattcaaggagaggggaattagactttccatgccaatgagaggagtagcaaagaactcacagccatctttaaactctcacacactaataggcagaaggcacattgctatgaccatgtcataaatttctgaattattgattcatagtcattagttactatcttaatataagggctcattgtctttcacctgattagtttcagtgatttctaaaaggtatatccttctacataccagtctctttttactttgatccgttttatatatggcacaagtaatctttttgaggtgtgaatgctgatcatggaagtctttttcctaaaactgtacatgtgtctcatctcctattatggaagactgtttagacggtctaaggttctgtgatggaagtatagtgtagaggttaatatcatgaactctagagtgagactctctgggttcgtgtcttggttttgcgtgaccttgggcagtgcactctatctgcaccttgcttttgtcatccgtaaaaaagagaattataatgatatccacctcagtgggtgattataagagttaatgaagaggatatacaatgtcattagaatgtgctgggacagtaatggttgttttattattattgctgctaacattttatggcatagcattcaagacctgtcctgttctgttgtaccttgtattttcagtctcatttcctatggctattcttgtaatccatgctgcctcacccagttgtcttctgtgctgtctgcctgttttctgtctttccctttactcgtgctattgcttctcagtgaaaagggatcttctctccctctctccattgggacatgatattaccaagaagtgctttagagggttttcagtagatggaaactggaattttatatctcatttcactgtgacatgtggtcaggttttgtctctccaactccgatatatgcttcttgaggtcaatacctggatcagatttttgtctttgagtttgccacacatgtggcatagtgcagcgccttatgtattggtgtttaaaatcagttgtgttgagggtcaggaagggctagattatgctgcagtaagaatctggaaacctcagtggctttagtactttttagtactaagaggactacttttttagtactttagtttctcagtcatgcttttgtccatggtgagtcaataaggggatctgttgactgtatcagtcagggtccctggctgatgaaggctccatcttaaacatttttccatgatccagaagcatagaaaagagaagtagaaataaatgcactgacttttaaagcttctgcacagagagacccatgttacttctgctcacatttcgttggccacttacatggtcacactgaagttcttgtaggtggaaaagtgtgattctattatgtgctcagaataggagaatcaaccatttatgaagaagctccagtggctaccacagatgacgcactggtctcattacctattccggtaagattcttctaggttaatatgcccaaactgttttaaaggtttgacctgcatgcacctcattaagttaatggaattcaattcagttaagactactgagagtcctttatatctcgtttggaggctgctctgtccagggagagtaaaacaaaatcttaaagtagcagttttgtttgtgtgtgtggtttttctgggaaatattaaagccttgaacaatcccgtatctttttcatatatttacctttaaagaaagacattgttttcttgcacctgtcctccactttgattcttgctttaaagtacatactggttagcaagacttgagattgatacttatttctggcagcataccagaattaccactgagggactgcaaaatagaatccttggcatagtcactagggttctgagttctaccaagttaagcgtgtttaataatttaatgatcttagcaaaatggaaagatatcccataaatatatgataatattcagtgcctcaaagtttaagatggtatcccaaaggaaattataggggcagattatcatatagacgaatgattacatttacttaacaaaaaattgggaggatttctgttttataccgtaatccttatgaaggatcagtatagaactttgctttaaggagttctaagtagtttatacatctaggaaagtgcagtagacatgggctactatgggaatagctattagagaaggcaaatagaggatggcaagtaaaggaccttcgatcataattcactgaatatgttagctgagtaaggcttctgttaaacttgttaagttgccaacattacatggtttgactgggccttgtaaggactagaaagcagtgcacgtgtatctacttttcattttgagaattgtgtcaacaaatatgtagaggttaagaaaaggaagaaaattattttaaaaaaaaggattatacagtgggaacaaaggatttgggaatcaaggaaatgaaggatatgagggggatggctacactaaagatcagctgttctgagtgcccagagaactggagttaagggtgtagcctcacactccttcagggacctgtactaacagacttcgcgagagagggattcactgtaaataggttgcttagagttctgttccttgggagttttacagctgatctagatgactggaagaatagacctgttcatgtaaattgtaatcctgttaaagctatggcatttattaaggacttggacccctttgacaatttggacatttaggaaccctcagtctagaatgatgcccatgtgcacaccctgttgtgtttaaagtgttcaatgggacccttagtttagaatcctggcagcacaggcaaggagaagtttgcaagatggtttgcagccccagcagttagctactgcataaatatctgtgatgataaagagtggatgtattggtggcttcagacaggcaacaggggggaatttgtttttaattttaggcattttaaacagcacaggcttgtggatttaaaaaaatatttgcattaacacaacactaaatattgtaaggggcaaggaaagtttacagcaaagcacatttgcttggggagaaggtttctatggctctccactagctgttacatgtttatatcctccaaaactttcactctggcttttttcccgggaaagaaatatctgccctttcccattcttctacccttagtgtgtgtgggtggctgtgcatctccatggggaggacacggaataaagctgtgcagcatgctcctttgctcccagaatctcaagccaaaaggaattgttctgaattggctgggtcttattttctcagtgctatgcctggaaggagacaggatcagggtgtgatgtgtcctgaaagcataaactctttattagcacagataaatcagttggttggctcagtagatttttgggagtgttggtgacattcatttcacagggatctcaaattatccaggaattacccagacagtagattatgatgccctgactctggcaatatctgctgttactccccctcctccctgctcctgcatatgcatacaagacttctatgcttttgcagtgtgatgatattggggaagctgcaagggttttagtctttaagtttctcagagcaaaagaagaatggatacaatttactgtgttgtgggtgagagagaactgtgaaacctgatttaaaacaaaagtgtgggcctgtgtcttcaataatctgactttgtctccctgtagcataaataattccagttgtataattatggctattcaggtaataccctgttatattgctctggagttatactccttttaagatttgctagttaaaagttgtcactttattcagacttttgtttttaaagttaaattaaaatgttcttaaggtagtttattctccaggaggcaggattagcctttctcagtagatatttggatctatttggaaagttttgatttttaaaattaagtctttgagtgtatcaagttaaagcataatgtattctaacatcaacttattttttatgaatcccaaaatattttgctacatattctgcaattggaaaatggcatctcggaaggattaaagttccatatgctaaaggagacaccaaactctgtaaaatatttcaaaaggcttattctgagccaatatgagtgaccatggcctggggaacagtctcaagaggtcctgggaaggtgtgcccaaggtggtcaggttatagtttggttttatacattttagggagacagaaagtgtaagtaaaataataaattaatatatggaagatgtacattggtttagcctaaagaactgggatatcttgaagtagtcgggagtgggggttacaggtcatgggaggattcaaagcttttctagttgaaaattggttgaaagagttatgctttttctaaatgaagtcagtagtaagaaatgtttgagttaagataaggggagttatatagtccagtgttcttgctgtgtagatgaagcctccaggtagcatccttcagagagaatagatgataaatgtctctttttgaaccttaaaggtgtcagactctcatctaatctcttctagatgcaggaaagacctagaaagggtctttcctttaaataagagattaaatgagagacctggctgtattagcagacattctctacatatgcaaatttcccttaaaagagaaggctttatagggtcatttcaagatatgaaaaaatatatgtcaaataaatatatgttgaagtaagatattttgatttccttcagggtctacatgtgactctataccagagtcaggttggaacttggtgtcttattgccacaaagcgtctgttttttcagtcttatgatgccaatttcaatgttaatgctggccagttatgcctaaactcccagagagaagaggtttaaggaggtttgtcccacctcccttcccatcgtggctggaaattcagtttttcaggtttctctggagtccccttggccatgagggacatccattcagacagttggggggcttaggatttcatttttggtttacaagtagtactaaacaattattaaatctgttcttcttaatgtaatatggcaaatatttacaatgatttgttaagtagtctatcggcattattctgacttattgttcccttgtcctttttatggagtctccctctgttgcctaggctggagggcagtggcacggtcttggcttactgcaacctcgacctcccatgttaaagcgattctcctgcgtcagcctcccgagtggctgggattacagatgcacaccaccatgcccagctaatttttgtatttttagtagagactgggctttgccatcttggccagacatcttggtctcaaactcctgacctcaggtgatccacccgcattggcctcccaaagtgctgggattacaggcaggagccaccgtgcctgccccttgtccttcatagaaccactttgatatgttagtctacttcaggacaggtgcctcttctctctctagatagaaggagaaacatcatctccccacctctgagcaccctaagaacaaatacatggccagtggttccaatccatgttacagctgtccaacaattggaagtatttattatttacataacagtatttctagtatataaaattcagttgatatatgcttgatacaatttactcagatttttgaagattccaaagacattttacaatgtacactgaaaatgattgttcccaaactgcatttcctgcttttcgaaatcatttctctcataccatccctccagcagcggtcagagaattgagtagcacttttttttggcagaataattctatatccaggtcagtgagagttttcttgttcatactttgatgttttgtaaatacaaaacaaaattcttattctgatctcagtcctgttaggggagtggttagctcagcatgagtcctaatgtatcagagatgaagggaaattggttgggagactactcctgggaccaggtgagaagcagctagtgtcattccgaatgtgctacagaggaagaaatccttgtagccctctatggtacttacttagaaacatcctattaaaatttgctacatagttaaaactgacattttgacccctgtctaagaaagtggggaaacccttgtcatgaataatgctatgtacagcagcagattaggacttctaccttttatctcgctttcgactctaaggtagcattccattctctgtcactttggttaaaatgttactttggaaggcagaggtcatttggagattgtctcgtggtatgtaaataaaactaatataaaaagtctgttttaaagttatacgacctctcctgttcttcctcatctcctttataaggtttataacttgcagacttttagcatcagtaagattataatatgtaagatatatataaacaacgaaaggaagaaaatgggaaagcagtcccatattcttaatgttcttactatatacatgtatggactaattcggacaaagtctccaattattttaaaatatactgatccacttttaaaaatccatttgcgtacatcccatatctaaaagttgtgtagggtataggaacaacaacaactatataaatctatatctatatctatatatatgtgcaagcttgcaggatatcgcaaaaatgaattgagtggatctttgatggttaaggttgagtctgttcaaagcctattgacttttaaaccaggagtctcagactcagatcatttcaggagttagacaagtaactggtgaaatatgcatctgttgcattttagacagtgagaatttccttcatttctacacagatgtcatattgattattcttgaaatatgagatcttcttgatctgtcttctgtttcttatttataggagtatgtgcagagaaatacacactatttggtgtgagatgtgagatactaaatgttgtagacactgggatgtcccagctcagcagcagctggttgttgcctcgatgtagaatgcaggccaccagtggcccgacttttgcttttaccagatgagatggcagcctggttcttttgcagtttggcctgatttttaagcaacaggaacaacaacaaaccatatagcccaaggagtatagacctgtaggtggactgcatcagcctgcgggtgcccagtttgtgatctctggtgaaacgttagataggagactgtcttttcttcccagttatgtttagtttagaacaaaaattggatgggaaattctcaaaatttacaaatacatttctttgatcttcttagcttttcatagattggtttgctttgtcaacaaaaatttacaacttccaattttctttgcaattgtctgtgcatgtatatatctgtattttgttaatatgtatttataaagttaagtgtgtattcctcttattgatattttaaatattttaaatttattttaaactcactgaagtaagacatgtaaaactgcatgtattacaaggtttttaacaaatatcagcaatgccatgccccacccacccctccctactctttggaagcaaccactttcaacttgtgtttcttctcatttatcagcaatatgcttgagtgaatatttcttgatttttaatattaagaccttttcaggtgatctatgataaataatagtttagttcttttttattttttcttcccagttcccatccctcattctctcttcctatgcatcctgcttcattaattaaaaatgttggtgagatcagtattcagtttttgtattagtatgatgataaaatattgttgaaagctgagtcacacaggatacttgtacatgtattttttttctctttccctggttttataatggtttcattttgtttgtttagtgatatttctttaaatatatttcagacatgtctggtcaatttctgggaaaggattctcaggagatatattttttttgacatttatgtctgaaaatgtctattctttactcatgctttattacaaaggtttgaaattctaggttgaagtcattctctttcagaattttgaaggcagtatgctattattttcagttttcagtattattgttgagaaggccaccttttacctgccttgtacctccaagcctctgcattttccgcctccagttctttgaaatttcatgatgtctgtgggtttttaaaccatttattgtcctgtgcactttgagcatttattagagcctttcaatctgtagattttcagttttgggaaacattatttctttatccttcgcctattctcaagacacacagtttttcagttgttctctttctggttctgttattgcgttttggaccttctggagcactcttctaattttcttttttttggccacctattttccctttctttgtctttttgttgtattctctgtaacattttctaaggtttatcttaactttctattgactttaaattttgccatcaaaagttttatttttaagagctctttgttgctttatgaactttgttttattccttttaagcatagctattgtatgggtgcaatatttgttcatttctctgagggtataaaagtctttttgaagttttcttctgctgtttgccttattgatctttccttagggttatttattttttctttttatttatgttagtctcctctggcttttatggtacaggattcccacaaatgctgggtgaaccttacattgttcatatttgagtgagtctctagtctgtccttcgtgattggtggtggttttccctgtgaggtaattctgtgtcttgttgggccccttaaatgtctagatttataggtttggattttttttttaactgattcgtgtctctatagagcagcagttccttaaccattagtctcatgacctttttacacacttaaaaattgaggactttatagactagtactgtccaatagaaatataatgcaaatcaaaaatacaagctacatatgcaatttaaaagtttctagtagctacagtaagtttaaaaacgtaaagctgatatttcccaataaatccaaaatatttttaacatgtaactaatataaaaatcgagcaatattacatttttttatactgtctttaaaatccaatatatattttatacttagagtatatctcaattcagactaatcatatttcaagggttcaggggccacatgtgactagtcaccaccatgtggacagcccagctatggagcttctgtttatgtgagttatatctactaatatttactgtattggaaactaaaactgagatattacaaaaatagtcacttcattttaaaataatgccaaaactcacttcatgttaacacagtgatatggtctaggtctgtgtccccacccaaattttatgttgaattgtaatccccattgttggaggtggggcctgttgggggatatttaaatcatgggggcagtttctcatgagtggtttagtaccatcctcttggtgctgtcctggtgatagttctcacaagatctggttgtttaaaagtgtgtggtacctcctcattctctctctcttgctcctgctcctcctcccgcttcaccttctgccatgattggaagcttcctgaggttttcccagaagcagatgcttgtgttatgcttcctctatatcctgcagaaccatgagccaattaaaactctttctttataaattatgcaatctcaggtatttctttatagcaatgcaagaacggcctaatacacgcaaattactcacttttatgtgaggtaaatgtttttccaagacagaatttattaagagtggtgttttacatttttgcagatcttaatgtttgtcttaatgtagaagatagttagatcttcatatctgctttagcgttcaatctttttttaatatgttatttttcttttaagtatagaaagaaattctggccctcacaaacaggtagttggaaaagggatgaatattttcatagtcttttcagataattctggatgttctcctttgatactacaccaaaactcagcaattggtggtttcttaaaggttagttgcaatgcggaatctaaaatcatatcaatgcttttcctattctgtcacattaaaatccatttgtctgtcttgtcctttgaatgcctcttttatacatgaatgagtttgtaacttgttataacacacattggtcatttgaaaaacattggttgactgacttatgctaatcttccaaacgctgacacatctcattgtacagtattaaaatatcatatttgcttatcaccatcagtctcatcagaaaaatcagaaaaattgggaaattgtcaagctcagtgtggtgtatagtttatccaaaccccaacttctgcttgaaagtttgaattttacgttggcaatgagcactgtcagttgttatccttgaagcgacaggcttactgtgtttactttttagacagcgtctgccaaatacccaaatctgaataaccgtggtttctctgtcagtcagtttttgaagtgaaaatgctgttccatgaaaaaactactggttcagtttgacaatgaaaatagtgcatgcattttttttcctgaaggtaactctcatactttggaatgcagcagaagtgctttataggtacacttcattttatcacacagaatattgaaaagacatgtaatcaaaagttgagatttaataaagtaagttttactgcctcatcaagttcttgaagtcagctttttaaactacaggtattgacaaagcctaaaatggatagacctacatgtaccatgcacaactgtaaaactcttaggacataggagaaaacctagatgaccttgagtatggcaatgactttttaggtacaacaccaaaggcacagtacattaaagaaataattgattacctggattttcataaaactaagaatttctgttttgtgaaacacacggtggagagaatgagatgataagccaaagactggaagaacatatttgcaaaaggcacctgataaaaacgtgttatctaaaatatgcaaagaatatttttaactttccaataagaaaatgaaaaacccaattaagaaatgggccaaagacctgaacagacacctcaacaaagaggtacagatggtaaataagcacatgaaaagatgatccacatcatatgtcatcagggaaatgcaaattaaaacaacagtgagttactactgcacatctattagagtggccaagacccaggacactgacaacaccaaatgctattgagaacgtggagcaacaggaactcgttcattactggtgggaacgcaaaatgaaacagccactttggaagacagtttggcagtttttaaagaagctaaacataccctgactgtatgatccagcaattgtgctccctgatatttactcaaaggagttgaaaacttatgttcacacaaaaatctgcacatgtatatttatagcagctttactcataatggccaaaacttggaagcaaccaaggtgttcctcagtaggtgagagactgaataaatgatggtacatccagacaatggaatattattcagtgaatgggaagtcctgcgtgtagtggtgtgtgtctctttggactgagttgtgagggctgaactgaaagtggcaggaacatgccattttagcataatgctaacattacattagatttggccaatatgtcagtgtgcagtatgtgttaagttctttcgtcccttaaacttcattatctctgtccaaactatttttatttggactttatatacttctttccaaaccttttataaaatttctcctttaaaaacccatgccaaagttttttctctccacggccttccagatttctcaaatgttccaaatgttccatctcccttcccagggttcctcttttggaaagctgttgtgatattattcttccttctggaaagcttgcagagttaggggttacattaagtctggggtaaatttatacaggtaaatggtacaacctcaagccttctgtggaaatcagctggcctctcctgatgatactttaatctcatcttgattctttcaagcctcctttagcctgtgactgtagatgaacttaaatcacagaagtgactatgaccctttactttgcctaacaattcttctttcttctagacatagttgaaatgccatcttttttctgttgctttcccaggtaaaaatcagtcttgcagggcagactaggtctttttggggagatggacagacccaatttgcatatccacataagccaagccaaggcaactagcatgaatgtacaagcatgtggaatgctttccaacatttttttttctttttttaaactttccaacttttagtttaggttcaaggggtacatgtgcaggtttgttacatgggtaaattgtgtgttgcaggggtttggtgtacagacaattttgtcacccaagtaaccagtgtaacactcaagaggtaactcccactctccaccctcaaggaggccctgatgtctgctgttcccttctttgtgtccatgtgtactcaatgttcagcttccacttataagtgacagtatgcagtatttggttttctgttcctgtgttaagttgcttaggataatggcctccagctccattcacgttgttgcaaaggacatgatctcattctttttctggctgcacagtattctgtgatgtatatgtaccacatttcctttagccagtccactgttgataggcatctaggttgattccatgtctttgtgattgtgaatagtgctatgatgaacatacacgtgcatgagtctttatggcagagcaatttctatttccaacatttttaaccatgtaattgtgctttctccaaagttatttcttccaatgcccatggacagtggagagaacgttttcttgtttattgtctctttttgcaaaaacatttcttatctgaactgctgctcttcttactgggccatgtttatgtcctagaattttcacccgggatcacaaactagcatatagagggaacagtgtgccctgaatagtgctgtggcatggagtgtgtgcagtggaaagggcacagacccttggatcacaaagacctggattggaaacccatatctgccatgtaccactggagggacctctgactagtaatttcagtctcagcttctacatgtataaaattatattttattgggttatagtgatgatttaggtcaatgagttaatatggataaagtgctattcagagtggttggaacactgtgatcacactcttagtggacatgtccacaactgcaacagtgacagtgtcacctgaaagtttgggttgggaactcttaactcctagaaacatttctttgcattatgaagtcatttataagcaacttcttttacaataataatgcttaggagtaaaatattaagcttctaatttcctaatgtgacttatttattagtgtatttcttgcaattaaggcagccagagttgctagactcttttgacatgagaaaggacttatgaaataagtagcagagaagaaaggaaaagtaggactgaacccctctagttttatctaggaatatcttgtttgacagtcttcatatttgtatgtttaattcctacacttggcttaatggacttgggagtctatttttccttctttattttccttatgatttttctatcttattttgttcatttggtagttacataataaatattttcctgaataaatgattctttttgttttctcttcttccatctgtctttacattagcgtattggtttcttttgctcagtatattgttactgagttagtctctaccctaaatcacttgattttctgtctgactgtgctctttttgctttgagagaaaccttcatcttcacctctttttagtccgttgtgctagagggctggatattgggtttgtggctgttcagcaaggttgcaatgctgagaatgaagaaggtcagcttctggacatcacttcacattctaaatgtgtgccatccagcagcctcactgcatgaccactgctgagctcatgtcttcaagctctctgaaagctgagggatggtttcaggagaattaattggcaggcatttcatcatgggctactagtgacagcatacagagctgttctttcccagttcactcatttcttcttttgcaaaagtaaaaatgtcttgagcatatttcaagtatgttgctagttgtcactagtatcaaacagttttatatatataatatgcttcacagcagcgtgagtgacatgacaaaaataagagcaaaagagcaggttttttttaaggaaccaaggtactctaagttgactcactggtaaggaagaataagccacaattcttgattgcagaggtgttgctttattgccgcattaactgcaagctcccatcagaatatgacttctgggtgtccatttctaagaccacgtgaaccgatcttgttaccacaccaggcgtgccctacacaagcaagagttagaagacaaagatacaacttcagacctgtagcagaaagaagaatgccaacagagtgtaattgtttagaaataagagaagggacggtatcagggtagtccaacttactttctgataataatggcttaacacaggcaggtgtacttcttgagcacactgggtactccgtgtgagtgggaagggtgctctacttattgtaggcactcaggctgacaaagctccatctccacatagcctttccaaaccctgaggcagggagaatacttactgactcatgcacctctctctctctttttttgagatggaatctcgctctgtcacccaggctggagtgcaatggtgtgatctcagcttactgcatcctctgcctcctgggttcaagcaattctcctgccacagcctcccaagtagctgggattacaggtgtgtgccaccatgcccggctaatttttttatttttagtagagatgggggtttcaccatgttgcccagactggtcttgaactcctgacctcagatgatccaccagcttgggccacccaaagtgctggagttacaggcgtgagacacctcacccggctcatgcacctttcttgggttacaggtgttagccacctcacccggcccatgaacctttcttgggttacaggtgtgagccaccttacccggtccatgcacctttcttaaaggctacagcccagaagtggcatacttcatctctgttatgattcactggccaaagtaagtcgcagcactgtactttaacatcagaggggacagggaagtgtgatgctgtcatgtcctgggaggaagaagaactggactacctatgaacagggccgttatctaccataggtggtatgctgaaataatgcctgctgctgaggaagaaatgagaaggtgttagagtcaagtctgaactcacagccacttgtgtaggttaacaataaaaagcatgtatagagggcactaactgtatacgtagtcctgtactgtaggttagctgtgtaggcaagttggagcccagaatgcttgatgggaagtatgtactttcagcaatagtggtggctacctgtgccaagaaatctctgttttgatgatctgagagtgctaggggaatggggcaaggaacagaggagtttgaagaagttgcgtccgttattctgagtgccctttccctatgctgagagactttgatctacacttatagcaagttacagatacagaacagttttaattatttagaaatgtgagtacctgtgtttcactgtaatgtaaagaatacgctagtgtcctggacatcaaaataagaggaatgccaagcttatatgtacctctgtggggtttttcttgagggcttgaaaggaattctaacttcagtagcacacactaggtattcaataaacatcttagtagatggattacaaaagattaaaagaatgttaccatctcatggataattcaaacagtagctaaaaaaactgaaagctgtaggaaggtattaactgtcaaaaggttggggttaggacgacaaaacttctaacgcaatgcaggacatctgtggatgtgtattctttttttcccctttgcactaaactggacactgtgagtagtttattgtttcatttgtgtatttgctcctacctaccctttaaaacctcttgaacgctatgctttaataagttctataaacttagtttagacataatatttctactaaataatgctatcccaagtagccagtttataatatccttgaattaattttgactgtgcttaacatagcttgggaatggagaagttgagtaaaatattctaatatatcagtctgacttttctccattttaaatctataatattgatttgttttggaaatttcttataaataaagcggtatatttaactttgtagctttattctgaacttgacaaaacatttctagaaaccttttatctagtttttcctaaatagctttctgtggtctctgcccattatcttaaacaaagtctgtctttgagtcagggagaaaagagaaaattattcaacagtctatctaaattagccattatttaatttatctgggtctatacaacttgtaaacagtgataaggaagatcttgtggtgttaaggtgtgtctcatattcacctggtggctatcaattactttcctgtttgaaagtatcagtttgtacaatcattgttctaatctcacttagttcatctcttgctactttatcagggagaactggttatttcaactctgacataggtctagtatttctttcaagggggtgaggggcagagggtaaagagtacactatggcttcacatgtacagtgacagtttgtaagagaaatggaaatagtgacagcccagactcggactctgagcaggaacccttcagtttaggttctacctttctaattagatagacaggacaacttgagcatgcctctcattgtgctgtctttccaggatgatgtgcgtgatactcactaactcaaaacacgcaaccagcatttctgttggtggaaatcctgtacctccttggagggagactcaagacctgcttcttccacaaagcccaacatcattctgttgtgcaaaagtgagccctcttctcccaactcccacgataccctcattgtccgtgtatggcatttgctgttgaggatatatagctcattcagtatacaattacatacaactcatttcctcgatgaatcagaaactctttgagattaaaaagagctcacgtgtttgagcctttgtatgttactggcttttaggttaaacatgtcacattaactctattaatcattggagtattagactataatattaattcattttataatctttatttatagaattatatttatatactactattatatagccgtatttatgatgcatattatatttattacattgctattattatttttatggatgataaaacagtcataagagggtaagtaacatgtctaaggtggtatagtaatgacaaggccagctataaattcagatcttccaactctttaaccttttacaccactctaggcttcatccttatattcaacaaattctgttgaatatagtgtattatcagtaaacatttgagctagtgctagaacttctttaatgtataatgagttggtagaaaatctgtagcttcagattaaaatatgcataagttctgttaaagtaagtgaatatagatatttctaagtatgtttgatacgttcccattatgatatatgcctctttcatttgcttaggcagtgctttgtcagagatggcagactataaattggatcttgaattctgaattactagaataaagattagtgagcattctttttgtgtaatagtagtttttggctgtatccttagccagcaatttttattttttaaaactctttgttttgaaataattatagattcacaggaaatttcaaagataccacagggaggtcccacatactattcacccagtttctttcactggttgagtgttaaatagctataggacaatatcaaaaccagcataaaaatcagaatattggcatctgtataaaatgtgagtatagctcgatgttgttacctgtatagattaatgtcaccattacaatcaagataaggaactattctaccatattctaccatcacaaaaacctccctcgtgccacccctttatagtcatacccacacccagcaccctccaccatccctttttccttgcaatcaacaatcttttctatatctctataattttgtcaattagagtgtgttgtgtaactgaaattatgcagtccatgaccttttgagaatgactttttttttctacttggcataatgtcattgagatatatccaagttgttgcatgtatcaataattcattccctttttctttattgtggtaagaacacttaacatgagatctgtcctcttaacacttttgaacacattttaagtatataatacagcagtattaactattggcataatgctccacagcaggtctctagaactgaattatgttgcataaatgaagaatttatacccattgaatagcaactgcttatttctccctgtccccaactaacagccaccattatactctgtgcttctatgtgtttgagtactttatgtaccttgtgtaagtagaatcttgcagcatttgtcctcttgtaactggcttattttgcataccataatgtctacagttctgtccatgtcattggcaggactttctttttagaggctgcataatattccatggtatgtatatactacatttctttattcattcatctgttggtggacatttagagtgaaatgtccatcatttagagtgaaaaggcagcctggggaatgggataatgggttatatccaaaatatgtaagcaaattctataactcaattgaaaagaaaagaaatcccaagcaatctggtttaaaaagttgtcaaaggacttgaatagatatttctccaaagaaggacctatgaatatggccaacaggtatatgaaaagatgttcaaaataaaaatctcaatgaaatataatctcacaccaagaaaacaaaagataggtgttggcagggatgtggaaaaattggaacttttgtacacttgttggttggaatgtaaaatggtacaggctaccgtgcaaaacagtgaaaactactcaaaaaatgaaaaaatagaaatatgtaatgcagcaaatcatacttctgggtacctatacaaaagaatttaaatcagaatcttgaaaaggtatttgcatttccatattcattgcagcatttttcacaatagtcaaaatgtggaaacaaactcttctaattgttgagtagtgttccatggtgtggatatactctagtttgtttaaccattcacctatcgtggacattctgcttgtttccagtttttggttatcataaataaagctgttatgaacaatcacagataggttttgtgtggacaaaggacagaattttcatttctctgagataaaggcccagggatgtgatctctgggccatatgttaagtgtatctttagttatttggtaaactgtcaaacgattttccagagtagctgtactgctttctactgtcaccagtaatgtataagagatccagtgtttctctatcctcaccagcatttgatattgtcactatttaattcttcggtcattctaataattgtgtagtgatatctcattgtgggtttagtttacatttccctaatggctagtgatgttgaacctttttttgtgtactgatttgccttcagctaaatctttcttaatgtctttaacccattttcaattggcttttgttttctacggttgcattttgagaggtatttttatattctagatgagtcctttgtaagatatacggtttggaaatatttttttctctgtagcttgtcttttcatcctcatttttatttatttaaggtagagatgaatcttttacccaggacaattgttgtggattcaaaaataaaaatattgaatggtgccatgcctgcatgccctctgctctgttagagattcatgggcagaggaaagagtgccatctactgaagcttgggcatcggttctccatgacagcaactgacaagggagggcaaggaacatgctcctttaagatgcggctgagagggccatccaccattcatgtagaaagcatcactcttgcaatttagtggaaaaccacaactgatccctgccaggataagggattgttgttgactttgtacactaagtctcttgaagcattgacaatgaagaaattaaataaaatacatgacattggtacccagctgatttcagatctctctcctgcctcagctttcttcgttccaattaattaaattcttctctctaattaaagcaatacattgctattagctctaggtatatttataacacatgccttgaaatgacatttccaaggaagactgatctaacctttgttttcgaacaagttatttaggttatttatagatttttagctttttaaaatctatgaaacgctcatttcataatattccacatataatgaaaattccttcctttttggaagaaataggtgatgatttactgatgtatcacagctgtattaccatccttttctatacttttttagtgttgcagagactaaatatgcttaaaattacaaaatttgagattggttcacttagatgtatagggtatattattttgaattaccatggagtaggaaatcctagttttctgtatgtgagataagtggtagctttaatatttctggcataaagactcatcagtcattttttggaaaatttaaagtattaattttttgactttagttttataggagtacttaaaatttggtaggtgaacaattagaagtagtaatccccatggactgacaatttgggtgagtttggatacatgtctgggtggcagatttttgaaatgccctaataaataactaaagagaaagccaacaccacattacatgtttggcaaatcagttttctgtgtggtactcttttcccctcaaagtatggcagggaatctgatttcaaaaattaaacatactcagctatgaattccttgcctttttccttactttttttcttttcaagagcctattttactgagaagcagtgtagctgctttcacattcatctgctactactgtggcaaatgtttccaccaaaaatgcttgatattgctatttggagtacccatgaatttaaaggaagtagacataattatacattatttgaatacagatagacgataaatatgatttcaagtttttttttttacatatttaaaaaaagtctgggtaaaaacaaacctgttagaaatatgaagctctgaaacaaaattctaaaaatctgtagtaaatgtattttttccctctgtatttttggattcttaaaatcctcttctttcaaacttttgataaatacaattgaacttttcaataatatcagttttgtgatgtgtttgttttattatctagctttcccccactcccagttttgaaagatttattttcccccaacattttctatgatttttttttcaaaagtaaagcaaagttaaaagaatttcacaggaacacccaaatgcccaacacctatgatatggtttggttctgtgtctgcacccaaatctcatcttgaattgtaatccccacatgttgagggagggacctgtaatccccacctgtcaagggagggaggtgattggatcacagcgatggtttcctccatgctgttctcatgatagtgagttctcatgagatgtggtggttttgtaagtgttgacaattcctccttcactggtcgtcttctctctttcctgccaccttgtgaaaaaggcatttggtgcttctttgccttccgccatgattgtaggtttcctgaggcttcccaaggcatgcagaactgtcagtcaattaaacctctttcctttataaattacctagtcttgggtactatctttatggcagtgtgaaaactgactaatacaacctagattctctctgttaatccatcttatattttgattcattctaaagtaaattgcaaatgtttggcatacaagtcagttacagttcaacattatttatattttatttaaaattttcataacaatagaatgtacatatcttatgtgtacattagctaagatttgaaaaaactgtacaacttagtaacccaaactgttatcaagttatagaacattagcatcactctagaaaattcccttataaccccttcagaatcagtttccttctcccaaaaacaagttagcttgttctagaatttcatataaaaagaattatacagcacacactattttgtgcctggcttatttcactaagcttaatgtttttgagatctattcatgttgtcatatttattgatagtttttttccctttttgttcgtaagcattatctcctggtatgaatatactatgtttgtgctaatgatgggaacctggaattcaaggcttttaatcccagaaaaagactttaagattgtgaaatagcatttcattaaaaactactctttcatcatttgtatacagttatctcttaactgcaattttgaaaactctgacatttgtatgtaaattttataatctagatcaagcttgtccaacctgcagccccaggttgcctttgaatgtggcctaacacaaattagtaaacttttttaaaacactatgagtttttttgcgtttttttttttttttagctgattagtgatcattagtagttagtgtatattacatgtggcccaagacaattcttctgcttccagtgttttccagggaagccaaaagattggacacccctgatttagatctttgtgtatatgtttaacttggttttcttgagcaaaatttttggactctaattattaaccacccttttgaagactacaggagtttctccctatcccgctttgcttttaggaagatcatcttggaaaatgccactgcaaagtctgtgtgttaattctaaattcccgttttttttttttaattaactttagaaaaataaagtcagtgttctatggaacaggttctgtaagggaagtttgtgataatatgcatgggcaagtaggattgacaaatatttttgctaaagctgcttaaacaccacaggttgatgtgtaaatgcataaatttaaagagaggggagagaacaggaaaatagctcttttcaatgattttgaaatttttctgcttattttcttttcctgcaacaacatagtgatttaatcagcattgttaagtgatcagttagcaatgacacataagcaattatattcaaaacctatcagtaacttcattttctgaccatctgacactcaaggttagggaaagttgaacatacataaaaacaatgtattagaaaacacagtgacattatgactaactaaaaccttgccagtatacatttttaggctactaagatcattatgtgggagattgcctttgaacattgttctttaaaagtttgtgcattggtaatgttatctgtagatgggaaatgaatgaagcacaatgtcttaacatcctctcagacaaatttatgtggagaaggaagaaattttgtgatttaaaaatcatgtttctttagtttaataggatgaagaaagcaaacattctatagagtatggcagttgtagaatatatatggtaaaggttgtttggcatttgtttcactgtagtgtcagttaatacatgttatttggaagagcttggaggagataaccagtaaatatccatatacagttccaacaggatgtgcatcccattgcctaaactcacttcaaaaagacctcatgaagttggacactgtccaaagctttcacaggggaacaaaagagatgatcaaatttatagctgctcaaggagaagcaagaagaaaagaatacaatgattttgaaatcctatagaaactttaagtggaaagatgacatcctttgaaaatctgcaaataagagcaataaaattagctttccaagaattagagatttgccccttccctactttctgttttacatttttacataccgtgctcctgcagtgatttgcttttctgtatttgtgtgaactttcacgttttctgtcctttgcttgtgttcttgcctctgattggatgcatctcatgaattcagtcatcttcaaaaccgtgttcaggcatcggttgcacaatcacgccacaatgattactgcttccatttcttcagaattatctatcagtagatttattaagttctctacctcctttctgtatctgctgcacatacttttgttctcacgaatcactgatttttccagtagtattacagctatagtaaccatagtagcagcagcaacaacacttgtataatgccacactgggccagacgtagtgctaagatttttacctgaagtatcttattaaatctcaccatatctttataatttcagtgctattattatgcatagtagtatgtttcattgccccagtggcagtgattctgaattatattctattaatatcttattgaaatgtgtctctaaaaaggacaaattattttatccaatatttcttataaaattacataccaaatactatagacttttttctgatctggtcaagaaatatttaacaaatataccgaaaagttattgatgtgtatatgcagcattacataaagtaagatatctccaaacctgagaataaagtcataaatctagagtatatgtgctcctatactctctgtacctgaaattaggaattctgccactgtttactttctatgccttgaaacaagatcttaaattcttgagcttatgatttgtatagatgatataaactatacaaactaggcctcatctagtaccctctattctttatattgatagtgttatactcaatctgatccaaactggtttttattaccatgggtaatgttagcaggtgtgcttgtaaagaaatgcaagggtcagggcaagggtagtggggtttgtgtgtagggtaaccacggtatagggattttatagggtgtgaagcattgttgaaaaaatgttttgaagtgtctgcttagggaactttgaaaaattttggaagcacatgagtgatttgggatggtacagtttcatgaaaaataaggtaatatttgtaaatatttgtggatatttatgtttttgaacatctctatccatctcatcttgcatctagatacttggttttgctgaacaattggatgttattttataatgatttattcttgatattgtagattttctcaaaatttttgtgtatttggatgtatatatctttagcgtatagttgcaatttttgtcttttagtggtaaaatggattctatttaatttttggagcacgataaagagttgtgatgggaagtgtcctattaatgctcacatttacattaatatcttaatgtgttagactttcttttcaagttcagattttatagtttatgtgtatagagataatataatattctctgatggttggttgtatttctgtggggtcagtgataatatcccacttatcatttctgattgtgtttatttgaatcttcttttcttctttattagtctagatagtggtctattttattaattttttcaaaaaaccagctcctagatatgttgatttttttgaagggttttttatgtctctgtcttcttcagtttagctctgatcttggttatttctgctagctttggggtttgtttgctcttggttctctggttcttttagttgtgatgttagcttgtcaactggagatctttgtagttttttgatgttgacattttagtgctagaaatttccctcttaacactgctttagctgaatcccggagattctggtacagctatctttttctcattagtttcaaaaaatttcttgattcctgccttaatttcattatataccccaaagtcattgtaccgatgggtcttagttctttctttcttttttttttttttgttttttagacagagtctcgctctgtcaccaggctgcagtgcagtggcacgatctcagctcactgcaacctctgcctctcgggttcaagcaattctcctgcctcagcctcccaagtagctgagactacaggcatgcaccaccatgcccagctaatttttgtatttttagtagagatggggtttcaccatgttggccaggatagtctcgatctcttgacctcgtgatctgcgtgcttcagcctcccaaagtgcgggattacaggcatgagccactgtgcccagctgggtcttggttcttaatccagcttgccattctgtgtcttttaattgaggcgtttagcccatttacatttaaggttagtattgttatcctatcatcatggtgctagctgctggttattttgcagactttttaatgtggttgcttcatagtgtcattggtctgtgtacttcagtgtttttttgtagtggctggtaacagtttttcctttccatatttaatgcttccttcaggaatcatgtaaggcagatctggtggtaacaaattccctcagcatttgcttttctgaaaaggatcttatttctcctatgtttatgaagtttagtttggctggatatgaaattatgggttgcaatttttttaagaatgttgaattttaagtttttcattttggagatgaaatgataacattttagacagccctcagtgaaagaagtcttatttatttctactaagtttggaggataaattagaaatttatagtagccagagcaatttgttggaggtggagcctgtggggaggtgactggatcatgggggcagatttcccattaaagagcaccatcccctcgttactatcctcgcaatcatgagatgtcatgaaatctagtcattttaaagtgtgtggcacctccctgttcactctctcttgctcctgctcccaccatgtcagacgccttgctccccttttgccttctgccatgattgtaagtttcctaaggcctcctcagccatgtggaattgtcagtcaattaaacctctttcctttataaattacccagtctcaggcagttctttacagcagcatgagaacagactaatacaggggcactctggctttttgagttttcagtgttcttgcgctgattctttcttatctttgtgggcttatctacctctgatctttgaggttgctgacctttggatggggtatttgtggttttttaaattgttgttgtttgcttttttttcttttagtggtctgcccactcttctgtagggctgctgtggtttgccagagggtctgctccataccctaggtgcctgggttttgccagtacctgcagtctccacacagctctatgtgttgtgcccaaggccctggtggccagggctcacgagacgatctcctgttcctacggttgcagagatccatgggagaagcctggcttcccagggttgcacattcactcactgcttctgttggctgggtgtgggggttcccttggctctgtgtcattcctgggtgggccatcaccccaccctgcttttcattctccgtgggtcaaggtgtttctctaatcagtgtcaatgcaagttcctggatatttcagtattcactcgcaccttttgttcccctcggtgagtgccacgtacagcagctgcttctaatctgccatcttggcctcctcccatattttctttatccatgcatgtgctgatggagtcttagactgattctgtactttggctattgtgaataatgctgcagtgaacatgagagtttggatagttctccaaaatactcatgtcattttctttggatatatacctagcagtgagattgccagatcataaggtagttctattttgaatttttttaggaagctttatactacttagcttggggaatttttaataaagagggtgtattttataattatggtaaatttcaaacatacagaaaaacagagaagaggaaaacatatctatgtaccctatatactactacaaaaatatcaattcctgaccttgcttgttttatgaatatgaaatctgtaccccccaacatccctagattattttgaagcaaacctcagatgtcacatttcattcataaatatttctgtatgtatcgctaaaagatgaggattcttctagaaatagcatcatattttcacatctaaaaacagttaatttaatatcatccattggtaggataaggttcaaatttcaccgattgcctctttttttactttttaaaaatttagctgggcacggtggctcacacctgtaatcccagcattttgggaggccgaggcaggtggatcacctgaggtgaggagtttgaccagtctggccaacatgatgaaaccctgtttctactaaaaatacaaaatttagccaggcatggtggtgcacacctgtagccccagctacttgggagtctgaggcaggagaatcacttgaacccaggaggcagaggttgcagtgagctgagatcatgccactcccctccagcctgggcaacagagcgagactgtgtctcaaaaaaacatatatttttaaacttaatttttaaaaggtttgtgggtacatagtaggtatgtatatttatggggtacatgagatgttttgatacaggcaaatgtgtaatgtgaaacaagcacatgatgaagaatggggtatgcatcccttcaggcacttatccattgagctgtaaacaatacaattacactctttaagttatttttaaatgtacagctattattgactataattaccctatttgctatcaaatagtaggccttattcattctttctaactatttttttgtacctattagccattcccacctccctcctgccctagctccccattatccttccaagcctctagtaaccatccttctattctgtatatccctgagttcaattgttttgatttttagatcccacaaataagtgagaacatgcgatgttggtcttcctgtggctggcctatttcacttaacataatgatctccagttccattcatgttgttgcaaataacaggatctcatatttttatggctgaatagtaccccattgtgtatatataccacattttctttatccattcatctgtttatggatacttaaagttgcttccaaatcttagctattgtaaacatcatttttaaaagaatattcagttttcttgaatcaggatttaaacaaggaccatgcattgcaggtgagtcatgtctcttaattctcatttatatatgagtcttccttcccctcctttttgatcttgcaatttatttgttgaagaaacaggatcatttgtcctctcattctccagagtctgtattttgctggttgtattctatggtgttaacattttttttctgttctacatatttattttaattgatatttagatctagaaacttaaatgtatttttgaggtaatatttcacagctgtttttatgtacctccatcaagaattgcataatatagtttttttcccctgcgatattagtggccatagatgatcatcgcttaggtctattatttcattgggggctcacaagatagtcatattcttccattctttcttcattcattagctagaatagttttataaagagagaaattttcatcaatgattttcctatcctgcgagataggttgtagagcaaaggcaaatttaatacttcatcctttcccttttttactggtttccagaaaaatataggttgatttcccagaatcctcagaggtgactattgagcacctttaaaacattattcacaacacatgaatataccatattttgggggcttatcaattattccctttgctcatgtttccaagttttttagccagtggaagcctcttcaagttgacaggatctcaacagtctttgatggcttctttgcttactgctatgacaaaatctttcaggctcattttgtacttttcctcccccggacgaggatcagctgtttctccttggagctttggtttcttagagtgggaaatggtattttgaggaccatgatctaggtagaaggagtaatcattgttactgggttggtcagtgtgtctaggtcttttcaatgaaacacagctaaataaagattacatatgtatgtcttgaattgatatttccagacaaaatttaggattatttggttttacttgattttctatttgcagactcttctctaatgtatcttcgttcctcaggaattaacatggtgcttttggaaatgttatctgttctttcttaagagaggtagagcactgtttcacaagttttgaggctacatatgttgacaggaagcttcaaattaactctcaatgatggacagacacctgggcagtgctccatgtatcatatcactgtatggaggtgttaaagacacatcctgggatatgtggttcgggcctggctctgccaactaatgagtcacttatttccttgtcgtgtaaaatggggataataataatctacctctcaagctttgtatggaagataatatatgtgaaaatgctttgtaaattattaatgtatcataatagaaatcatttccccatcttattaaaaaataatgtgatagtctttgaaccactatacttttgattagctttttcctcaagatttgtttactcttgtaaggcatatttgtcttttttgttaagttgccaggatagccttcctaattaccttctttaatgggtcttcctctctgtagttaaatgtatatgtttgtaagcctctcttgaggtgaatactctttggcttaaatatttgtttggcttaaatattaattaaatattttaatttaaattaatttatgatgttataggtatagaaaggagaatcaaagtaggggtgtgttttgttttttgtccatcaaagcataaaccttgtttttgatgatgctttatttctgtttccagtgtcatggtgtactgtagacccagagctgtacctctggggagatatataactaatctttcctttgatgggacctaatttcagagcgctgtcttcataacctggaatcaaatgaaaagtccaggtcaggttatccagctagatacaagtgtattgtgtgcttggtgttcctaggctctttattatccttatttggctcacaggcctttctgagctaagactttagaggtcaggtgagtgtgtgtgtgtgtgtgtgtgtgtgtgtgtgtgtgtgcagttattctttttaaattctagaagaacagggtccttttctttcttgatgccatgtttatctacctgaaatctcacaaagcagcagccagcatgtacttcctaactttactggtgtttcctttgtcctgccttcaggagaactgttttagttaccctcctgccatcttgtgctcttatggccctgaatttagccttttctttggtttcacagccttagattattccagcctagctttttttatacttaggcttctttctaacttttcttcccatgtgtcaatgatactttccttaaactcaccctgtactgttttacaactgcattctaccccttccagcaattttagccaaactttgcagttgacagtggcctccttcctgcagcctaggcttctgaaacccctttacagtatcttcatatatagacttatggcgctcattttcattcaccaacaattctgtccctgtaaggagttaaaatcattgttattcttaggtatttctagtatgaaataatagaaccatattctaaaactttggaaaataaacacttaatccctttattctttcatactgttttaatgtgtttttttcccttttgtcttatccccaataatttttgtacaattaatctggagtacatttttggttttttaccctcatatcctcagaaactgaagaggctaccaggagcattttgcatgtcctttcataggatttatcattaatactgaaagacaaaatttaatattttatactctgtaaaagtactaatgtaattaataattaatacatggtacaaatactaatagttttccaagaaagatacattggtcaggcttttttgaagtcttcagttattgtcctactgtcctattgttaacagttaatttccttccaggtttaatatacctccagtttcagtatacctgtagatttaatatacacattcatttaaataatacataatgtctgagatagatgtataacatgtttagctgttcctgtatcagaagtgtactaaattctcatatttttactattgtaaatacttatggtgaaaatttttgtgtacacatatttgttcatattttagattatttctttaaaatcccagaagataactaggttaaagtaacagtatttttagtatttttattactcgtgatttacatttctggatagccttctataaaggctataatagtttatgatacctttagcaaattggttacagcttttttttttttccctctgtcccccttgacctcaatgttcatttctttcttgggggttttagcgtgtccttttagcttcacaacagtatctcttttggaaggcactttggcttgtggagagaagaatgcacagtgtactgcagtggggcataggagagagatgcggaagaggtgtggggcagtggaagaccctgacagaaaggtggtggttgtgaggatggcaaagtcgttctgagatggattttctactttcttacggcattatccctggtaagaaactatctctaagctgcaagaattccagtgtccaatgttaaggaatcaacctgtgactaggttttaaaaacaatgatattggactctcagcaatcaaactatgcgttttcttatacaaaaatggaaaaagcaacaagaaatggtctccagatttataaagaatgggttatgacttgtgtactttactgaagatgttgtaacctggtttcatagttaggaacctactgagtattagccacatatgaaagtagaagtttacaattccccagaaattcattaaagagcctgaattgcttagcaacctcacaaatttattaaagcgatttcatagatatcatcttctactttatgtaacagttactaggtatgtcagtgtttgaaagaatatggtcatgtgcagttaaagaactggagaattgtgatctagcactgcaatgtgctgaattgattttcacacattgtgtattactgatcgctatatatttaaacttgctttagccaagtgtaattttgttatttagagtaaactggacttcggaatggtattgctttcagtcattcgagactatagtaggaacattttatagagtactaataaaaagagacatcttgaatgtaacattaaaccatttcattattttatagactatgccatctgtaagcatgccaagattttggggggaggagggggacttcaaatgactatgcattaattgtacctcatgtttagcatgtattgttttaaatgctttatcataggatatcctataacctgatggaaatgatggcatatagttcgtaacagagtgttttgcagaactttagacccctttgaagctgaaagcattatcctttaattctaggacctattctgcctttgtttcttaggcctttagattcctccatggccaagtatccagccctggcatgggtgcttattaactatgtgtccttgggcaattttttttaactctgctgaggctggctttatgatcagtgagttgtaaatctctgtagatcccagcctgctctcactgacaagttggtacctacagtaccctgggaactgcagctagagtggccagggaatattcagggaaaaagctataggacacagggattggggaaaatgaacagcaaaaatcttttatcttgggagtagaagttgaaggacaacattccaaatataatcttataatccaagtctaattcatataagcatttatagtgaaagatggggcagaacataagatcagattttctaggtattcttattagttaaagaccagaatttctggaacaaaatttctaggaaagtatgatttttgtgaggatgaaaataactattactatcattattaataacttttgttcaggtactaaatatgtaccaggagctagtaaatacttctatataaacaggtgaccctcagtatccatgggttccatatctgtggattcaacgaaatgcagatcgaaaatacttggggaataaatggatggttgtgtctgtactgaacagtgcagacttttttcttgtcattattccctaagcaatagagtataacaactgtttacacagaatttaattgtattttgtattataagtaatctagagatgatttaaaactataggggaagatgtgtgtgggttatatgtaaataccgtgtcactttttatcagggacttgagtatctgtggattttagtgtactagtgggatgcccaatctcctgcagatatttagggacaactatataattaattctgtcaatgactttttaaaagatacatcctattattatcttcatttatcagataaagaaaccattactagaaaggcttggtgatgtattccctgagtggtgcatgtgacataggaacacaggctatctgaatccagggcctgcagttgaactcacaccaagttgtgtatcttctacttgcccttataaatatactcgttgctgggcatggtggctcatgcctataatgttaacactttgggaggccgaggtgggtagattgcttgagcccaggagttcgagaccagcctgggcaacatagggagacctcatctctacaaataattaaaaaattagctggatgtggtggtgcatgcctgtcatcccacatacttgggaggctgatataggagaatcacctctgtgtctgggaggttgagggtgcagtgagcagtgatcgcaccactgcattgcaacctgtgcaacagagtgagaccctgtctcaaaaaaacaaaacagatagactccttgctcttctcttcaccacctatgtccaggagcagtggtgacccttcaggaggcatcagcaggttcccttgccccaaattcctgtcctgttcagctcatgagagatgtcatggcaggagaacataggacaatgggggagagcagtcagagtagtcattgtcctggtgccctccctgtggggttggctgccatgtctttacccagggtcacatctgtcaggaaccctcttcagcattctggtaactgttccctttccttgtcccttcaagccaagggcagagggagtgctaagttcttgtggtgactagacctgagatactgcactgtccctttttgattttgtcaaccttgcctacacttgctgtgaataggtccttcattaacttgccttcagtaacccagatggagtgtgccatctcttcttgcccaggtccctgactgatagaccagctctctcatttagagaaatgtgagtgttttcttacttttttgcagtcagtaaatatttattaagtatccagaaagcatgaggcactgttcttggtgtactagggtcactaatggagcaagagccatgagccctgcctgtgggcagaggggaggaaatttataagtatctatattttatatatatatttactatatataatgtatatttactatgtataatatatttactgtatatataatatatatttactatacacacatatttactgtacatatatatgaaagtatgtatatatttactatattatatgttataatagtatattatatagtattatatattgtatattactatattatatgtacatttatatatatttattctgtcaatgacttttttaaagatacttcctgttattatctttatcagatagagaaaccagtacccgaaaggtctggtgatatatggctggagtaaatatatgtaaatgtatatataataagtatatatatattaaacataaatacatatgtggatgagcaggcatttggttggaacttctaaggactcatacaatttagtgaaaatgtaaaaacaactttgtaaaatgtgttttggggataatgaatagaagtgtctagatggggctaagggctcccgtgaaggactagtgggattagatgagataatgtacttatgttgaaaagtacttggtcttttttttttaatcctgctttttgcaaaacttttgcacctaaattagtgttatatttatagttgttcatgcttgttgtaaataaaaactggaatgaagtagtaataatgcctagagtagtcctttcttgaggggaagctgagtttctttggatatctgtttactctctatgtcaggcctgcagttgtgtttggacacaccatggttgtaattcatactcttggttttagcaacactttcatatgtagttgtcactacgttgtaattacagcaataaaatccattctttgggaactattccagtgtttagaatgctgaaaataagtgtgcttagtaccagttgtcacaatgatttttccaatgctagaatttctaagaaatcagtgtctattgtacttcaaaacaaaactgatgtctaataaaattctccttttagagatggcagctctttgtagaacctgaaaaaggaaactttaaatcaaaaggaatattaaaaaagccttatgttattctatttagaaatattgaaagggaagaaggaataatcaagtatctcagaaaaaaaaatagcctggaggcttcaggatatactttgccttatttagaaattaagttggttctaacataaacctgagggaggagtagtttgtatgtgtgggattggggtcagcccatttgaccctctgattctttctgttttatataggaaaagctatatggaattctacctaagcctgtttctgtttaattatctatgggtgcactggtctctgctacagagtccacttaggctcaggcataatagcacagactgaagccattgggccaaatctggagagaagctgtgtcactagagtatcagcagagcaggcgacactgtgcttgggtaggcttttaccatgctgttcttcacactggaaattggtcagagtgttgctgtttattagctatacctaggaatttaatgatgtatcctttttctagtgatttaaatggacataattgcaggaaaggttggtaattcagcaagaagattacttagaaaacttttagaattggtttcatgatgctagggacatttctgatttctgtccatggtggcataggacatccatatgaagttgtagctatcacaacatgcatcttttaatctggagactgagaaaatattctgcctggtgtgacaaaatggctatcccaatatagccattttgatatgtgatatggtttggcactgtgttcccactcaagtttcatgtcgaattgtaatttccagtgttggaggaggggcctggtgggaggtgattgaatcatggagcagacttcccccttgctgttcttgtattctcacaagacctggttgttggaaagtgtttggcacctctcggccgggcgcggtggctcacacctgtaatcccagcactttgggaggccgaggcgggtggatcacaaggtcaggagaccaagaccaccctggctaacacagtgaaatcccgtctctactaaaaatacaaaaaaattagccaggcgtggtggcaggtgcctgtagtcccagctactcgggaggctgaggcaggagaatcatttgaacccggggggcgcagattgcagtgagccgagatcgcaccaccgcactccagcctgggcgacagagggagactctgtctcacaaaaaaaaaaaaaaaaaaaaatgtttggcacctcccactttgctgtctctctcctgctccaccatgtaaagattgtgcctgcttccccttcaccttctgccatgattgtaagtttcctgaggcctccctagccgtgcctcctgtacagtccgtggatctgtgagtcaaacctcttttttccataaattacccagtctgtaatacagcataattacatcctaactccccattgccttccagggagtctgtcctggacttcatccctcctctccaaactcttgataaacattattttttgaatatcttcataccatctcaaacacatgtctacagtagaactgagtgtctttctacgaatttgactccttagcttgaaggtttaaagcaaacttgtccaacctgtgactcatggggccacatgcaacgcaggacggctttgaatgaggcccaacacagattcgtaaactgtcttaaaacattatgagatttttttgtgatttttttaagctcatcagctattgttagtgttagtatattttatgtgtggctacactgggccacactggaagaagacaattcttcttcttccagtgtggtgcagggaagccaaaagattggacacccctcttataaaggatactagcaattgcctatttattcagattaagaactgcaaattcttctggacatattctccagaaaaagttcatatatgcagtgctttgcataaaattcaggcttgatgactagtccctcctgaagctaacctgagtatacaacatttaaaaagtagaagcctgactgcgaggatgacatcaaaggcccactgtccagtatttcatgtctgtacactggtggatcactacccttaactagtcttccccttctcaagcctcttgtaagaattctttcctttagcaacagcaatttatttattcgttctctgaaggaggcttgttttcctttctccactccattggtaacacatctcatcccatcccatttagaattcttgctgtagttctttttgcccagtgaccttttccaccctttaaaacccagccatgttacacctcctctaaagttgaaattatgcttcctgttatgttttcatggggacacatttctctacatagggactgaaagttccttaaggacaaggacagtcatttattttactactcaaagtgcatggtatacatatcaagcaaatacttttggttgattttgtatgggtgtgtgggtgtctatctttgtgtgtgggtgtgtttgtacctcaaccctgccgaggtgcccattttgctttcatgtgtggtcttggaagtcttttttatgtaccaatatagactcttttattaacatattattactatgttagttgaaagtgaaaaataattccactgaatattttaacaataaaagcaaaatatgtggtctctttcaaaattagaatattttccctagttagagagttagaataatttaaattttaaaatattttaattggatattaatgtatactaatttattaataaaagaaaatgtgtgtggggtcccacaggattattcctaggataaatagacagtttttttccttaagaatatgccacttaaaaatattagaatacactgaatcccaaatgaggtttatggtacatgatatcatgatttatgggaagagttggatctgaatatatttactgtatattcttatgatacttttataaaaaaattcctccccagagagctagagaataaacataaatggcaagtatgaaaaaccttttaaatattgggaaccagtaaatttttttttttgttttagttgctgctttcctaagagagatactcgatgaaagttgttgaccaaagtacatttttaaatcttgggtggtttaggcaggatttatgcagaagtgattttgtctttagattcttaaaagggttctggagagattttatttgatattaaagctgtgagattgtaaatggagaaaagtcattctgtgtgtatttgacagtcacccatatcctgtcactgacgctgagatggaagcaaactgagtattactcacttcattggctctatggtatttacttaactatattaaacaaacactggggaaacctcaggccctctgatataaaatatgcaaatccttaagcatgacaatttattagaaaaagagaaaaataaagtgtgtccattgacagttctgtgcagaatttaggcaatgactcatacatattttgctgattgtttttgtaataaaaattattcaagagaaaaattaatacatttttattttcataagcagttcattaattatgtgaagaaaaaaattttgtttcatgggtttcttaggcaacaatctgtactttggcttaatgtgacatattagttaaggcattttcctgcatattccaactttaggcctcttaaacctttgctcataaatgttactgttcatcagcctgtcagttagctgtcaagttgtggtgtcagctctcttagactcatcatagtagcccattcttgtattagtactttctacctaagtatttcttaaatgatgactgaattattttaatacacaaatatgaagtgaccatataacttcttttggttcactagagccaaatgcatctcactaaacttttaaaagaaggcaatttccaattccaaaagcatcttctgtcatgtcttcctttgcttttttgacatggaagtataatatttttaagataaggtatctggataatcaatgtattttcatggcttactcaatgaattttgtcactagatgtgactgctataacgtgtctctcttccttcttgtctaaggatgctttctacttctagctataatgtgtctctcttccttcttgtctaaggatgctttctggttctagccaaagaacattctggatttattgttttatttggttttgacatatgttctttcaattaaacacatttaaaaataggagatatacagacatgcataaagcatatatactttaaatagaagctataaattataaaatacatacctctgcacttgtattaccacttccctggtgaagaaatggaatgttgcttgcaccccagaagttctcacgtgccactgctgaaacacttttcccttactgcagaggaaagcactatcctgaatgttgtgattattattcctttcttttctttcctacctaatgtaggactctaaacattcagtttagtttttcgtgttttttgaactgtatatgaatgtactcatacagtgttgtgtctgaatgctttcattcagtgtttgtgagattcatccatgtcattgcgtgaagctgtaggttgttagttttcagttataatcattccctcatattaatatattaaacgtgaattatccactctcttgatgaccatttgtgttgtttctaacctggggctattgtgaacagggttgtgatgaatattctgagacataccagtgtgtacatacattatcttccttaatttatagatgagtggatcatagggttatattcattttccacttcccagataatgagaatagttttgcaagttagttgtgccagttcatatttctattatcagagttctggttcttccacatcctagagtatgtttagtattacagctgctcctttataatggggtcacatcctgataaaccaatggtaagttgaaaatatagtaagtaaacaatgcatttaatacacctaacctacagaacatcatagcttagcctaccttaaacactctatgaacacttacattatcctacagttggacgaaattatctattacaaattctattttataataaagtgttgaatatctaacttaagagtattgaaacacataagaccaacctgggaaaagacaaaaattcaagatacaatttctactgaatgcttattgcttttacaccatcgtaaagtcgaagagttttaagttaaaccactgtaagttggagatcatctgtattagttactgcttttgctatttcaatgggtgttcagtggtatctcattgtagttttaattagcattttctggataaccaataaggttgagttcctttctagatgtttattggtcgtttattcttttctgtaaagtattttgtttgtctttttctattgggttgtctgttgttcatttttgttttttgaggcattccttatattctgcatatctgtcctttgttggatacagttttgttatacatgtattttttttaattttgtgccttgctgcattttatgattggaagtttagtctaaatttctcaatttttttgtatgtggtttataccttttgtcttatttgcatatttttttgacatttcattatttctaattcactgaaaaaatgttggattcaggttaagttgtatgtaataagactggaagaaaaatggccatattgcactgtctctaaagtaccctggagtggtacactgtgatcatatgcaatatccaatagtaatttgaagacatattttagaagtataatttaaatgtttttaagggctgcagttctgagagttttctttaagaagaacagggatagaatatgcaatgggtaattaaattccatatatacatgtgctaaattaagttttttggaggagataagagtgccacaatatgatttaaaagctgcaaaacattaaaaagtacaaataatgtaacagaaaggcagaacatctgttacttaaaggagatattaaactttgagtgctaacacaaatgctatgacataattctagagtctacacattattttgccttattttgagtattatatattatgaatattataaatattatgagtataattatactttttaaaggttaatttttgtgtatatttggagaaggtgactacgcaatagtaagactgatcttattaaatgtgtagaaaattatatatctgtagcttcaaaggagttatttttgaggttatgcaagtatttagaaagtactgctgcttctcaaattttgaatgcagttttggaattacattcatgaccatataaataggtacttaatacattggtttatcatgagaatttaatctcatttctttgtgaccataatctatattttaaaaataaaacttattgaggtataatttacacataataaaatgcataaattttaataccttttgagctttaaaatatgtatatactttcatatccaccattagatgcccactggtggtattccattgttggatatatcacatttcagttgtttccagtttttttgccggtatgaataaaggtgttatgaacattcatggacaagtgtatttttagacatgttttgtttctcttgggtaaatacttagtaattcattatgagttgtgggcaagcatatatttagctttaatatataaagctttaaaatatataaatataaatatatattatatattatattatatataatatatttatatttatatatactataatttatatataatatatattatatatataatatatttataatatatatcatataaataatatatatttataatatatatcatataaataatatatatttataatagatatcatataaataatatatatttataatagatatcatataaataatatatatttataatagatatcatataaataatatatatttataatagatatcatataaataatatatatttataatatatatcatataaataatatatatttataatatatatcatataaataatatatatttataatatatatcatataaataatatatatttataatagatatcatataaataatatatatttataatagatatcatataaataatatatatttataatagatatcatataaataatatatatttataatatatatcatataaataatatatatttataatatatatcatataaataatatataaagctttaaaataagacaattttaaatcattgtctacagttcttgcaccatttcatattcccaccagcaatgtatgggcattctggttggtccacatccttgccaacacttgtgttgtcaagtgatgttgaacatgttatttaaagtgtgtgcttgtatcttttgtccattgtgttttttggtttatttgtcatattattgagttttaagagtctattttttatgtattttgagtactaaccttttgtcacactgttttccaaggagaaattgaaaattgttttaatgatagtgtcattggatgtgtgtgtctactttcttccctgttttgtatgcatgagttctaaaccacccatccccacaaaggagtttccttacatttttactctgtatgtgggtgtgtttggaaagatgagaaagaaacatcattattatgcatggtactggtaaacaacaccaccaccaccacccagacacacaaaaaaatggaacagaatagagagcccagaaatagggctgcacacctacaattatgtgatctttgacaaagctgacaaaaacaagcaatggggaaaaaactccctattcaataaatgctgcttggataactggctagccatatgcagaaaattgaaattggacaccttccttaaaccatatacaaaaattaactcaagatggattaaagacttaaatgtaaaatccaaaactataaaaagctggaagacaacctaggcaatactgctctggacttaggaatgggcaaagagttcatcttggagatgccggaggcaattccgattaaagcaaaaattgacaagtgagatctaattaaacttaaaagcttctgcacagcaaaagaaactatcaacagagtaaacagataacctactgaacaggagaaaatatttgaaaactatgcatctgacaaagggctaatatccagtatatataaggaacttaaatttacaagaaaaaaaacccattaaaaagtggacaaaggacatgaacagacacttttcaaaagaagatatacatgcagcaaacaagcatattaaagctcaatatcactgatcaatagaaaaatgcagaacaaaaccacaatgagataccacctcaaacccatccaaatggctattattaaaaagccaaaaataagatgctagtgaggttgtggaaaaaagggaacacttacacattattggtgggactgtaaactggttcaaccattgtggaagacagtgtggcaattcctcaaagagttaaaaacagaatgaccattcaacccagcaatctcattactgggtgtacacctaaaggaatataaatcattctgccataaagacccatgcatgcaaatgttcattgcagcactattcacaacagcaaagacatggaatcaacctaaatgcccatcaataatagactggataaagaaaatgtggtacatatacatcatggaatattatgcagccataaaaagaaatgagatcatgttctttttaggaacatggatggagtaggaggccattttccttagcaaactaacacaggaacagaaaaccaaatactgcatgttctcacttgtaagtgggagctaaatgatgacaactgtatcagtccattttcacattgctatgaagaactacctgagattgggtaattgatgaagaaaagaggtttagttgactcactgttctgcattcttaacaggaagcatgcctgggaggcctcaggactcttatgatcatggtggaaaatgaagggaaggcaagcatatcttaccatgggggagtgagagagagagagagagagaaggaggaagtgccacacactttcagacaaccagatctcaggataactcacacactatcatgagaacagcaagtgggaagtccacctctatgattcagtcacctcccaccaggtctctcccctgacatgggattacaatttgagatgagatttgggtgaggacccagagccaaaccatattattctgccgctgacccctgccaaatctcatgtccttctcacatttcaaaacacaatcatgccttcccaatagtcccccaaagtcttaactcattctagcattaacccaaaagcccaagtccaaagtctcatcagagacaagacaagtcccttccatctataagcctgtaaaatcaaaagcaagttaagttagttacttccaatacaatgggggtacaggcattgggtagatgctcccattccaaatgggagaaattgacccaaagaaaggggctgttggccccatgcaagtccaaaacccagcagggcactcattatatcttaaagctccaaaataatctccgttaactctgtgtctcacatccagggcacactggtgcaagaggtgagttcccatggccttgggcagctctgcccctgtggctctgcaggatacagccccttttgctgctttcatgggcttgtgttgagtgtctgtgactttcctagacacatggtataagctgtcagtggatctgtcattctggggtgtggaggatggtggcccttttctcatagctccactatgcagtgccccagtggggactgtgtatgggggctccaatcctacatttcttccccacactaccccagtagagattctccatgaggtttctgtccctgcagcagacttctgccttaacatccaggcatttccttacattatctgaaatctaggcagaggctcccaaagctcaccttttgccctctgcacacccacaggccaaacaccatgtggaagctgttaaggcttggggcttgcaccctctgaagctatggcccaagctgtaccttggcctcgcagccatggctggaactggagtggctgggatgtggggcaccatgtcccaaggcagcacagaacatctaggccctggacctggcccatgaaatcatctttccctcctaggcctcaggacctgtgatgggaggggctgctgtgaagatctctgaaatgctctggagacattttccccattgtcttggctattaacattaggctcttctttacttatgcaaatttctgcagctttgaatcacccccacccccgaaaatcagtttttcttttctcccacatggccaggcgcaaattttccgaacttcttgctctgcttcctttttaaacataagttacagtttcaggccatctctttgtgaatgcacacgactgtatgcattaggagcagccaggtcacattgtaaatgctttgctgcttagaaatttcttccaccagatatcctcaatcatctctctcaagttcaaagtttctagggcaggggcaaaacatcaccaatctcttcactaaagcatagcaagggtgaccattaccccagttcagaccacctcagcctggacttcattgtccatatcactagcagcattttggtcaaaaccattcaacaagtatctaggaagttccagactttcccacatcttcctgtctctttctgagccctccaaactgttccaacctctgcctgttaccaagttccaaagttgctttcacattgttaggtatttttgtagcagtgctccactaataccaattttctatattagtccatttttacactgctataaagaactacctgagactgggtaatttatgagcaaaagaggtttaattgactcacagttctgcaggcttaacaaggaagcatgaatgggaggactcagggaacttacaaccatggtggaaggtgacagggatgcaagcacatattaccattgtggatcatgagagagtacaagtgaaaggggaagtgctacacagtttcgaacaaccagatctcctgagaactcactcactatcatgacaatagcaggggaagtctgcccccattattcaatcacctcccaccaggcccctctcccgacacatggggattacaattcaagatgagatttggatggggacacagagccaaaccatatcaaaaactcatggacacaaaaaactcatggacacaacagacactgggatcttcttgaaggtggaggttgggaggaaggagaggatcagaaagaataactattgagtactaggattagtacctgggtgatgaaataatctgtaaatgaaaccccaatgacaccaatttacctacataacaaacgtacacctgtacccctgaacctaaaataaaagttaaaattaaaaaaaaaaaaacctagctattatggaaaaaagaaagtcattgtaaccccttctgttagatatacttttaaaacgttaaagtaacttttcacttgtaaatacaatgtgtttttgataaacacctgtcagagcactgtgttgctatatgtggcatccagactcttagcataacctctcatgatctatggcagctttaggtcagtcttaaaaaaaatgttgaaagggccaggcacagtggctcatgcctgtaatcccagcactttgggaggccgaggtgggtggatcacctgaggtcaggagtttgagaccagcctgaccaacaaggtgaaaccccatctctactaaaaatacaaaaattagccaggcatggtagcgggcgcctgtagtcccagctactagggaggctgagacaggagaattgcttgaacccaggaggcggaggttgcagtgagccaagatcatgccactccagtctgggtgatggagcaagactctgtctcaaaaaaaaaaaaaaaaaaaagaagttgaaatattcattcagcattcaaggggacctgatgtctgagattagtttaacctaatgaagcactggtccttaaatttgggaggaaagtttgagagtctgatgacaacgtacactatttccccagatacaaatgtacatttatgaacatgcatatacataaataattttgcatgcaatcatatgagagtctccagtttaaaaacttctgcaataaaaattcctcttgtgtgtcttcattggctactgcatcttcacgtcttattgtgtggtcctctttatctgtgtctcagcaaggaggtgatgtgaggataatcttgcaaaatgtagagtcttagaaaggtgagcttttgcctgagaccccacttcttggttaacttatggtgagtgtgcctgtgttcatctaatacctttcatataaggaaggcaagatgatttatccaggctgaggggggaaacgaagaaaggatcgtgacaacctaatgcaggttcttgaataaaaggggttagtttctaattttgatgtggaaccataaacatgaggatttattcctagtatcatgggtgaatagttgcttctattcccgtgtattcctcactgagctttcttgagtatcatcacagataactctgttacctggtaatgaagaactctgctggggaagtaaatggaatgtggtgatgttgggtttttctgccattttagctgatttgaggagatagtctttctacagataggaagttctcatgccatgagtgatagggcagtgttttttatatccatatagtggattttagtttttcactggaacatggataatgagaaactgtctctaaaaagtatctctgaagttgagatttttggagggacttcttgagggaagtgttttaccaggaactggaacttcattattggtgataagctcttttcctttggagtttttattttgaagcataatactcacttgaataggaataaattctttattttttgtttatttctgggcacagtgcccaggtttttgttggggcaagtttatcctctaaagaaactttcttaaacagtagatgtttcatagtctctggtggaccgagcagactatccagtacattgagagcaggactctttgagacctcctaaaacaagaggatcttgaaatctactgctgtggaacagcagctccaagggagcaacacttgtctcccccagaaatacttagatttgttgctttaagtcttggttgcacacactgggtgatatctgagagtagaagagaaagctcatgactttagagacatgtcatcatttcattggctgcaagtacacatctcttcctgttgattctccccttagttctatagctaaattccttgtccagttaccaataagtatctctttttggaaaactctgtccatttttaagcaacactcctgcattcaaggctacagattgctcagtgcttcagtcagctgatactgctccctaaagttatgcaatatcccaatatccctgcttgaatttccacatagtagctacattcctttctcttcctcagaatcttgcttctctctgatttactctgcttgtctgttctatataagatgcccccatttgttgcctgcattcctggatgcgttttcctcactgctgttacgcaagtgccaaagtcattctaccttgcaaaagttttaagtgcccttccctaatttagaatgttttctgaaattatacttcattcattactattcaacatgtattaagcatgtttatagtgtattaggaattggggaagtggtcctggaggagatcatgacccaggacatactatgtttagttgtcctatgatgtgataagcgctagctgtgtgaacatgtacaatggagacatagaaatgtgtttaaatctgttgtggaggattaaaggaggtcagcatatatatctgaataacaaccacaaacccagtagcttaagtgataatcatttattgttgcctgcaagtccgtgggtcagctgtgctattcttccagttttgactgtgtttactcatttgtccacggttagccacaggctggaaatttgtctcagctgatcttgtctgggccctttcaggtattttggggtgagaaggttgtaggctggtttagaatagatgcagctaagtagacttatctttggtggcttcttctccagcaggctagtctgggccttttctcatagcaaaggaaatgttctaagaagcaagcagaagtgctcaaggctttttgagatctaggctcagaactggcacactattatttctgcagcattctattggccactgcaaatcacaaagccagccaacattcagagggaatggaaatagacttcaccttttgatgagaagtgctgcagagttgcatggcaaaggctgtagatacatggtgggaaataacttggaccattttttataatcgatctacgattgcacctttaattgataatcagacttcctgaagtagaaaagtcagtagaaggcattgaatacagatatatggaaggtttacatgatagaaaacaaacaaacaaacaaacaaacaaacatgtatgggcagtatgagcaacttaattccaaagttattcctggtatgataacttgttttagtgtcattttccaatctacttcactgtttacagtcttaaagtttaggggtaaggagactattttaggccaattccttataaattaagaaacacctagaaatgttgagagccacccagtccttaaatcacattcttgacagaagtggaactattactatgaactcagatctcctcttttcatggtactcttcataagcactgtccatgtttccagttttacatttttgaaaggtaggcatgtttcatgtgttatttcttaatgtgacctaccttctacattctaaatattttttcacagtatctgtcactgtgggctcatcagaaagacttgtgcaaatagtgagagcaaatgcctaaaccctcatgtaccaccttgtcctcatgttgagattttaataagctttaaatgatttggaatagaagcagctcctgtgttatttcacttttgtctgtgcctttgtgttctaggcacagttgtaatgttctgaagtcacaatctgagccattaagagtaagatcatgatgtctctggatacccagagtgagtgccttggtcttatttgtaattttagaactgctgcttcttggggacctgggtcaagtgattgtattagactttgaagagttctaggccatactgtttgatgcacagattccatcccactgtcgtatcactttcttctcttcacaggaacatagcaagatctggaggagaaagagaggaaactactccagctgtgttctttatcatctcacacttgttcatacttaaccatacattaagaattgtgagctgggcacagtgactcactcctgtaatcccagcactttgggaagccaaggcaggaggatttttgagctcaacctaggtaacatagtgaaacctcatctctaccaaaagaaaacatagctgggtgtggtgttgtgtacctgtggtcccagctacttgggagactgaggtcaaaggattacttgagcccaagatgttgaggctgcagtgagctatgattgcatcattgcactccagcatggatgacagaggtgagaccctgtctaaaaaaaaaattttttttttgattcatatcttaattcctgctagagaaaccaaggcaagatgaagagaactgggactgaattcttagctttatgaaggctgtgtgcttaattattcttaaagcttggcttatacaagccatacgttttcaggtaatcctataaaacaaatgaaagcacaatcatccacatacctatgaatatttgaatattatatttagaacaaatagcaaaatgaattgaaatacttctttacttaattttaaatagtatgtatgatcataatttttctccattacattattttaatgatgtactttagtaaaccatggttgcatgcaagtgaaacttgagattttcaaaatactccttaattcttaaaaaaagtaagaacttttttagtaatatgtatacacatttgatcttcatatattctatagtttatgggtgttcaagtatttactgacactcttagctgcaaagccctgtgctagaagctgtaaatgagatgattgtgacttagacatgatctaagcctatcaggtcaagaaagacaaatgtgcagctattataaaggctctactatggcagataatttttctaattgctagatgacattaattttccattttgcatttgggatatgctagaattttatattttcacctttattcaaagacactttgaagactaaaagttaaaaaaaaaatctatcttattagatccttcaagtcaaactattgcccaagggaacaggtggagtgagttgctttacatagtaagttaggattgagtactaggcatggagttggtttatacattttcttctgtgttcttatagatataaacttttcaccttattggattcttcagcttaaaaaaatacaaaaggattattaactattgcccttaagtgttaaaaacgtctcttggtcttagtaaataagtagcctgaactaaagatcctaggaaagattgtcttcattgtttgcagccatcatgcaagacatatgcctcttgcaaaaattggtgaccattcactttgtcagttacctcaaagctgaggaatgaccgaaggcaaaaagtgtataacctctagaacaggcattcaacaaattattttttttttcttttccaaaccttgtaggacttaacacaggttatttaccatatagatgttgttttcattgctagatttctagaaaatatgtgaaaagctcaaataacttcatttctattgtgtcagcttctaatattaataaaaattttactctagatccaacaaaagtcctaacttttatttccagggtacaatctgctattaccaatgtgtctgagtatttttactctttcataataacctatgccaataaatagtcaagtgtccaatcaatccccatcatcgttgcagacatttaaaagctcatgtagatattaaaatgcattatctcggttccatttctttggaggtctatacagcaaatatctttgtccttgaaaatgtaagtagccaggccagctatcacattgttccaggtgttttagcattccctagctatagtagcagtctagataggctgatctcagaaaatgctaactcctcaatttgcattcttagatgtgttactgctgtactgaatgttatcagatactcttgacctaaagagtaatcaatagcagagattttagttttctaggttggaagaaccttggtaattttgacataattgaacaattgtgttgttttccctaacgttcatctttggcttccagtgatagccccaaagaagtaatttctttctgtattctgaacctgtattttaggtatctggccccattgagagatgcgccaagatattcttgtgtgacacagctagataggctaggggtttctaactcaaccatcaatggagctggacagggaaatcaaattccctgaatgaggtgggctgaatgaaggcaagaaggaatggtgataggtggccaagtggagggtacacaagtgtgtgagttgtgtatatagcatcgtggctcagatccagttgattaccattacactggaatgcaggcccacttttgaaagattacatgtttcccccacatcatcccaagaggagctagtcagattttgatgcagaatttcccacctttaacatactgtgcaactaaagaaaacacttctgtatgtcaggatgtggttggcactgtgatccaggcttccctatccatgaatggtgacatctgagaccattttatcatcatcttaagtactttcatacattatttaacagcagcattgaaataacattaatctgtctttataaacaatggatgctatttacaaaaattatgatacaactacctaggtcaaagccaaggttccttttgatgctaaacataaagttgcaactattactatttacagtaattctagcattaatgccattctctaagattggaagactttgagccaaacttattttcagtctacatggggacctcagaggaaaacacccctacagataattcacctcaacctcagatgtccaggcaagacgaacagaggtgtgaagtgctggttgatagctctcagtgaggcctccagataatgtatttctttttcatctgcttcccttggggaagaagctattccacaaatgtttattgagtatagaaccttctgaattataaattttcatcccttctgttgtgtcccttgctctgaagtttttctccttcaatcaatagtttccatttcaaccatgtttattattgcaattaaccacctccttctaactgctttttgcaatgttttataaaagcaaccaccagatacttccaagtatcctaaagaaaattgtcctcccgactccagccccagctattaaacatttaaaacaaatgaagttatttattgagtacctatagtttgccagggaatatgctaagttgcggggtgtggtggcctatgaaaatataagacatagaaatgtatgatcttttaaaaagttgctaatatactgttctgtcaatactgtctctggaaggagttcagataatgtataataaatcattagtggaccaggccaacatctagttaagcactaatcttggttccaaaaggttacagaagtatatttctgaagtgactcccatactaaattttgatcctttaaagaagttactactcttcctatttggtgatttatcccccctctgtgaaattatttttttgtttttcatttccttttaggaacagaactcattaattgctactaatagcaattgtgtgatgtttttaattcctaaagaaaggtgctatgaaaatctagttgatcttaacatgagtttaattttaaagtattaatgtatagaacatgcagtgtggctttgtgagttatgccaaaaatgaagccattaattcccaagttgagtttaaacccaaattttctttcattgcagtgcctggatacctgtgtattggatgagcagttgagtactgatgctttccccagggagcactgccagtgacttgccctacaagtcaggcctccttttaagtcaggcctagtagtgagcagtgattcttcctagtaacaactgatagattgagggacatttttgaagcactcaattcctcagtttcttttccattatacttttttgttaaattaggaacaggtagtaacccttcctctttccccatctcaaacccaaaagaatgtccccaggaagattacccagtgacattcacagtaaaggtgaataaatgttagtgtgaatccacaaggctggtgttaacggtttttcccttcccctttgcttgtgtttcccacctgctgaataagaatacctgaagaagtgtcaagaagatgctgctgttgaaggccttggagtccccgagatgcaacttactttcccctttaaaatatctaaacaagacatttaatattgaaaccaagtacctcatgaccagaggcagaatgagccacaatattcaggaaccatttcctcatctccatctggaatacagtactctgctataggggttttcaaacttttgttcacaggacctctttgctgtcttaactccttgagaacccaaatgagcttaagtatatgtggcttatatttatcaatattttggattagatattataactaagggattctaaattatttaacaaatttatttaaaaataaacccattacatgttgatgaaataatatatttttatgagaaaataactatcttctaagaacaaaaatctttactgaaaaaagtattgttttacattttcacagatttctttagtgtctgatttaagggaagacagctggattcttatatctccttctgcattcaatctgttgtgcctattttggtttatgtagaaactgggcctcatacaaatatgtagctggaaaagaaaggatcattttaatactcttttcaggtaattttgggtattcttctctaatactgtactaaaacttgacaaatggtagtttcttaaggatttcttacaagggagaaaatgaaacaatatcaatgaactttctgtactgtaaaatacactggtctatcttgcattttgaatggaactgttatccacacgtgattttgtaacatcatacatttgtcccttggaaaatattcatagattgagttatgcagatcttccaaatagtgacagattttattatttgttatcaaaatcattgcatttattaatattaccactgatcttatcagaaaggttcttcagtactgggaagctgtcaagctcatggtggcaaatacaagttggcaaaaattctaattttcctttgaaagctggaattttattattggcaacagatacagtgagttttcattgaagtaatgggcttactttatatattttcaagaaaatctttgccaaataaccagtctggaaaaccatcatctgcctttcagtcattcattcaaataaaaaaatggtgttccatgaaaacagcaggtggttcagcttgcaacataatcacacaagttctttttctttgcagaaccatcatacatcagaagtgcttcatgtgtacttcctattttgtcacatagaatattaaagatacgtaagttcaagggttgaggtttaataacatttataattgttattgcttggttacagaccttgagtgaaactgcctgttgtttatgttttgaactggtactgggtagtggtaaaaaacaaaatgactattcatatagttgggtgcctctgccattattcatgctaagacaccagcagtttgacccgccatcagtccaaatggcaacacagtaaataaggccaataacatgatagaattattatggaaatagctttgaccttttggacttgagacccccaagagtctgtggaccaactttaaaaactgctgttctattacatattttccaaatgcctggtttgcattatcagatttactctcatactgtaaccccattatacttcatcaagaagtggggctatgctacctttcctcccttatccaaacaccaaaactaaccatataggtatctttacatttgccacattttagtaattccttatcccagttcgccatgacgaacatgtagacatgagcttaatccaagctgtaaccatggttactgttttccccaggctggccctacttgttgggccacagctggctcgtacctgctgtcttgcccattgctgcccaccctgccattctcatgtgagctagcctcggcttcctgaggttccctatgaggtatcctgagctctgcatggacacatccttctactgaattttagtgccatgacagtgagaatatcacccgcatcccttagttgcagtgtcagtgcttaaaggtatttgctgaacttacaatcatattgggaaatgtgagtattaaagtcaaaacacttctggaacctaaactcatacctattgtactgatttttaccagataaaggaaatgatgacacttattagttggcttggattttaaaatataaagatcgtattgaaggtagatggataggaggtgaagtatttgaaatgcggcattggacctgggcttacaaactccaggtgtgattcctcctcttaccagctctttcaccttctgtgaggtgagctacctctttgagccttatttttcttgtctgtaggagagtgttaatatttacccgtaagtgttgtagggaagattaatctcgttttgtagatagcagctaccatactgtgtggacatagtagataactattttaaaaatcataatttataaatttggtaattagacatttacagatctgatttcagctgtcatatacggttgcattattatagtgtgaattcatgcccccatgattttaaaaagtggtgtttttggcatgtgtgcattcgctgaagttgtaaaacacattttttaagtgtacaagtaatggacagcagatgagaaacagattgcaaaaactcttttcagtatccaaacatgacagtaaactcatattgttcaaagaatagggcccttaattgggtgggatttttatttgatttatgacctgaggctaatactgtggcttggatatgttctaaccccatgactgtctaatagcttacatatatgttgggtagtaatgccagtggataggttttattctgagaaccttcattcttaactcaaatctcaaaaatagatgacaaggcagaaaatatttggggtgataagattgaatatggaatagagcatcaattgcttgctctcagatactagtcttttttgtttttcaagtaatggagaaaccatatattattttcatctgggagtgtctgttgtgtttgcatgcaccagatgagctggagaagttgtggcctgcaagtaacataaagcaaataaaatttttgccagacggggcataactaaatgcttaccaccctccctgaaagttagttacgttttgatcattggtctgctatattgaatgctgatttttttttccagtttgacatgatagtaagtgacattgcattgtataaaaaggatatttttatttacacacacttaaaaatggatcctgggttttaaggaaatttccttttaagcacattttggctctggtaaaatctattctgaagaacttataggcaaatagcttttgagaatttggactcattagcagggcttatttctttggctatatttcctgataatagttttctgtaagctatgtgaatgtcagagagcagaaatagtcagaatttttcttctgagctcattagtgaatgcatacaggatgaggtagcctgaaacagtttgaggtataatcagtgtcttctcactctctccttttctttcatctcattctttaccatgtttgttgggcattagtttaaaagcctagcatttaataggaactttggcatatgtaaatattttctaggttcagttttagcaaatccgttgctctcatgaagactgtagagaaaatgtttgtactgatttaggaatgttaagaatgtggtggggagtggctcttcagaatactgcagtgtggtaatcatgtttgtggctatgattttcttgtttttgtttttttttttgtctttgttctttcatctcagcttttcaaaatctttagaaaatataagatattcccattttagggtttagaaaatgactcaaatatatgcatatagttgtgaaaggtgttgagatagcctcaaataataagctatatcttttgaccatattataggtggggtctctgcctgggaatgacccaccctcaagctgtttggctcctgttaaaaggactagaagggctctgccagaggaacaaggatgctcttcctggtgtggctcttctgtggcatctggttcagggctgtggtcccactcccaatggcagattttcttattttagagggagtgagtcacattcctcaaccagtggatgaaaaattccagccattccaattatccacgcctatgatcccttctgttttacacagatcattgagtcccaactcactagaccaagactcagggaaatcatgctatgatcttggctgtgccattggccaattttgtgacctcagggagtgtgtaaaatctgggtctcaatttcctcatctgtaaaatgaagtaattagaagaaaggccctttttgatgacacagtctgtgacctctaactggtaatttttataagtattctcacaagaaagctgtggttgcaagaaactagaaattagtgggataaatgagatctaacataggcatcgattagcgtacttcttaccaagttttagagggctccaaggaatatcttgggctgtatatgtgatatagcaaactttaaagagtttgtgactgtgacattgtcctctcacagagtataaagctgttcagtaactatttatggaatgatgaatgagtttgcctgatgcctactggtatgaattttccttcttgaacttactctggtactaaccattctttgtctgaatatgatgatcttttccatgcagcagtcaccagtagtaatggacttgactgcctgtggagcccaggcaatctttataatgatggattgggctctcaagtgggggagtaaagcattttaagttgatgaagacattgcccctgctcttgagaaagaaacaaataagcaactaatcatagaggcaaaatgaaataatagatgtaatcaaaatgtgaacaaggtaatggtgggtgcgatggaataataaattaattctaattggagaactgaggaaggattcatatgtgagatgaagagtcatgaaggttggacctagagagatactctctaatattaaactagagagggaaaaataaaaggtaatttcagcaaaggagaagggctttttggattaaagcagtagtaggactccaaatatgtcactataggaagggcatggaatatttggagaaaagtgagtcgatgtagagaaaccaataggtggctattgctgtagtgagagcaagagatgatggttaacttggcccagagagtagttgtaagagtgaagggaagtgaacagcttgagatagatttagaagataaagtcaatagaatttgtcgatggatatcataaggggggttatagagaggggtatagatgaatcctagaattttggctcacacaagtgggaaactatcaccatttgctatgaaaaaaaaacacctaaggtgtagaatgccatgcactcagttttgggcatgtaggtttaggcatctatgttgagatgtaaggttggagccctcagtaataagtcatggtagaaatgtgtttgggagccatccaggttaaagtcctagcggtagatgagcttactggagagaaaacagagatatggaaaagtagagtcatgtatctaggactgagtgaacattgagggatttggatgtaaaggctgagcagaagatgctgattgacaaaggaaactgagaactggacatatgcattgaatggtgtgaatataagggagacagcttatgtccggatacccatctgggagagaggatgaggaaatgctgagtaggccatggtaaggcaagagaatggcagaaagacttaatcatgggtgttataaaaattacttaggagtggtcttaaaattactggggatatttctctttgattagagttcactaggctggaatcttcataaaagcaggggctgtgttcccttgttcattactgtaactgcagcaagctcagtgcctctgcatagaaatcacccaatacatgatgttggcaaatgctcaaatatttgttttttttaaactcaatttttttaccttaaatatttttttttacctcaaattcctcagatatcatgtgttttccttgactctgaatattacctccatgcatataacttaccaatgtgtatgtcctaggtctgacctctcttctgagttccagtcccagatttttagctgcctgttagacttctttacctggatcacttggaggcatctcacattcaattaaggcaaatactgaacttgactcacattttccaccttcccattctgtcactcatgctttcttctttgttacagatcttataatggactctcttctagtctaattttttgtgtgcatgtgaatgtgtgtgcttgtgtgtgtgagagcctctgccttccatgggggagtcacaaatagtgaaaaaggcagtcacacatagtgagaaaaggcagcgctttcatagaatctttatattcccactatgccttatgctgtgcctttcatgtagtcacactaaataacagtttggtttaaatcagggtttgttaacaagccatataaatttttggactctgccttttagcatgtgaaagacttgtgaagatttcaaagacaaataagaaaaagtatgcctaacgaggtgtatatataaagagagttaaaacattggtgattcttgtatggacagaagaaagcaggggatcatttgataataaacctacatttctgttgtggaaggaggtgtaaataaatgaaaagccttctttcaagtctatgaagtcttatttactgtggaggcattctaatcatttccccaatctgaaaggactgaataagcaggagagagaggagagagttggtctggaaatattttccccatggtgagcatagctctaaaggtcaatggatggactgatgcagtcagctggtgacacttgaatggccttacccagctggcatctgttctgattgattagcgcttctgtgctttagattagaagttattattgaaatatgtgtttggctcactttgaattcttattgactcagttagtttacgtttcatttcaattctagattttccatctctgtttcatacctctgttgtctcatggactgtttaaaaactaatgctttccttgagtaagattctccagaatgtcaggcccagaagttgaatttgactcaacgtttcctgaagattggacttctaaattaacactaaaagtttccgaagatatgttttttagttacgtcatcagcttaatttgtaacccttttcattccaaatacatctctgaggtaagtcttctagcacactgacttttatttacatttaattcggaatattcttagtgctgttaagacacctttttcataaaaaagacaatacattccgtccttatggttggcagagtaacaccatctgaaagatgtctacttcctagtccctagaacatttgtatatgtgatgttacatgacaaatgagaattaaggtaacatatgaaattaagattggtcagtttactttaagctagagagattaacctggtgggctcagtgtaatcacaggggtctttatttgtggaagagggaagcaggagagaaggtcagacttgactggccatttatggttttgaagttggaagggaccaaagagctaaagaatgtgggcaacctcttcagaaggtagaaaaagcaagttaatgaatcctcccttggagcctccagaaaggaattcaggtccactcacatcttgatgttcacctagtaagatccacgcctgacttcaggcctgcagaattagaagataataaatcagtgttattgcagtccactaagttggtaggtaatttgtaaccggagaaataggaaaccagtagaacccttctttatttcagtttggtgatatgaatgtgttgcttcttacattctagataccaggcatttataatttttcctagaagagttagcctatttttactttataggatcaagggcaaccatgtttactttcataaggagtaattttttttacctatacaaaattggataatttgttttgctattgaatgtgattatatccacttttatcaatatataattattatctaagtacattttggcataactcactatatattttatataaagtcacctcttataacttgcataacagtaacccaacatgcttttgagctgtaaaaaggagaatatgttcgaacattcttgtttgaatggtttagtagttacgacattggcattgttaggaatgacaaatagtcatttcctatttggtttatcagggaacactatttccttggttgcaataaatgtccatactgtctattggttttcaacttttggaatcaaattatagagaaagtatggttatcattacagaaaagaatgtaaatatttgcaacttcagtagcataaaagtaaaggtagagccgacagaaatgggaagggaaggggtggaaggtgaggaaaagagtaagggctgccaagtcctcttttactccgaggaatgaagagatgctgttttagatgacagaataaacatagtcatttattaaagataaaggtaaccactaaagggaataaaaatatttgaataactctattaatggaaaggatggaaaagttgggggactctaaattcactaagttcccatgaatgatttcagaaagtcaaaagatgattctgaagttgaacggttgggacagtcagaaatgcttattatttagagaaaaggtgttaaaattcaaaaagactaaaagatctaaaagagttgcctctggagaatacagaactgggccactcttctgtaccatttaattttttaaaatcaaagtaatgcttacacatggtttaaagaagggttggcaaagttatctgtaaagatctagaaagtaaatattttagcctttgcaagccacatgacctctgttgcagctgctcaactctgagtttggctgtgttcccttttatctttatttacaaaagcagtgataggtaggatttggcccatgggtcacagtttgccaattcgtttatagggtcaaatagtgctaaaaggcccatgacaaaaacagtggtccaatggccccctgccgcccaaaccacttctaagaagcagtcactccaaacccttcactctaaaccccacaggttttttctatttttctccataattctaataatgtatgaatcaagggataccagtgtgcttttatgtctaaatatgaatttactgctattccttggttcatcaattttagacattttctgtttacatctgattaaggtagttgaaaatactagctattttatagctataactcaagctatacgtttttttctccttgtttcctaaaattattgttaggctatttggttaaatgcatattcagtgtttttactgttatgagaatgcagctattgttacttttgagcccataactatggttgccttttgtctcgtgcaaacttttggttttactggagttaatgactttatttgcttagttttcattgaatctcatgctttttttccgttctttttaatagttatgtaaaatgtctcttactgcaatcttccactgagttaaaaccatcaaaaatctattgattttggactttttcctaggaacattgctcctggagcccttcttcattgtcctgatcacatcaggattggtttttctctaagccttgcatggttatgttaattgctgtcaccgtttatctgagaattcccttcccatctcttgtgtgttgggtcctctgttccctgggtccctcattttggtggagcacattcgtctaatcacctgtcaggagtgactgggaggagggttgagtgtaagcctggtttttactttgctggcgttggatagagtagcaaggttggcatgtgacccccagtctttagtctgtagccttttacattcagcccttctctgtgcctgatgtcttagagtctggatcttgctctttttcagtttctccagagataatatctcttgcctctcgatgagtgagatggtggggggcacctacctaggagtgttatccttccttaaagaatttgtcaggcagcttttgttcaccattttcagcccccaccttcgtctacttttcatgatacctggggtctccagaccctgtcgaagtagataggcttgtgtttcatgctagctctcttcattggcaggaacttggatttgaccttcttcccctctgagaagtcattacttccttgtctttccttttcctgtctgcatgttgtgatttgagttacagatatctgctacttccatgaagatagagtttatggttttgtttcttaatttccttgtttggggatgattttcagagaaggaatgagattgtcgtaatgactgtaactgtggatgtgtgttagctgataatttttaaaattaaaatatttctgtatctgcagttttcaaaacaataaagatgaaacttattttctttcaccagctaaaataaagacccacagtcatctcagctttggggttatattaatatgtatgcatgaatgaatatattcaaatatatatgtgcatgtatgcaactgatagtgtaatataatcgtcggaaaacttttcctcaacattttgattatttttctataatttttagcatctttctttataaggtgaatttttagcttaatattgtgttgttgtttacttcttacacaattggcattcctgcttggggcttccctcccactgtatttataacttagtagtgtaataatggtataatgatacatcattgtaggcaatactacattgtttttcatgtcttcatctaccttctcattcgcattcctgaagtagataaggtgttacacccaagggaagctgttagcttttattagcaggctattttctgaaaagttttagctaattgtttttggagtttggcttgccttttcccatgtaaagaatatttaaatgaaaatttgtattgtctgcacaggcttttcatatgtcaacattttgattaatgtcaatgaatgtgtcagttaattatgaatcttagctaaggcactggacatgaagggcagatggccagtgtatccagaaattctcaaactgtttgtgatagaggaccagattgttttgtttgttcatctatggcaaacagatacttttataaaatacaaaatcatgtgcatgaatatagcaataaaaattgctataaattttaaaaaatgcttactcccaatttttgtatttttgttgcaaatgaaaaacaaacagtttcatggaatgcattagcctacagactacattttgatccaggcataggaaaaaaattgggaagagcgtttcttcccaaatttttgacgtgtgaaaaacttgcctaccattctggtgcttctctttctgggccttttgctcacttcctgctgattttattctttcccaagcccagagggtctctttgccctcctaactgctcattagcttctagttttgaagaattatgcagagtagtaataatcacaggcgctgtttattgcacatctattgtaagaagagtgcagtgtcagatgctgggattacagtggcatacacatcagaaatggcgctgcctttggaatgtaagagtctgttgtcaagaaagaaaatatatgtatgtatatgtatgcccgtgtatgtgaatgtatgtgaatatgtaatgaatttctcacaatccagtgagggtagaggatattgttcccatttatgagtggtaaattttgaatttcagcctagtcttactttaaagctcatactttttccacgaagcattttggggagtatgctgaattatcctatttatgtggcacatgcccagccaatcctgctgtgctgtacatcagcagtttggaaaaaccatctgagatgcaaataacatgtaagtcccttcttcttcctttctagaagtattttcttttaaaagaaaaggtacctttaaacatatttaatgctgatgtaaaaagtagtagaattttatttcattttgtagagtggaataaaaaatttactcagtgtggtgcaagatactcttggcaagggtagagaggtggttactaccacttggtgtttttgcatctccaccaagtttattcaacctgacaagcgaactagttttcccactctcatataagggttgcttttctgagctttgacttattttacaaatgactgcaatgagacttgccctggggcacagccatttgttagaagacctggctccccacctccagtctgccactgacttgcctcaagtctgtgctcaaatgccactttttcatggaggccgggcctgaccccttatttaaaaatacaaactgcctgtactccccatcctcctcatcctactgtattttatctctcaaattgcttatcacttactaacatatcattaattcacgtatgtattttgtttgttaattattgtcttctcccttcactaaaatttaagctttattccttccaagagctggatttttattctcttttttcttagatgttgcaagaactcaacacatgttgcagaaaggactgccattgacctgcagtctacagtgtttctgcttctcccatgctgcccttgtctatatcaaaagatctaagtctcaagatttgagcttttactcagtatcaataaaatggctttctctgttataccctgagcccgtccccctactttcttactcctttctgtttctcattgtcttcatttgtatgacaaatgcataatgaatgtcagaagtagtgctggggatatggaagtgagtaagataaatgaggtttctgaatcatggtgcttatgttctagttggggcagactaagccataaaattaacaaataattgaataaaataaggataacatgatattgataatttatgatacttccagggaatcagcgttagttaggtcgagaaatttctctctgagtaggggatacttgaggttagctcttcctgctttcttctctgcattctctgtattctttttagctatacctgtgatccctctgcagcattctggaggaatgaagttgttagagaaacgcagctaacagtagcaggtagtattatccccaatcctttttgaagatcagaggcaaataatcccttactattcctattactgccacactgaaaagaagttttataaacagtgtgggaggggggtgggtgttggcgggaggtaggtggttgcagtaaagtggatgaggtctttatgtttgtcttagagttagtttattaaagttaacttattttataaacacggccgccagtacctcttctgcaataaattaaaattctcctttctgtgtcttaatctcttctttgattgatccataaaactgtgttcaagtgaagagctaagggccattattgttacctgtaaaatgctttaaaccttactcagtcattcatatacacaaagatacacacaactggtagacactatctgtcgaaagtattctttggagttagcatacaaagatgccaacgttatagcaccaagaaagtttgaattggagatattaagtaaactgtgagttgtacaaatttgcattctcaaatttattcttattaaaattcattttgtagcagaatgttttttagggctttataatggaagaattattctaaaaattaatagcttgctcttctctttggagagatggctccttccactttttaggtgtaggctttgaattcctctggaccacacaagtttctaaaaccttggcatccagggctttggactataaaatttcattggaaacaaataatggaaaacaggatttttaaaaaatcagctgttttctttaaaattactttgagtcattgtttttcaatattattaaattagtaatggttcagtgttttacgtctttcatactgagaattgtttttaaatggattaaatccatttaatctgcttaagtatatttgcatcaattatgcattaaatatctttaattttttttaatttcagacttttaacgtttaattttcctgatataacttcagttttgtgattatactgtatataaacctgaagagttacataaggcctatactttcatgcatttaagagtgagcctttaactcactcctagagctgtaggaaaatgaaatttctatattcttataaagtcagtgtcttgagatgatgtagacagtacatttggaaataattaaaatttgttctttattaaaaaaaagctctatctagatctggaccttttcttctcaaataaatttagattaatcctaaaatgaaaaatgaacctctaaagccctttatataaagaaaaccgctgagattatagttacttcacaaagctgaatgaaagtgacatgggttaattaacattcctttaaatatttagctgatatatgaactaggaagtgaaatatatgtctcaatacttaaatatttttctatttgaaaaagggaataagtaatattattaaaacttagattatgagatactgtagaaacaaattccctggaattgttggtgcttttatattgcaattattttgtttagaattatacatcagaagaaaacaactattaataccttttctatggcttaacctttgttaagccatactggtttatacataatggtttatactggttccctgtctttaaaataagaggcctattctcggtggtctctgagccaatgaattccttccagtctttgaacttataaatttactagtcaaggcttgaaaattccaagtattttttttggggcggggggtggtaatgaggggaaggtgggaggagaactattttagagtgagaaaacagcctattcaaaaataatgttcaaatcaatataaaattctcaggcttttttttcccccctaccaagagtatttcttttaccttggagatgaaagacctttttcttaaatttgttcataaattaatgaattttcaggctacatggcaagacattggaataacgggtagattggggaattcaaaatatgatgttttgttgaatagactttctgcttggggatgcacagtaacaggggaatcctgcagaattgccgaatctattattcctaccctacagcagagatttcctctttcaagagctcaaagccctaaggatctttgaggttctaggtgctgtaggtctgagagttggaagggatcttcaggatcacagaagttccacgtcttatcctgtagcatccttgagatacggctatctagcctttgcttcactcttgaaagatgtagagagctcatgtttttaccatacatcccattctactctatgattgttttttttttttttttttttggagacagagtcttgctctgtcacccaggctggagtgcagtggtgcaatctcggctcactgcaacctccacctcctggattcaagcaattctcctgcctcagcctcctgagtagctgggattacaggcacgtgccaccacgcccagctaatttttatatttttagtagagacagggtttcaccatgttggtcagggtggtctcaaactcctgacgtcgtgatccacccacctcggcctcccaaagtgctgggattacaggcgtgagccaccgcacccggccaagattgttctttttgaaggatctttcttacgctgagtttctacctctctatcgtctatgtatcatttctagaacagcacagaaaaagccaaatctctcttttatgtggaaggcttttagttggattggagatctcctatggtcatttaactctctgctgttacctctgttgtctcagttctcatgtacttatttacggaggtctaagtgtttaaggtaaaacttttacataaaatatagtctccagtgtaatccagatacttcctctggtgctcaactgaaaagacaatgaatactccaagtctagattaaaaacaggtagcattggccttattcagaggacgtatgttcacttccattgtggtgtctccctaagggatttttaggactaattttaataagtaatttttaccttacctgataactttaagagctcagtgccctgtaaactgtagttctgtctttgaaatagcaaagtgttttcctttttgttctccaatttagacaagcctcaattaattcagctcactcatcataagatgtatttccatctccttaacctttgtggttactgtcacatgggtcatctccagttagttaatgatggtctcttcaaatctgacaaaatactctaaatgtagtgggaccactttggcacagagtgaaacgattccttgttctgttctcacacagtccttgtattatcatagcctaagatggtaataataatatttttagcagactcatcactgttgacttgttaaagcctgtggtcaactaagcatctcctgggcttcttagaaatgttgaataactggtagtcagttagctacatgttctattggtaggataacctggccttcccatcttctgggacttctacactccttttgttttaggatttgtccttattcttctgaggaaactagacttactctgaacagctttttggtggtcttcatttgtttagctgtagagatggcatgtgcaaaaggaacaattaggtatttcagtttgaaaaagtcacatttttggaagcaaagatattattttcatttttatgtaaataccttggaagtatatcacacgtgcagaaaagtacacaagttaagtatagctggtgagacaggagagtccctgactccctcgcaggacttgcgatgaggggtggctcctttgcagccgagctcaaaccgcttgtgggagggggagcacgcaggtgagcaggtgcaggacctggggcaagtgcctttaggtgctggcaggaccaaacccagtaaccgggcccgtggtagcaatcagtggttgcccgcaacttctggagccccagaggttgtgtattacaaacaatgcccttttggttgttgccttcaacagagagctaagccttaaccagctcagtggagagtcagggtgacatataccctgccctcttggtacccgggttcttgtctggcatccaggaagaatcaggtcacacggacttgaaggatgttgaatgcagaggttttattgactgatggaggtggctgtcagtggaaaaggagctagagcggggatggtgcgggaagaaagtagtctttccttgaagcctggctgactccagccgggtcgtctccgaagtcgtgtggtctgacattaagccgcgtctagccttagtctctgatgcgcagttgcttctagtctctgatgcgcagttgcttctcctctcgatgttcagccgcttgtctctctgccagctgagctctgaggtttataggagcacgagatacggaggctgggtgggccaaaaagtagcatttgagctggaaaacggataactgttttcatttagggctgcagattccaggctcgagggtgggttctttgccagggagctgccctcttctatccagtatttccctgcctcctgtcggtatcgctaacatacagatcaagaaatagaacattgccctagaagccgcttcatgcctctttctactcaccacccttccccctcacaaggagtaaccagtctcgtgacttctacattgtgaattaattatgcctctttttgaacttgttatgcatgtaatcatacaaaaggtgcttgttttgtatttggctctttttatgcaatttcatgttgcgagatttactcatgttgtcgcataaacttgtagttttgttcattcttgctgtatagtattccattgcatggacatactgtagtttatacattctactggttacgaatatttgagctatttccagatttttaggtattaaaaataatcctgctatgaatattctgtgtgtcgtttggttaggtatatattcatagcaggatttgatatatacccagatttctgttagatgtatacccagaagtggaattgctgagttatgtgtgatgttcattcagctttatggcatgtttatgttcagttactgccagttttccaaagtgattgtatacatttacacttttacccttagtgtactagaattctagttgctttgtattctcacaatccttaccctaaccccagtcaatttggacaagatcaatatcttcacaatagtgagcttttcaatctatgatagtcttctttaatttttcctaatattttataattttaaatcataaatgttttgcatattttcattagactcattcataagtatttgattttatgctattgtaaatgttacaatttttttttaattttttttaatctttaactggttttctttgtttagttattggtttgccttatttactaagatacttctatactgtgatttggtggtgcctattctcaaatgctttttctgcatccattgtggtgatcatttgatctttatcattttttctatattaatttatgaataacttaggttgatttttgacttttaaataactcttgcatgactgtaataatttccacttggttatcatgtattattccttatagacatcactgaatttgatttacaaatgtttaagatttttacctacatatgtagatttttacctacatatccatgagaaagagagagactgggatattattttcttgtaatatccttgtaaggatattggtatcaaatttatgctatcttttttaaaaaaagctgagagaatttttctctttttctagtctctagaagtatttatataaaagattggcattatttgttccttaaatattaggaagattttacctgtgatgtcatctgagcttggaattttccttttgaagaaacatttggaaggttttgaaacaataaattcaatttaattcttgttgtttttgtattaatcatattttgtatttttactgtccattttgttgtatttttcgaagaattcgttcattttataaaaattgttaaatttataggtccaaggtttttagaatattctcttcagtatctgtaggatctataatggttttgcttgcctttgttccttcctgatattggaaatttattttatttttcttgattggttctgctatgaatttactagttttgtcaagcttttcataaaaccaactttgatttttatttgttgtttttttatttcattgttctttgctctttattttcttcactgtgtctttggatttcattagctgttttttttctagctttttgatcaattttttttacttgttaatatgtgcattaaagaccataactgacacatttggcactgatttacctgcattccacacatttttgctattttaattactagaagtattttctcattgcctttatttttcatctatggatttttcagtactgtatttcctaatttccaaacagctgggcatttttgagatatttttctgtggttgattctactgtgataagagaacatattttaaatgatttcagacctttgaaatttggtacacgttccatgtacacttataaagtatgttctaatcttttcggttacactatttgtgtgtgtgtgtgcaaatataatacaaataagttaggctacatttgttacttgtgtcagtcagatgatttatatcttcttcaattttttgtttcctatcaagtctcccaattcatgtttttaaaatattttttaaagatctgttcattttgacagtatatgtattaaagttatattattgggtacgtacacatttaacattgttatctttctgttagattgagccttttatcatgattgaatatcccactttatctttattaatacttctttccttgaagtctcctttatctgatattaggattagtatggccataccaactttcttttgatagaatcatagatttttagatctggaagtaaatatatgtatggactaattctccctcattttatatgtaattaaaggtttataattctattggacttgctaggtgttactttcaacccagcataaaaactccgggtcccattctagttctgctgaattctttggaaacatactgtagttaattcaaacagcctcagcccatgttcttctactaggcttttctcctgaagtttacacttggttgatctattttaggaaggtgaaggcgtgttctgaagccagttagggctggttcataataaactgtatattcatcactgccttttctggcttgattctttcctttcacgtgtcagtgctgctctgctaggctttgtttgggtgtcattttccaaaactcttgtttttccctgcactgctctgtggctggctactcagaggctcctgttctctgtctgccccaaacagtctgcagacatgctctgtcaccttctccttcctgggtgcattgtggggcatctgattctcatttggtcttgggtagaggggagaatgcccccaggagattattataaaagtaattaagtgttatgtgcaagtacatttttgtaattctctatctaatttctggtgcttcaaactccctctctattcttggcagtaagatctttttccactgtttccaaaacccttaagtctatgattatgaagattatattttgaaggtttccccacttaattctcatttgtgaagcatgggacagacccacttaagcaaagaatttggggccttccattgtcaccccccatgtctctgcattttgacctctatgaggtgcatcatacaaaaggccatccagtctccaggctcactaatgatgatgcacccgaggcccagaataatggcaacttgcctgggtacgtatgcttatgtagggatagaaatggacctgattccctgcctgattccttggtaattgtgctttgtattaagttatttaataacaaaatattttctgtgtttaaaaaaaaatcccaccttggctttgctgcttattcagtgtctgaacttcggaaagttaattcacctaccttggttttctcatctgtaagatggattaactgttttatgaggcattttgaggataaatgagttaatcatacaaaacacatagtacctatagtacctgacctataggtaaaatctcattttgtggatatgtgccaccaaattcatgaagttaaattctataaagaaaattccgttttgtttttaccttccatttgaccattgctgttgtgttccagtaggtaagattcttctagtaaaaacattaagccaccaggaaaccagttgcatggctgagaactgtaattcatgtagcccctctccaaaaatcggcttttcctttgcagcactctccccactttgggacctcgctgccattgcaggctgttttttcttcttggactacaggcatcttgcttgggcccctccaagttttccctttcttgtgtttattggcataatcccagttcatggtagtcacagcattatagtatgtgggttgccagtctactcctttaggtattacaagtggaaaattattgtacttcaaacatggttaatgtaaattttctaatgcataaggtaaaatttcatgtcatctacccatagtgaaggtcttttggtgctattagtattaaagcctatttggaaccatttttacatttgatcattaaaaataactcttcttcctgtaatgcctgtgtttttgttttgctttccttttgcaattcattctcataggctagttttagttttaaaattttagtagcatttaaattaactcttttattttaaaaacagatacaataatgtcaaaagtggagaaaacataattataacattatttttcaataatgatcctaggagtataagtaataagacattgcatagcaaaatgaacacatatattagagatattttcaaaataatttaaaagctatgtgtaccacagttacttgtgcaatataaaggcaagttaagtgtcataatcataaaaatatagtaattttttcccagtgacagtatgaaccagaacacatatgtgaacaccttttcatatctgatcagttttattcctgatggcaataaaaccatgtaaatgaaatgcaaaatgttgactgcaatgtaatggttgaaatttttacatgcattaaagagtcaggataaatttatggtcttacgatggctgtaggttgcatattttgtatgtacatttttgagtgatcaatagcaccatggccaaaataccatggggacaaaaatcacagttggtatgtactgtggtttattgacattttgccccctctcagatgtgtaaaatattaaccctgagactgatttcctatggcttgtctgtttttgttcagggttaggtgtagatatatgcccatcattagcctactcttttcttctttggaatgtataaaatggcaatatcaatgtggaatagggagttcaaattgtagtctttccatattctgacaccatgtttttcacttaaaatttttgggtcaaatacatgtttccaaaatgtatcaagatacttttttacttcatttagttctgagctcttttgaatcaaattagagaacagtgtcttagtttcaactccgtgtcttattttccacaatgtcttggatcccagtgtgcgtgagggaggaatggatgtgatgcggcaaccccatcttgctgccatttgtttgatattccctttgccactgatcaaatcctatctttggctattttttgagttactttattttaaattaggactctttggttttcttctctctgtgtttccacctctaggcaggaaggtgtactttaacttactgcagttgtgaaggatgattatttacctccatcgtaggtgataaaatctgcttttacaaactgaacttgagaaaaaagcagataactgatagatgcctgcttttaagtacaaatatactataaagaaaactctttagaatacattactttttataaacatggttaaaatcaacagatttcatctacagagctaggtaatatatcaaaaaactcaatggaagtttatagaaattaattaaattgaactctttttataagcagactttttacaaggaataaataatacttaatatttccgtcagaagtcctgggtagatttgaagaaatatgttgcttgcggcatggccataacaaaaaagatttaattcccaaatattgctgggggagagctgtattgtccagtggccattacatagttttctctatgctaggatcctccctttttgaaatctggcctattatacttagctcatcttttacagcacaattacttcgggttggcaaagacctctggttaaagaaactgaataatgagagttgtgtgtctttcttacctgattatactcccactgcttatatctttgagatctctatctgtgccacagagtcaggcatttaaagtttcctagtaaatcattggtgtttgcacctataaactcagtattagaagtaaacaaaactccttttattttacttgaaattcaatactgtatggagaacttaattttgaaatgtctaaagcctaactaaggagaattcctttagatttttaaagcctatcactttaccaagttgtattactggaaagctatgtacttgggtcacattttagtagctctccaaatagatgccttaaaaaagtattgtttaatagtatgcccttactgtttattgggggtcagctaaaaagaagactgtatgacaaccatttctattagcttttatgaaattgaaattgaattccgtgggttatattagttcttatccctaataaagatttgtatgggaaaggcttagagctgtatcctagaagaatttccatctttcttttttaacaaactggtatctgttcgtttattggataccaagtgtattatagctcaaaagtttcccactttgaggggctttctaagactcacagaaccaaattgattatagcttggggattatggtaaaaccttactcatgtttttcttcacttcattcattggttcatgttcttgtcccatcgctataatggttcactttcatagctatcctggaaataggcagtacgtaagtaactgaatgagctagattatttaattctaaattctagaatcagagtaagcggtttttaaaagtaagcagttttttaaaaagcgatagttgaacatctctttaattactaccccaactcagtgaattccccattcaactctgaacacagtttgagttgctgccatgctgcaggaaatggcaagcgaggctggagctcctgctctgtgcatcattgcatatctcagagtgaggctgcatgctgaacatggagatttaaacaggtgaagatgttggtggctacccattccatttatatattttgtagtgatagctattaccatcacagattctgcctttagggttttttccctacagctttggaatctgtttggacttttattcctagtttcagaaagtaccctcaagaagatctttcttttccagagtattcttggaattacctgagttgtaggttataaaaattccctgagtatgtttttcaaacagtttatttttgcattgcaatttaccttccaggaaaattgatgaaatatgtataccttgattctccgatttaagttaaacaggataaaaatgccaagtatttttttccaaataaatagataacatttgttttcagtgtttaaaaatttgattactagaacatatttttaacaagttaacttatgtctcttaacattaaaatgtgtttaactttttaacatagattaggtcattaaacttgtgtttgttctactatagggtcctggttactgggtgaagattcatcacttagaatatacagatggaggaatcctggatccagatgatgtcttggcagatgttgttgaagataaagacaaggtagataactctaaaaatgtgcctctttgttttcctctacagagctgcatgttttcaagagactgaaatccttaacaaactcatgtgtcaattattattaaaagataccatctgttcaggtttcacctggacagcccataaatcaaagttcttcatcagatgtttggaaaaactgtgttaaggtttgggaatctgtttgtgttggcctaattagcagacacttcattcccaagagtttctgatatgtcttaataaattagtttcatatgtgaggctgttggaatcatcattgtcgttgctggctctgtagtttattcctggcccttgctaactattcaactaaatgcctgaggcgtgaatgtgtttcaaagtagagaatacaatggggcagcaagttttatgaagaattacagtgaagatttttctgaaagtagctggcaaacaactatcttgagtgatagtcttattttcactgctacagtaaaaggcactaaattgaatactccaaaaagtttgagcgtgttctgccacttatttgggaataatctcgttgcaaatatcttgttttaatgagatttttcttctgagactatacagaggaaggtgtgaaagtatactatttcattgcaatacacacgattattgctgttgagacaggtttaatactacaggtttggctcctgtcatcaatggctaatgtgttttccaaaaccgaactctgtcagagagatctagctttcaaagtttcttctattatacatctttagtgctgtttgtacaaggctaatttatatttggaaacatgtttctctatattttttccctgtaatctcaggggtgtgtatgtgtacatttttgtgttttacctaactggactggaatataaataagtgatttattaaactcaggtgaagtttatatttttctttttccataagatctcttcagactgttcaaacttacattaatctttgcagacatcttatacatttacttttcatattttattttgtaattaaaacctgttttgctttatgttgttattagcgattttatagtctatttagggagataactaactaagttttatagtctatctagggaaataactagctatctagataaacctagttatctccctaaatagattgtaagctcctagtggacatggacttgggagatttttatttgtgtgtttttgttagtagtatctggtataatatcttacacaaacttgattcccaaaaatacttactgaattaatgagtgaaaaagacagctttactttctacacttgactcttgctgtatgtaattttgatatatacttcctgtttatttagttggtctcagggtaaataaaagggtaactaatgtattattaaccttcagaaccctgaagaagggtttttagttctttcaccctgtttcactttctgcttcttccctagggatcatcttcttcctttgaaataatccagatattttaattgtttattaatgtagaaggcagttcctgtcttaaatttcactgatgtccagaacattaaaatgaagggccaaaaaatggcaagtttaggaaggacgagaagaaaatgtcttaccccagcttcatccaatacctcattactagaaggataagtccatgaacagtgcccagggagataatttgtcccatagagctctcacatttagagcattcttttaaactatctcagcaatgcagtttataaccataatccacttactacacacagaaacagctttattatatgtaatctctgttttaatgggactctaccaccattactaaataaggtaaaaaagtgagataatcagttaaaatcctagctgaggattagtactgcttgggttcggctttaacaattctgttaatgtacttcaatatttctacatgatgcctaattggtattgttctgcagagtttatgacaatttatacttttgatgttgctagaaaaaattgtgttgccatttcttcttcttaaaaaatacgtaagtggcacggtggctcatgcctgtaatcctagcactttgggaggctaaggtgggtggatcacgaggtcaggagatcaggatcatcctggctaacacagtgaaaccccatctctactaaaaatacaaaaaaattacacaggagtggtggcatgcacctgtaatcccagctactcaggaggctgaggcacgagaatcaattcaacccaggaggcagaggttgcagtgagccaagatcacaccagtgcaggccagcctgggtgacagagcaagactccatctaaaaaaaaaaaaaaaaaaaggtgaaaaaaagaatttcttatttttctgacaaccttggtaatcttaagatttctttatagtccatatgtctattgtggaaagaaggccctgccaaatttcattttaccttactttttggcagtttagattaagaagtaactataagtgatgctttgtggatgcttaatgacatatcagtctcactcaggatcctttgaggcggtattgagcttagacaaaataacagttcacctgtttgcaaattggctacctaataatctttggcatttaaaatgtggatagagaacaagtccaaagaggcacggatagatgcacataatcattgtgctaaccccaaaatatctcacctcctaggaaagactctcactccaggtgagaagtggcattaaggaactgttggtctattgcagcatatcaggcaggaaaaacagaaacttagaaagcaggggaggctgggccatttagtgtatggtaacaccatcccatacacttcagtaaaggtagaaactagaggttaaatgatattgtacttcaaattagagaaggctctaacaaagttcagccagtgttcttaagaaatgacttttaaaacttgtgcctaaagtggtttgtctgtggtcttacttctattattcctttggccaacatagtgcttggcgcatacatggtatctgcttgggagctttggttttttaaacttgctttcctagtacagcttccacggggaccaagtctccactgtgttacactacttctagcctatatgtgtcaaaatattattggaacagctttggaatattgcatcttatgataactatttgtataaaatgttgtgctgaaacttaataattatctggttgtgacagttattctcaagattcttcagtttgtctatcagtctgatgattcgagttctttgggataaatatctaagaattgtaattttacactcatgtctcctctctggttgctaaaggctaccaacttagttcacccaatagtaacaacctaatcattgatgactagcaatggcccagaatgtctttggcccttatttattctacgttattttaaagcaatcctgaagacaagagctagtgttatccctatttttaatttccagaataatcacagaaattgtaagtaacttgcccaagatcacacaggtagtaaatggcacaatcagactctggaacctagaatttaaatttctgtaatcttatttcttttcttctctgatgtgtcaagcagtttggcgcttgtatctataatttctattacgaaaattcatcagtcataaattaacatgaattttgcttttacgtagtcaccaccattgctaagaaaaggttggtaatagaccaaactgttgagtataacaaaacagttgagtatacaatttatttataaattaattcagaattaatatgccatacatatttaatatatttcaaccctgtttgcctatagcctgcatctagtttattgtaaaggcttgtcagctctacctctgttgctttcttttgcatcctcttttctctaggacccagattatttgatttagatacagtttaatttcagttggacgctttagactgcacttgaagtctaaccaccatatgcaattacaaagaaaaacaagtttgtattacagtaactacttttttgcaccaactatagactgtgctgttttcagtaggcagagtaatggcgcctcaaaaatgtctactccctaatctctacaacctgtgaatatgaatgttacatgacacagcgtctttgcagatgtgcttaaggatcttaaaatggagagattattctggattatttggatggacccaatgtagtcacaagcatccttataaatgaaagaagaaggcaggagagtattagagagataaatgtgagaaagacacacccagccaatgccagctgtgaagatggagaaggtgccaccagcgaagaatgtagctggcctctgacattggaatcagtaagggaatggattctcccctaaagcctccagagagaacacagtcctgctgataccttgattttagcccagtgagacttgtttcagatttcttaactgtcagataataaatttgtgatgttttaagccattgcatttgtggtgacttgctacagcagcaataggacactaatacatacactgcctcttttcccattttaacttttaaagtgatgttagtcttctcaaatttcatattgactgggcattgagatcctgcaggatgagataaatgctttgtacttcagatgggttccttgttctttgccttcctcccaaagtccatcacaaatgatcctcagtttattgggtgagccttcactctttgagacttgatctttaaatatctaattatgctgttatcgtctatagtgtagaaattatttcaaagtcacagacaaacagccttgttcacttatcagtttctcgctgcagtatgtaaaggccctaagaagtctgaagactgatgcttagtaaaccactgcaaagcttaatgcttccttccttttaagtgagcatgagagcttctgagtattaagctttttaaaatgattattttctttggtaattgccattattaatttttggctgggttgaagaagacaactgcaatataacatgaaaacatggcagtctatcacatctattatataaagtcaattactgccatggtttcattaactgtacaaaagtaatactgtattatgtagtaaagtaacatggaaagatgcctctgttcttgactaaattttgcctatcctagggggctagtttggagagatgccagtggttttcagggcttccaagtgaattgcccactggatcacatgtgatatctggtattcaaatgttataatttcagttcagttttatctcctattagttatcagtccttgggcaagcttcttcatctctctggtcttggtttccccatttgtaaaatgaatataatgttcttacagggttggtgtaggaaaactaggtaggtaaactatataaaattttaagtatagtatagcatatactgagaactcaaatgctgttatattaatgatactatggtagtgctattacagtatttttaatgtaggtgttttgatgttaccattagatgtttttaggtatttaaacatcaaataaactattttactgtatattttaactgctttttaaacaaaactgatatgaatgaagttattaaattggtaaaatagttttataagaagatattgaatatgacagaacatttggattaatatattgttattatttgcgaaatgaaaatgccagtatgattaaactggaaatgagaatccttttatcagaacatattatttggtaacataaggagcatttggagatgtaacatgattttaaaatggagactggtttgcgcaatgctgcatgaactagtgacctaaagccaggctctttattcttaagccaaattgctttctgaacactctgttgccctctagtgggtccacagttacctagaaaccagctcacaggagctacttcctgaacaggatgaagtattttgttctactttatttgaaaataatttttgctatgttttttgttacaactcacagactcaggcatggagaataaagccagagtttgcatatatttccctgtgcttttgtgcatcttctagtaagggctaaaggaaattccttgcatttataaaaactcctcttttaaatttatttttaaatttagacttcttcccgcctacctgtttgctggctgaaagattaatggctggtggtgatgaagtgtgtaacttattcagtctgtagttggacaatctatgaagtatattgtgttttctggagaaggagaatgctaaattaagttaaacagcttttttttttttaaaggtcctgatttatttcatttcttagccctcattttatcagtaagatttccatcgcaagctaaagtacctattttaaagccacaattaaaagaaaaacaaatcaggatatgatgtgtttttgtttttccttcaaaaagtcttactttggttcatgggagttgatgttataaaagcacaaaagcacatagaagaagtttggagaaggtttcagaaataaatgcagaagctcctgaagaacaaatgaattaccttggtcatgaaattttagctcagaattttcaagattactctccgcttatagaattacaaaattgtagaatcatggatccaaacaagacctcaacagtcatgtggattaaactcatcatctttcaaaagaggaaatatcctacccaggaagaggttatagaacacgatgtctgtagctgatttagttcctgagtccatttctgcatttcctccctaggatgctgataacatctcatgcagatcaaaactactcagtttgaagttggcttcctccattgacatccttgtttttgttggttagtttcaagttggcttcttccattgacatccttgtttttgttggttaggagcaccttctcctagtctcccagacttgaacttgcagttattttaaaaatttagttatttaataaagccaatttattctttcctttatcctttcccatatgtttgtttttgtctttgaatttccacagctaccaaatttatatccataatatttcaggccaaggttactgtaattgacaagaaattggtcgtcttgtttttagtctcttccttacctgtcagctgtttttgtgcctcgtatgtaggcagaatggttaagatcttggattctggacaaaaaagtcagttcatttcttggccctgttatttgtctagttttgtccaagttgctaaacctctttgtgccttagtttcatcatggataagtggaactaaaaatagtactaattatgtaagttaacacgaagtgttcaggagagcacctggcctgtagtaagtcatcaattgttattgtaattaacacactattaataatgtaaattacattatttaaaaagtattgcttaaatcatattgttccttttagtgtatactgcatcaagtccaaactttgtagccatttagaggcctcacaatgcctccaaactttctctaaacccacttcaaccgcagtggtggcgaaactactgtacgatttattatgtatcatggactttctagctccaaagctttttttcttaatgttccggttgtctgctatatccttgtccctatttcctgcccatcgaagattcagtttatgttgtattttgtattattcaatattagctccatgaggagggggtctttgctttattcactgctgtattcccagtgcctgcagcagtgcctggcatttcctagctgttcaaataattacagtcaatgaatgaacgtatgctttgaggttttgaataagccattcaaccacttgtaactccagtttttccattggtaaaatgagagtgataaatgatatcgttcacatcgtattattgggaaggttgaaaaagtgtgcaggaaaatacaatggaaattacaaagcactatatacgtgtaaaaaatgtatctattcctgctgttcagttcttatgaatttttcaagatcaaggtgaaattgtattttatcccagtcaacatttgtaaatcatctcaatctaaagtaaatcctctgtgctctgaaattttatagaaacgattaagtggtctttttttctttttcaaatgttattggctagtaacatttaccacttaccatctcgaagttcttaagaattttattgtttaactttttaagtcttggtttgtctgtccaggtgtcttgtgtgctgttttaggactgggatgattgtttaaaatattttttagcccatagacttcttacctgtagttcagtgtttcataaacatgtttaattttagttagtgatagagtgggaactagaattgaagatttctaattgactacctttttcttccaccaaactacgttgtctctttgaaatattttattaggagacagtttgtgggcatgtttcaacctcagagaagaattttggaatcaatgcctttgtgaccttactatagctaaggcaaatagtgtcaagagatagtaacttaaactacagtaatcttgatgatggccatgtcagatatgtgccttccgcaatttagttggttgacaactatagtgtgtatgggtgtatgtgtgtatgtacgtatgatgagagaatctgtgcacagatgtatgtatgtggaggagtgtgtacacttgccctgaatttgtttgcttgttgtgtacaattgtgacacacaggtttcatcagaggttggaatgacatgatcaagctctatggtattattaatttagctaagcatttgagtacagtgaagagtaaaccataagaaaatgtttgatatgtgtgtaaaattttaagtttggttggagggaaaaacccaataaaatttgagatcacaataatgctttacttagagctaaaaatgtaattcaaaataagagtcaatgaacactttcatctttacagtatgcctttcaccatatgttacattactggacccagttctaccaattttctctctcacattagcttcttttgaagctatttgtataggcatatctttggcctaggggtatgggaccattatttttttttaatatacatctgtttttttacttatgtaacttacgaattacaatctcattgtaatacctaaaattataccaaatggaagactacttaagctataaaacatcttcttttaaaaatgcaaatgcctgtgagtactagtgtcagtcaccagtacctgtgtgtattgattcagatcgtgctccactaatacctagctgaaatcagcttcactaaagcagtattgtagagtgtcatgtggcagagcacagggcattgacagtttgaatgtaggtttttcttattttaagctgtctcaacctcagttctcatgtttataaagtcagcttttaggaggaggatcaaatgaaatgaaagagtgtgtggtaacattttgaactgtgatgtatcacacaaatatatcacttttattctttcctcgtgtagcagcagccctgaggtatttaagcaaacatttctgcatagcccagaaagggcttgtggtggtatgagaacactgagccaggaacagaggaatgtcagagaggtttggaagggaggaggatggttatgtcaaaaggccactcttctcttcttgccatctagtgaggtgttcaggaaagagttagtgctgagagtatagggagaagtagttttctgaaacaaaaattgcatttttctttaataagtgaatgtgggtggtaagaagggatatcagaacttccaggtacagaccatcaaggaaggtgaaaactaaagtacaaggatagttgttcagaatcttcccaagattccagaaccttgataacgtctgcataggttatcaggtatcatgtttgctgcctatttcttaatgagtaacagcgggttctataaaatgggaggtgggtgctttgaaacaatagggagtatcgggggaggtatctctatcttaggttaggaaaaatctcaagaaataaaatggaaagttgtgagaaaaacagctgaccttccgttaaatcatgacctgaggtctcatgatttaacggaagaaaaaaacggaaacaaaaaacaggtcaacaggacactgctcagtatgggcaaataaccactgaaccttaaacaagcaactatttagttacttgatagtttcaccaagagatatttgctattgagcaatttaatgggagtaaccatataccagactcttaatttactatgctggttctcctatttccaggacctaaactcactttatattattaattagccatattgtgaatccaacaagacgtttttgacttctcttggaatcaaactgatgtttgtcacacttttatgaggtacctgttccaaattctatataaaccgcttgtacttatagatacatttttagtaaataagaatattcagtttccttaagcttaggcttttaagttgtagcgtttgaaagtcctataagtatttaatatcacatttagaaagaaagtgtgttttccctgtcatgtgaatatggaaacttcacttacagaattgcggcaggattactaaacttaatgtttactcttttaactttttaagttatctttttagctttacttcgatgttatgaatcagttttgaaggatcaagtgacattttcttaacaataaagaagaaagcctccttgtgcagactttaaatcaggagtgaaatagcatagaaacatgttcagaaataatgtcttcattaatctcaaccaaaaccatgttacaattgaaatacacatgtttatacaatacttaactacaaacagaccagaaagactacaaaataatatgatttgagattattctaatagcctaacaatcttaaatatgcatatacttgtgtaaaagttgaagaatctcatagttcttaattgataacagggatagaagttgattttctagactgctggctaagtgtggccactgtataccagttcaaaatgaacccattgtggtaaaatgacgtgttctaaatagttcgccttttaaatgggaattttacagagctcttggttgacttacttggaaatggaagtacctagtgttaagactgaggaacctgggactacaattgagaagagagggttcagagggagcctgctaactgtcctcaactatttgagtgatcatagaaaaggtataaattcattccctattgctctaagaaatcgggccagtggtgtttcaagaaaatctttttcagctgaatataatgaacagcttctcaatgaagcacatgctgctttctaacacaggagctcatcttagtcactgagaccgagtatataagcaagagtggggcagacatctgccaggaattcctcttttagttttgcagtttgattagagacttctaaaggccaactgtcagcctctgaggcatgcatttcagtctggaaatacaggattggcctacatagtccgttgtgatacagtgttgtttgctgacctcacatccgttgtcccctttctccctccggttgtgttcagattctctctcccttcaacttgaagcccatatggttcagtgcatgtgactactcacctgcaagggtgaccctgggtggcccttcgtctgttactaatatttggttccctgtgacagtgattactttgggaatggtcgtgtgattcagtttgtgccaaatatgttcaaagagagatttgctgagtccttctgggaaagatcgtttcatcttgtgggagaaattttctccgaattttattttgttgttatgaagtttagatccatggctgccatctagcttccaacaagagaagaaattcaggttccggtaatctaaggaacatggcgtcagagccaatgggttgagtcaactctcaagaccctcctaacttggaacctccaattacacgggccatgtattgccttacatttacgcctgtttccattgcgtttttctgtgactcacagattacggattgtcgttggttaccctgttagagaagcttaggctctattttttgggctcctctttatttccatttgattaggacatatttgtcctaacctctttcagttctatacgtcattaattggaaagttttcagattgttgttcacatttctgccaaattatttagctcctttctttcagaagtttttgaattgtcaatgaaagaattacacatcttaaaatctggaggggtaaaaatgcatattccagttgtttggtttgcatggcttagatttactaggcaagattaacttggaatttttccatttggtgcgaattatatctttttattttaaagtctttgttatccttgattgttgattgggttttttttttctggaagaaataattaatgctatttaacacatctattaagatgtgtttgtcataaacgctcattatttctattattcattacttcaaaaattatgtattgagagccaatattctagtgactgggaaatcagaaggagttctgtctttagcctttttagatacttaaagtataagtggttacgtcaatgcgtggtcttacagagtaacatagaggccatttttccaatggatttctttaaaattgtagcgttcctcctttttattttaagaacttggaagaaacatttgacactaacctcaaaatgtcgcttcaactgggtgcaatcctatttacatcaagaaactggagactatatttaaagcaaacaaatataaaaaagaaaaaccttgggcagtttaagaagtttctcagaactcagagtgaagtataataatcttttaagttattatccaatggcatgagatcataatgtggttaatactccagcttccccttagctgtgaagaagttttgcaattatcagttttcccaaaattatctcaaaaaataatgaagcccttgacctgacatatgactcttttcttctgactctttacccaagttataaagaagtgtctaggtgcccctggtgtagcaagtaaagcctggagactcccagggagccctgggcccctaaatggggcagactggggatatttcttgttcaccgaggaagtggggttgcttacgcttggacactgaaaacacatctgtgatatattcaatgtacttcatgtccaagcaatataaagacagtggtcctttacattgtgacattgaaatcacaatcactcctttctgaagtggctacatggctgtcaaaatcagggttctttaaacaagcttcagaacatgccactcttccctaacaagacagaataatttggtatatttaggaagattggaggttaagcgagtgagattcccggaggatttgtaagaacactgtagaagtgttgggggtgggggagataaatgtgatgagttagaaaaataagtaatttgcagatttagtgtgctgatgatttaaaaagtgctgtaatgaatgttacaataagacaagcaacaaagaataatgtgatagacaatgatacaataatgtttggggaggctccatgtcaaaggcatcaacactcaaactatttacatgactctttcccaaatggaaacttatttcccaaatggaaataaggaagttaagtagttacaatgatttagcataaaaatggatgaaatattttgcatttaacagagaccaatctgagatgaatcttgtattcttatatataatgcatcaaaatatggaatgcagcttctgactggccaagttaattttaaaccttagtattttttatatgtatatacactaacagaaaatgtatcaagttggtctgttccaagaaagtctaggttgaaaacttgtgtatttcctgccacattgatacttgaaataaatattcaaataaaggtggaatattaaaaatcctgcagtactgttctttaaatctttgctgtttgttagaaatcagaagctaaaattgaaaattagatttattgagatgaatacttcaaaggctgttccctggtatcttaattcaatatattgctttcctctttttccaaaacaaatattttcctcttatttaaacaatgttttcttttattcagctatagcatctgatagcctcatgttactgaaagttaacataataatttgggacttagaaactttattttactcctagttataactttattggaaaatttaattttgtacagtgaaaataattatgtctggaatactctgagcaccatttggtcagtagcacaccttatatgaaataaatagatttttaaaaatttgatagtgtcttcatataaggagaggaatatagctctggattgaatttttgacacgcaatcttttattatgacatctagttgattaatacttcagccaaatcagtgttttatagtatctcttcactgtccattggatctggagctacaagcatgcataaaacctgaaatctgctttgtacttcccatcatttactttggggcaatgccagtgtcttgattatagtgtttgaagtctaaatgctttaagaattcatctaaggcaggacaatttttatacatgattttcttattgtatttgagtgacagtgtttaagaatttcttaaggttaaaaggtggtaggacagaatttttgaataagaggcacttttgtttgttttttcctttgttttaaaattgttaaactgttaactgttaaacccaacactactaaaaaagttagtacttgttaaatgtcaaaaaattttaaatatggtaaaataccaagatgaataccaaaatcatctgcaatcacatcaagcaggagtagtcattattaaaagttgggcatataaatttcttttgtatatgtattgaagcataaatatttacatttatactttttcatacaaaattgttttagtaacatacttttctttgacttaacacatttttctatgtatttattctttgaaagatgattttcaatatgtatttggcccatccttgtttgaatggggatttttagctttagcttccttcctttgctttttccttgaacattttgctataattctgataaatactctatttactgtaattaaaatgtaaaagcaagatgtgttttcagtgtaaaaatcctgggatattttaggaaaaggacttttaaccctataaatacagcatagaattcttgtctagagaactaagtaaatgtctatactcatgggacttattgggctggttgcttacctaggtagctgaatattctgatttctggtgtttggaagaaaaatttccatttgttttataggtgattattggtaagttattagctgtagtttgcttttaaaatgtatgtaccttgaaatacacatatgaaaggtttaaaggcaaatctaactttttttaaatctgaaactctattttaagttgagtgttgttttcttctggatttaactgattttcagcattttattaatgccgtagaattctggaagtattcaccaattgaaaagaatgaaaagaaagtatttaacgatgacttctactgaggaagcaattttattttattattttttttttctttttcaacttttagcttcagggggtacatgtacgggtttgttacccgagtatattgcataatgctgagattggagtaccagtgatcctgtcatccaggtactgagcaaggtacccaagagttagcgtttgaaccctttccctttttgctaccttccccctctagaagtccccaatgtctattgttgccatctttatgtccatgagtacgtgttgtttagctcccacttacaagtgaaaacatgccatatttggttttctgttcctgagttaattcacttaggataatggcctccagctgcattcatgttgctgcgaaggacatgattttattcttttttatggctgcgtagtaattctatgggatatatgtaccacattttctttagccaatccaccattgatggacacctgggttgattccatgtctttgctactgtgaatagtgctgctgtgaacatgtgagtttatgtgtctttttggtagaggatttgttttcttttggctatgtacccaatagtgggattgctgggttgaatgttagttctatttgtagttctttgagaaatttccagagtgctttccaaggtggctgaactaatttgcatttccacctacagtgtttaagtgtgctcttttctttgcagcctcaccagcatctgttgctttttgactttttaagccattctgactggtataagatggtatttcattgtggttttaatttgcggttctccagtgattaataatgatgagcattttaaaagtatatttgttggccacttgtatgccttcatttgaaaagtgttcgtgtcttttgcctatttttattttatttttttctttttttgaaggagtattgctctgtcacccaggctggaatacagtggcaggatctcggctcattgcaacctctacctcctgggttcaaatgtttctcctgcctcagcctcacaagtagctgggattacaggcactggccaccatacttggctaattttttgtatttttagtagagatggggttttgccatgttggccaggctggtttcaaactcatgacctcaggtgatctgcctgccttggcctcccaatgtgttaggattacaggcgtgagccaccatgcctggccaatagagttatttgttttttttcttgttcaattgtttaagtgaagaagcacttttaaatgtgaaaactgttattgttgaattataagattgtaattggaatattcttcatgattccaattagaatttactttattgatactttattaattttaggcatagtgctaaaaacattgcttatattatctcatcgattatttaaaattacccagtgagatagacctattatccccattttacaaattggtaaactaaggctcagagaacaggattaagtggtttgcacacttctaaagagccagtacctgattaagccaggactcaaactcagatctgtcagtctccaaagccagagttcttaaccaccatgcttagacacaaaatttggttttccattttcatggtatttttctggaactctactgtccctgcacttgctcatttatgagatgtttgtcccatgaggctgtatccattatgaagtttatgtaaagataaataagatgcttcttgttaaagagatgggaatgggagaggttggatggggcagtcaaaggaagtgacagctagtttatttctgttactttatgctcttgtaaaaatacagaaaagattgtgaatttctttacttttatgaaatgttttaatttctgtagagttgccatgcattattcaagattataaaatgatttgaatttcaggagcagacagattttctgatgaggatttcaagctgtgtaattatgaaacccatataggttaaaagttcagaactcgttagcttaatcattaaaaaataaccaattcataagcatggcatttcattttagaggggtacagttacaatatcatttactaaatgacccttggattctgcttcatgtcccaccacacactgagaatgtacaccacatagtttattctatgttattgtataatttataaagaaaattcatattttatggtagtaaattagatgccacaatgtagggcacatttctataatttttttttaaagttttcttggcaccttaaaaattcaaggaagttaatgagtgccaaatatcaaaaaggttaattagaacctgttacatagtgttgaagtatacatttaggaaatgatttgtcaaatttttccagatatggcataaatgtttcagaataaaatataagaaaatgagtgctcaggtatgaaggaaaatttgtattgtgctaaagtacacctaaaatgtaccatcttcatcatttctaagtatgcagttctgtggcattaagtgcattcacattgttgtataaccagcaccactattcatctccagaacttttcatcataacagtattttttattttgaataaaatcatgcagatattattgagaatatgtttggattcatacagatgcttggaatctttaaaggttttaatgtatcagtatatgtaaagatgaacgttgaaactgtagctcttgttacttcaggtaagacacatgacatccattgatgcaactgaaatctttaccagcttttgaaatactgtcagagtcatgcatattttcttcaggatgaaaggatattgagaggaaaactatattcaaatataaacaatcttcataaagaaccatctgaggtgattaaagataccatgatcatcaaacagttaaaggtggaaaataaaatatggtatttatgagaattttgactggcatgaagattttaatgcatattatcttgctttgctaatcaaggtgattgagatgcacttgcctgttaaatagaacttgctcgtggcttttagttatcagagattttacatttatcttttcttcatttgaatgctacataaaccctcccctttgaatctgagggggccactaatttttttcctagagtgctactcttatatattgagaatattttttcccctaatgcttggagaatgataacaaaaaagaattttttattggttcatttcatgcttggtaagattccaactgtcaaaacattataaaattttgaacctagaggcacatttcatcaccagagtactaattgctgcagagaactggagcgaggcattatgtagtagtatttattagagctgcccaattttaatgttttttggaccagagacacttaaataaaaggttaagctgtttgggcacaaaagaaggaagaaaaactgctcagtgcttgcaacacatcaaatatagtacaggaagggtagaattaattgaaaactgtgcacctactttcactgacactcagcatcttattttcagtgatgagcatggcagatgtaattcttggtttattttcactatgtttagtattgggagccgattatgtgctagggcactggtgatatgagggaaacgtgaaagacaagggtctcccttcatgaagcccatattcttgtggggaaaggagacagtaagcaaagcatcattaataatatagcaagtaatgcttggtaatggctataaagacacacatagtggagtaaaagaacagagagtgagtggttggaggcaaaggcattttaaatcaatcagttaaaggaggctcttctaaggaagtgacatttgagaatagcagtgaatgagggccattcaaaaaattagtcatgtaagaatttaagcatacaaatatctctcacataatttccatagcatgaagtactagaaaataacaaaaataaggacaaaatgaaataaaatgctctattaaacaaatatattaacttctatttaatagatgtctgttaaatatcatctgtcaagccactgactgactagatagtaagctggggaggagaaaagataaaaatgtgtctctgtacttgggaaaactacagttttagtgagtcattgtggtttgcttaagagtaggtgaacaagcagtccaaagcagtgaagtgtgtggaggcagcagcaggtacttaagtttgaccgaacgctagccaagtgcattataaggtgattgttgatgaattgttccttaatctccatccttcttccatctgcaactgatactatgcggtcctttagtgctgatcatatttctgttctaaatacttggtgcacaataggtactcagtaacagttctttgattgggtgaatggatgagtgaatgaagacagaagacaggctttaaacttttttaaagtatggtttagaagaaaaaggagtgtagttttgcatgtctttgcaagggtaaaatttatttcatttttacataagagtaaggagaattgggaggccgaggtgagaggatcatgaggtcaggagatcgagaccatgctggctaacacagtgaaacgctgtctctactaaaaatacaaaaaattagccgggcatggtggcaggtgcctgtagtcccagccactcgggaggctgaggcaggagaatcgcttgaacctaggaggcagaggttgcagtgagctaagatcgcaccactgcactccagcctgggcgacagagtgagactctgtctcaaaaaaaaaaaaagaaaaagaaaaagaaaagggtaaggagaaatccatccagatttgagaagaaaataagggacagtggggagaaaaaagtcaaaatgccagtgacaactgatagaagaagactccagaaaattggatggggtgtggtgaccagcctaggtaggggtttactttgaaaaatatgaaatagcgtttttcttcaaagacaggagaaaaataagtcgagttggacatgaggaaagattttaaggtatagaggagaaaagtctagggtgatgatctcggtcacattttagtggaggtaaaagaaaggccatctgaaataaagagggactggaagtccttgaaaacaaatgagtttcagaattggaaatttttttgatttttaggtaagtagtagatgcatctactacatactaagtaacactcctcatatggtctttggcagtaccctgtaatcatagacattaatatttttctagcaaaacactaatatttatatctggtgaaataatgatgataaatagtttccagtcaatatagtttgtgccaaatgtacaaaaagataagaaaacacgcttggatattggaataatggataagggattgtggacctgtgcaatttgcatggcctgtttttgtttgcaggaatgactgagatgaatgaaattgtttaagatttgaaaagtagcaggatttttttgagcaggggagccaagcagctgctgtgatgtctgatatggcagagtggtttctcagtgaactgcatcagcacattcctgtgtgtttctgtgcactctcctacacatgcatatgtgtgctctaatgcccagcaacctgaatggaaatccagaccacatgaagcccgagtgggactgcaaatttattatggtggtggtactattgtcaggaatttgttccagaggcactgagaagcttaaatggtgagattagcatatgctttaagatccaagggttaagcaagatatggagttgctgatgtttttaggacagttttttgacgaaatcactgttacaactttttggcttctattttatatggatttttttctacataagttgacatagtattgaaacttttcttggtattttatatttttatcacaaaggccaagcagtgtgcctagatatatctagtagatgatggataactaaataaattattgtaactatgaattatagcttgttataaatgatctttcatgactaaataaatgaattattgtgtgtttgtgcatacacacaaacctttgtactgtattttccacacaggattgcaataagccctttttcaatattgttgtggaaattctgtatatgttaaattatgtctgtggagatttgtgttcgttgacttcatacagtctcagtagaatatggtagaagtgctaagcaatgattccttaatattaaaattttaaaaaatagtaatgcagaaaataaaaccatcctatgagtttcatgttttaagcttttaattttaccttgaaaatattccctactgaagattgtggagctctacccagaggcggccacggggagaccctggcatgggagtctggaggggtgaggaggagaccaagagacccctttggagacttcatctcttggtcagtatctccctcatcaaaactcccgacccacagcaggatgaggatagaactcaagggtcaatgtctcagaactgggaggagcaagtactcttctgtgactgagggaacctgtctgactatgtataaataaaatattctaattatagagacagatttttttaattgatttgttttgttttttaatttttttgtagagacagagtctcaccatgttgcccaggctggtctcaactcctagcctccagcgatcctcctgcctcagcctgtcaaagtgcagggattacattgtgcccagctggagacatatttttaatgtgtgtacttgtgtttatgacacacatgatttgtgattatggaagaattaaatatatttcatatagaagaactaatatatgtagcatgaaagcttgcttttgacattacaaattataaacataaacattttggttattagatttcagaaacgatctcctagtattagaaagtagacatagatattcgggttttagaattctttgatcaaatcctgataatagtgaaataatgtaattatatcactttcacctgtacaaaattctcctaaatagtctcagtacttgtaagaactttatatattagtcacatcagataatttaatttccatttttgtttctagggatttacatcctaagtctcatgtaaaattcttctcatagaattgtaccagagtaattttttatgttaaaatgtatcctcaagggcatagtatgttcttttactttttcaatattgtttaaggccagaaaccacaaagtcttttcctggtggcatttttttcaaagctatgatcaagtgtcacctacatagacagtcatttgtatagaaattttaaaatgcctttcttaacagctttaaattgtccacctggactgtggaatgctaaaagatattgttctcagtattttttgggagccaagaacaaattaaaaatcttattctggtggatgggattttctaatttagcatagtacatctcaaatataaaaggctaaaactcagttgaaatataaatgatgtttgggagcaagctacttagggaatgcatgaataatgcttgttgcattccttttattatagtttattcctagattatcttacccttttgaaaaaaaaattccgtttccagaattgtaaggtaaaaatgcttgtatagtcccattaatttgatacaaagttctgatagaagagttcaagaatgtttaggtttgcctttacatcatgtcagtacccaataaaacattctccgcatgatgcagaacgtactgcagtattttatgtgagagaaaacagtaccaagagagaaaacataaatgaaattctgccagactgctgtggaatttctgtgagtttcaggtcaatgtatgtggttccagaattaaattaactcatgtggaaagaaccagccttaagaactttagtatgagcatatgtgtcttttattattctactttattattctcttctcttttatgacctctaggttacaatatcccagtacatactacctttggctctctttgaatgtcagctgctgttgaacacagtggaccatctacctagtaccttgtgaagcagatgacttctccatgatagtgtcatacgtttgatgtgttcagttggggaaatacatgtctatataggttaggccccaattttctggggttcaacactgaggcatcttaaggtaaccaaaatcaggccaacaacaatttccagaccaggaatactgtggtgttataggctacagctttaagggtcatcacactttgcatgctcagaattttaaatttgcctcaggatcaagcatttgctaatagccaaaggattattaactttaaaggactttaaatgtttaagtgattgtgaaataatggttagtgcatttttaaaagttttgtctatttttcacaggctaaagaaatcataattaaatattgtttaaccttctgaggaaaacagggccttttccaaaaacagagaaatataaaattttattagtttcattgactcgtagagttacctgtctatttaatacttctatttcttacgttaaaataagatttcagaaaaattctgtgagaaaagtgatcaggtcttcttccttcttttcttaaattgaccttaaatggttaggttaaggtagcatatatttgggaagacattgtcctgctggaaagacatttaattcaagctcttgcaggtcaagccttaggataatagaaatctgtcatctaagcccctggttgactggcacatactgcctaagaaatgccgtttccatatattctgaatggagggaaaaaaggttacgaaacagatctccagaacatgcagtgatcccttgatgtctgttaaagtacgtttaaattctttgccctgggaggaaattgttagactaatatgtatgttgagatatttgataggtttttaagagctggacttgcagtcatttgaagaaatgtgaggcatgctcatgtggtagaagtttagacaggggctcaaagtcttgggcactcattggggctgtgtccaccgattactgactggctgatttggatgggggttctctgtctccctggttctcccttttctccttcatattctctaaagagttgcacctgcttcattgattctcaattactgatttgaagagtgattccattagaagagtctaggaaacttacatagattcttgtcctatcctctgtgttggggtcctggaatctgtatggcgtcctgtgctgttttatttatttactgttatgtagtttttgtcttctctctaattgctgtcactgacacaagtgaaagctcttaagctgaaaagtaatagcagtccttcaagctctgaactgctggtctaaaaattctagcccagaggatgttgaaaccagacctaatagtgatattgatgatgaagaaggtgagtaaaggagttttgtttggaagtccctttaatcagtgcctttgtagaattaagcaaatcatttctctaaatttttaaatttaatattgatgttgtggccattattaccttgttatagcttaaccagtttaatgtattcatagttctcaagatttcctttaagactaaaaattaaattatagcatattttgtatgttctgataactggacttaaacaattacttgttttatagtattgagacagccacttaagacctttgattttcctcttctccccatatttctagaatactgacactgcttgttttacaacaaactttatgaagaaaaatgaaatgactgagagctttaaacaagactctagattgatttttattgcctttttaatagttcattgtgtatatgtaaattacatattaaatgtatgaacagataataaagtttttctaatgaaggtgatattaatatctaacagctactaataggtaggtaataggtatatgtgatctctgtgttatgtcttacaactgcatattgtctcaattatccaaaaataaaaaattaagttatatatcttttttcttttttctttttttttcagacagagtcttgctctgtcacccagactggagcacagtggcacgatcttggctcactgcaacctctgcctcccaggttcaagtgtttctcctgcctcagcctcctgagtagctgggaccacaggcatgcaccaccatgcccagctaatatttttctattttcagtagagatggggtttcgccatgttgaccaggctggtctcgaactcctgacttcaattgatctacccacctcggcctcccaaagtgctgggattacagacgtgagccattgtaccccgccaactattcttacctccattttacaagtgggaaaacaaatgtgcagaaaggtgaagtaacttccatgtttctgtagttggaaatggaagaattgggatttaatccaaggcagtctgactttggaatccaggcatgtagcactagtgttttgaaaatgtagaccaaatctctaaacttttgtttggtaggaaaatcaatactccttgatccctgatatatgatgaatttacactgtataacaaatagtctttatcatttcacagagggcatttatatcataccatttatgaagggagtttatatcatatattcccaagttatgttatgaaagaaaatgattaacaaaaatctttaatggtttgtgtactctgcgaagaaagtttgaacattatggtttaaaaattgtgttaggactttactgcttcatcagagcttaccatttccaggaacaggttagacattctgacattgttaaaattaaataggctggccgcagtggctcacacctgtaatcccagcactttaggagactgagacaggtggatcacaagattaggagtttgagaccagcctggccagtatggtgaaaccccatctctactaaaaatacaaaaattatccgggtgtggtggcaggccaggcctataatcccagctactcgggtagctgaggcaggagaatagcttgaacccgggaggcagaggttgcaatgagcggagatcacgccactgcactttagcctgggtgacagagcaagaccccatctcaaaaaaaaaaaaacaaaaaaaaaagtgaacaacaaaaaattgtttttcctttttattagcaatataatccatgtaaaagagtaactaatatgattgatagataaagcaatcaaagaaaaatcatgtatcatgtacttactacccagcttaaaaaatagagtaataccttttaaatttctatgtgctgccctccagtcatagtaatcttcctcccaccccaataagtttatcattacaccaattggtattatagaatattccatatgtatatatccctaaataatgaattgtcgagttttatatggtttaggcccctgtgtgttgtgttattgtatgcattcttctgtgatttgcttttttcagtcaatttatttttggattcatccacattcatgcacgtaagtttggcttattaatttcactgctgtagagtgtttctaatgtgactgtatttgaacttattaatcctgatttttgcttcttcctgttgaaggacattgggctgtatatgattttttctgttgctttattcttcaacacgcatgttttgccccttgcaacacatgggcaagaatgtatatctaggctagaagcataggaggctatttactggaataaatactttttgagataagtatttttataatttacaagatgatgccaacttgttttccaaatccagtgtgccagtgtgaatgttcttaatgccgcaaaaccgtatactgaaaaaatggtaaattttatggtatgtccatttcatcccaataaaaaaataggtttattgggataaaatagacgtaccataaaatttaccattttttaagtatgcagttttgtggcattaagaacattcacattgttatgtaaccgtcgccaccatttatctccagaacttttttcattttctccaactcaagctctgtgcccattaaacactagtttcctgtttcccctcttcccatcagaccctggaaaccaccattctcctttttgtgtctttgaatttggctattctaagtacctcatataagtggaattatatgatgttcacctttgtggatctggcttattttacttagtatgtcaaggtttatccatgttgtagcatgtgccaggattctccacccccctttatataaggctgaataatagtcctctctctatatatacacattttgtctacccattcatttatcaatgttgttcaagggttgccttgtgttttttttctgcccagccctggaatcagtcagttccccaagaagttcttgttcctttgattggagaatggtatttggaaaggtctagatggtagttgtgctctgaactgctggtttattattgttgataggctctgtcagtgtacagaggtaggaaatatatgtatgtttattaacacatatatgtatgcacatttatatttatttttaaacccacccttctgtatatctgttaaaatccataggtcatacctgtatctgtgattcttgtcctgtactacagggttaatcttagctttccttctctccttatttatagctctgtatttctgagaatggaaatgaggctgtcattatccacaatagatattttcccatttgtatatgtatataatacagtttcagatttgctaacctgtaaccctgcaaaataacatttactaactacagcatttgtgtacattagtactctttttcacacataacccttttccttattagaccaaaaaatccaaactctcttaaatatcatgaatttcatgttcttgtttccttgtttattttttctgtgtttttttaaatcacagatttaagatctgcccattcagagatttagttattatatatgagccaatgaatactttactttgcctacattagtttcagtttctgtcacttgtaaccagactgtcctgacacaaaagcacagtgtgactggtcagtcgtttcttcctttccacaaagaaagaaggaggaacatcttctgccttaaggaaattatttccaaagaggaaaaccagatacagcgagaatatgcacataagtactccagattatttgagaacaccttattctaatgtctacttatctctatgatatcaaatcatatgaaattaaagctctgataacttcattcctcactataatttacaaacacacccagaatgaacccatggcaagtcatcagtatctactacctaatcactttgcttgtggattcactattcactttccaatttgacaatatgttatagtgaggtgctataattttcattttaagctatacaacagaaatgatattacatttaatggctgaatggctttcatgttacaattagaggtatcctaagcaataagagttgacaaattatcctttaaaaacaaattgcaggacactcacaaagatagcttttgaaaggcttaccaataaggcatccttgaagtgaatatagagtatactttactaatctctatgaaactgtttgtattgaggttgtagttgcttttgaaaggggagtgttctttagaaatccttgtgttcagaagtcaaaggtgaagaagtatttctaagaaaataaaatgattaaaatagtagttattacccaatcacttttaaaatttaatatgggatccctgtgcctaatgaagactgtatttaatctcagtaaagtttacttccctgtgattctgacaaattttaagagcaaaattctttttaaaatgtattcttgaaaaccattcatttttgtagtgggtggattctttttcctgtagatttcaccagacaagaatttgtattttcattagaaaagtctgctcttcaggctatttcagtttattcaacttttttctaaagcagatgctgtttttctttttttttttttttctgctgctgttgactatgcaactgagtgtttctggcacttgatcagttaaaacgtaaatcgtaagccaaactactttcttttgtgaccaaacttatgtgtaaaacatatgagaaggctttagtcatattcctctgtttgaaatttgcaaggagtcttagagaagatcttctatagaagagaaaagtttgggggctgcttggctctttgcagcctaattgaggcatctgcttactgctgacctttcacatatgcttctttctccctttactgccagttatactcccgtacatcttctgtgaatctgccctggtcaacgtcccatcctttgagctgccattctacattgctttttcttaaattcaatgtgtcatctagttttttaattatctctctgctccgtgaaaccagcactcctcagtttgaactgtcactcgcctggcacacagattcataggcctcaaccctgatgtactcaaataagaccatgggtttacattattgacaaatgctgcagaaaactcttacgcatgctgttatttgaacagtactcagccaatgagtactttaaatgtaggaactaattattaattgcatttgtatctcagcagagcatttattagaagttcaataaatgcttattgaataaatatcaagatattgagctctttactatccctaagagatagtaatagtctccagtctggttgctattggtccacttacatctggtatggagttaacagtgtagtgccttgctactcagagtgtgggccacagatcagcaacatgagcatcacccagaaatgaagagtcttgggccccactctggacctaccaaatcagaatctgcattgtaacaataaccctagcgatttgtatatacatgaaaatttgaaaaacactggcttagggggccagagttatactgccatcttggaatgtagtgagggagattttaatccgttagacaaggagtgactcttcaatgagaacatggatctttgagcactaaaggatgtacttggggaagacagtggaaatggactgtatgtaaaattattgagttgatgcaaaagcagttgctgtttttgctattaaaagtaatggcaaaaacagcaactgctttttttttttttttttgagacggagtcttgctctgtcgcccaggctggagtacagtggcgcgatctcggctcactgcaagttccgcctcctgggttcacgccattctcctgcctcatcctcctgagtagctgggaccacaggcgcccgccaccacgcctggctaattttttgtatttttagtagagatggggtttcaccatgttagccaggatggtttcaatctcctgacctcgtgatctgcctgcgtcggcctcccaaattggtgggattacaggcgtgagccaccgcacccggcccagcaactgcttttgcactaacctaataacgtgctgtggaagaagcgtgtatgggtaaggttttctgatgtctttaggttgatgtagtttggagtggggtacttgggagaaatttcatccattcatatttcccttcaggatttgctgcaatggactgtgcacctcattcccttaattatcgcagaatgaaccagttagtcgtgatgataggctaaataaagtgatctaagatttagaagcatgaagcataagtacctttgtgtaaaacccaaatattatttaactctttaggaaatagatttagagaaacctgagacttgggtactcagatctaagaattttggcttaatattaaaatatttttaactcttttaagtccaagaatatgcttttatgaataattaattaaaaattgttaatgaccctcataggctttttctcctaattgaatccacttgcaaatgctaggtaagaaaatgccatttgagtctttccattttcccacctttttaaaactctcatcctgtttttccccatgttatccctgtcacgtgaacaagtgacagtttttttccttttgatggtatttcagctagtttaggtgtctggtggagttggtggtggcctggagagaagattggaattgtttaggggctagagaatgagcagttggacagaaatccaaaggaatgatgaacattatagaatgagcagtgagaactgcagtgagagccacggtcatctctatgtcaaataaaggcaggtggctgggtagtcacagagccaaattgggaactagacaaagaacctgagggtgatggaagtatctggagagatggccaggatgtgacgtggaagaggtggcatctgtgccttggatgactggcacagcagtagcacagatgtggctgcttgtcagtcactgacaaccagggaagggatagcttcagctcaataggttcgttctcagtttgtatgctccatggccatagtgattgacatttgtgatgacagttctgctgaatcacctcagaccaaatttacatatattacatgtcttttaaggttatgtgaatgttccaattatggctcttttggtttcaaggaacagagtctcacacactagttttattttagagaacccgaggggagaaaggcacgtatcatgagaaatgaaagcaggaagggaaaaattgtcaggacctgaagaaattaatgtctcagcatttgtgttatctttttttttctatttctttggtcgtgggggatgggaggagtgtctatatgctttctctctctcattttgtgtctcttccctcctccccatgatgcattttttcttactgcattagtctgttctcacatggctataaataatacttgagactgggtaatttataaagaaaggaggtttaattcactcacagttctgcatggctggggaggcctcatgaatcttacaatcatggcggaaggggaagcaggtaccttcttcacaaggtggcaggagagaggagacagcaggggaaaccaccgcttacaaaaccatcagattttgtgagaactcattatcgtgagaacagcataggggaaaccacccccatgatccagtcacctcctgtcagggcccttccttgacatgtggggattacaatttgagatgaggtttgggtggggacacagagccaaaccatgtcactgactttgcatgtgacctccatcctcaacattgttatgacttattagattcaacatcaaccattgcctagcagtagtctcttgggtcttgggtcagattcgcagggagcaagagtaccagctttctttagtttatctctgtaagccaagccaaacaagcccttggctgcctttgagatatgtgtatccctgagcaatcagttgtgttgagtttgaggccagtcacatgacatgtaaccctggttccttcagaaactgaaaatgagtcaggtaataacacatatatgtatcgttgcattttaatcatgattactcctgacatatttaatcaaatttgtacagttctgcctcgtttcaggacacattggtgggatttacaaccaggaataaaatacacattgggagaagttatgatccagtggagagataacagttaattaaccaaaacagataattttctaatagttttgaaaagagtatgttcatagttgtttttcatactattgaacttcattcttaatatatggcttcattttgttaaagacggggcttctaacaaaacttttcgaaagcacatcttgtggattactttaatggaaagtattttgttataatagtcttaatggaataattatttcacagccagcaaggctaacggagactatttgtagattgaggtatgttttcaaagcctagtggattagcaaacagttgaggaattagggccaaatgccttcaaatgcttgtctcttcatttttaaaattaaagttgatatttgaatagacagaaaatttaagtaatgaaaatctttgatcatcttaatagcagatatctttaaactataaattaactgctaatttaattcactgtaatgctatgtgaagtgagtgtctttatttaaaaacttgtaattttgctgaaaatatgctgattcttaaccacatgtaaccttctggttatttcattttgccttttcacatagttcttgcatgttaccaaactttggttttccttgaaatattttaatgtattatgttacattacactataacaataactgaaaagaaacaagaagtattattactgatttaattgtctttttttataaccttgaatttcatcatgatatgtaaattaatttttaatgtgccactgaattaggtaaataatacctttcacagaagataagttaaattataggaaataaataatcatttgaaactttgaatacttaaaaacaacaggtaaatcgaactatttaaatactattctatagttgtgagtaaatctcaggaagaatgtatccattcatatcctctctccctgaattttgtgttgagtaagagttttgcttaagcttttgcctcttgaaattactcctttttttgaggtttctttgtatgtgtctgtaaagaggcacatgacattgctgtctttatggcatttttttgtgaaggtctaatgagaatatagtcaactctgttatttagcagtagattagttggtgtttggattaattatactaaaataataatagacattttactcttacagttttaaatactgcgagccagcagaaatgatccatatactgaataacatctcgtttggagttgcttggtaacggatagaagctacattaggtctgttgccacgtgagaatccttggtgcttttgccagtccatgatgtagcttttgtagtcatggccatgaactgcgtttttgtgtgtggtctgtacaaatttaaacagtaacatggtttgggtcttttaaaatgtaaatgtgataaaatagacccaacttaaaatattggaatctaagtgaaaactgcatattgcttaacattcaaagaagttatcagtcaactgggaaaagtataccattaaacaatttccattgtaatatgaaaaagaaatcagatggctgatggttgaaaaagaaaggataaattgatgtcttttgtatctcattgagatcttgaagcagaagacaaaagcaaaagggaaaagttaaacttgaaaaaaacattgtctacttttgatcagacaatgcaggtttggtactgtcagcaggtgattggtgtaagaaccttagttgccatccggtacctgttatatcaggttatgtgtccagctgctttaacagaggccaaataatagtggcttcaacaagatggaatgtttatttctttctcatgcggaagtttcagctgaaggtagtttgggggtggaaaccaagcatcttgcgctcagatgttcttttcatcactctaccatgctttagcagtaaccctgtctatatactagattaatataagaagtgtcaaatgagattcatataaggaacataaaaaaaagactcttgggtgccaccccagattaaattataatctgagaatgagtactactccagacctactgaatcagaatctgtggtcataacttagtcatgagatctcacctcgctgcaaagcagggtggggaaaggtagtctgtaagctgcaggcaagtatacagctaaaacttggttggttttattaccaaaaagaagttagaataaatattgagggagacaataagtagttttctacctgtgaattagagtttaagacactcagcagtaataattatttacggcacttggtagtgaagagaggacagtggtggaatatgaagctggttaacatacataaaatgggaactacctacaggaggcacatactcccccctgtaagagtctaggaggtgactcaggctagtgaaaaagggccagtcgtttcagaggctggaggggctcttttaaagtggcatctctagtagttgttgccatgtaggaaagtggactaaagttttatagattcagttagaaatctacatttttatgaaaatgtgagcccaatttaacatatctttaaattagatatagattaagagccatttatttctcatttttgacctgaatgttatggcacaatatttcgatggcaaagacagcatttttcgtggtgtcaaactatttttcatgcaaattcattatatttaaaaatatttttgaaaagaaacttgataaaaatggcaaaggtattttagtagtcagtatccttttggccatttctagtaaattatgtgattcctttgtattcctaagttattatatttgaattgattttacatttttgggtgatacttgtagaactctaattttgaatgaacttttaattcaataagtatgcatttcttgaccacttttaacagtgattttgtgttctttgtgaccctctatctccagtttattaagaactacctctgcatgcagaggcactttgtaaactgtaagaaactctaatgatattttagtgccttgccactgtgtctggcacaaaaacacccaatgaataagtggtgaaaaaatgatacctctgttagataatcattaatgtttacatcctatgacaaggtgtctatagatttcaattatactaaaatcagtaggataccacaaatcaaaaatattttcttcatcattcttttctccattttacaaacaaaagagattgaaataaactttgtatctattgacaaataattggatcctgtagattgagttaattacttgttagaaaattacctcttctgcttcattggtcaagatgttctatgaagtagaatttgttttgactttctaatggcataacaataaatgtctaacaatgtctttcttgtatcttgggactagtttatctcatcatatctggctgacaaatgctttggcagtgacagtgtcttggatgacagtgctgttggattagattggctaacttctacagtttaaattaaaaccaggaccctgaaatgcttctcggaataatcatgttggttaccatgcccattgctcaatttttttccttttgttgaaggcagctctattagcatcttgtctatacatttcttgactagcgagaagagatacgaggctttagggctgacgtaaactctcatcggttggacaggtatcatgctctttttcatttatcaattccaggaaatactgggtttggtccttgttaataaggaaggagaaataccaagactttcgtgagtacttaaaattcacaagttatgaagtttacaatgcgttagttctgtggagctctggtgggggcatcttctgaatatgggcaggacactgtcctgcagctccctggttatttgaaaagggatgaaggctatgctgtctggctctcacttccaccttctgactcccactctttccctctgctgaaaatggtgagtcaaggccagctggcaaaaattagcatagaatggggtattgtttcatcaaaatttggcaattggggagtaatttttataaatattgacacttttgttatctctgggaggtgattggttgatattctatgtatagccatttggccacttcttaatatagaagaaaatatttcctgagtcacctttcttaattttctcaaaataattaccttgaattgttatagatccatcttttcatgccaacacaaacttttagatgctgttgagtatgtttttaacaaagtataagtagattggttttaagttgacttagccattgttaatgattcagttgattttttaaaattaagaatgcattaaaaatgaaattgatacatttatggagaattcataaacgattcaaatcaattactttatagacataatacatatattttgtatgtttttgtaatttttgggaaaaaattagcttaattatgtttctgagtaagctaaagacattcaactgtattctttcaaatttgccaaagaacaaaaagtaagattttgtcatttggtttattggatttttcattattcactatgataacagtccaaaaacaagaatcaatttcttaatgctttattatatgttttgaagggagttcctttgttctgtgtttaccttacagaacctcagagtttaaagccacattctgtttttaagggaaagcaagtcttgtcagtttttataattgcaaataggataggaaatcatgaatggatgaaaagtgtagtgtgataagtcattcactagaaggggagttgaggcagtgaggggcaggatgatggagtgataaagttcatagtaattataggagaaagtgagtataatggcaataaattgaaaattgaccaagtaagatatttgaggaaagccagcatattgtgatcaacatgctggtgtaacctaattacttatataacctgaaagtaaattccaaatttcttctggcaagaaatagtgattttttttcctatgcaagtaataaatttgctgatttgagttcttatacaccttctgggcataacacaagaacatgaaaaatgttattcttcaaattactgaccttatggctaatgcctttccttaatgctagtctcattatattctattcttggtcagaaattccatatgcacagctttcattggaatccttagcattacttttgatattccaaagcacttttcttaatattctcttgccattcaccttaaaaaagcagtagatatagttggttttgttaagaaaagtttcattggcaatcatttatatttctcaagtattgttgctaatcaaaatcctaatatttagcctctctttagcattttagtttgcctttttcttagaagatactagcaaataatatagtgtttcaaagtcacaatgtcttcaaatcttacggttgattcagactgaaatcttttatggattttatgccccacctggagcagtactcagtaatgtattcacagcaaggatgtactctaaaattaattatttgtgtcattcatctaggtattccctcactaataaattattgctttcttattcagtataaatttgcttttcactgttttgggtgacctcggtcatcagtgggtagttaaaaattctcttccaggaattccctctgattatctacaacattttgggctgaataataggtgtgctgcataacttggagaggtgaccctttgatattcagtttattaattatttatggagtgactatggaagtggagtagtaggagataccaaatagtagaaaatactgtccttgctttcaaggagttcatgatcgtattatagagacaaggtatacttgaaagtctaattatgttgctgaaaaagtaatagaggccatatatgtcatcgaatagtggggggcgggggtgggtagggggaagacaggatggctgtgggttagcatgagaggagaagaagtgatagagaactagaactgatccagtctatttgcagttgttagaatttgactgggccgctaggcagggcaagaagtggaaaatagggaagcggcttaatgtcatgaataaaaacagagtaagagactcactggtgtgatagaaatttctactttgaattatagtggagaacaagtttaaaaatagtagaggagattgaatttgaggaaagacaaatctagattttttttccaggagattttcctcttttgtttgaattatggttatttgaataatccatttcaaaataccacttaatcagacagtagagggaactatttatatgacgtaaaaggtagtttggcagacatgattaaggagaatgttagagaataagatatcaacatggaaagagatgtgatcttttttaatctggaaaaagcaagacaaattgctttgaacatgtaggtgaaaacgtaccttaatgtttccaatttaaccagaaaatatgattaatgtaaaaactatagcaaacacagtaattttactttgtaattctgctataatttgtttcatttgccatattttatttttcttgttgtcatttgaatttatacctgggaatgccataaaacttaataccttagaactataatcaagtcagaagagcttcttttccataatggtgtcatatggtttgacatccactcgtcatcttcaggatgttaaagtctaagatatctactttacatattttatgtattcaaacaataaggttttatgcatgagtgagtttgaggctttggaatatgtgcacccactatttagtaaactgttgccttccattgttagggtatccttgtgagacttaaaaaacaaacaaacaaaaaacaaccagaaaaccaaagcaatgcccctgaggccaactctgtaaacttatgggaggtaacagtaaatgtttcaaggacaattctgatatgattcctaccaatgtcacatagctgctgacatctgggaagtgacagtagctgacagaccatgttggcacagcagaaatcagagatggactagctcagttggaagaaaaatgtcatgctgattgggaagctaagaagcagaacgccacagtggcaacctgtgcaaacagtggctattaacattaactaacagacagattgagtccagctagggctgcggaccacccatcagtggatctgccatgcctgtacatataggaagttctttgctgtcagcatagcttcgctcagtaaaagagaagtgatgtttatgttcattattatgcttatgttgggtggtgacagataaaggaatgtaccttttcttatgaagagtaatgcaattttaatgagaatttgaccttgaaggtaaagaattgctgaagcatcactaattgagtattcatttaaaatgtattcccagtttagctgctggttcatcctcactcatccctgatctcaacattttcaagatggcaccctagaagttggagtatgttttagggcaatggagtcaaggcctttggactgaaaaataaaagcatggaaatagcatttgcttttactgttttatcatctaccctttggctgcctccctcaatgttggcgtcaagggtgattctgaaacctcaaagccccagtgaagccccaaccgcatctctaaccttttacctcttagtccatgatcttcctagctgccttacagaacaaaaacaatgaccttgagatgggattcaactttctcagttccttaccttattgtatacaaaatgtattaatttctgcactggagacttgggattgcttctcctacccaaggctaattttcatacttgccttttcaattgcatttcctcccttcttgctggaaacttttctttttaacttcacatgtcccttctttctcctgtcttcagcctctctgctgcgtggactcatctgagcctgtaaacatgaaggctctgttttcttaaaaccaagttgggaaaacaaacaagctgcctttatttcctccttgcattcatttttctacaattctttaatcgttttcctttctcagacaagttgcttaaatgagttgtttaaaggagaacatgatccttcccttccccgccctgcacgttctgctgttcacatttctgacctttgattcattgaaactctttgaacagtttgagaagtttatcaaggaataacttaagaaaaatactgcatgcaatgagaaggtcattaggacagaatgagaagcttggtgtcagagctgatgggccctgacttagcctgctaggtaacacagctcttgtttgtttgtttgttttatttgtttattccttgtatatttgtgtacacatgtttcattctctttgaatagccacagatgaggattcattaagagcctagactttttaatagacttacactcctttagaaatactttaaattcaataaactaaaaatatccagaatcctgcagtcagctatataggagactacatgtcgatgtctagtttctaagcatggataggtccagtattttcagtcatggtttttctataattttaccatagcaaatatgtgaattgtctgtggaatgtttgttctgtcaactgaagaatgacaaggctcatagatttggaaggaagacttttatttctcataaagagttgtggcctgcaggtggccatcctggcaggctggaaagggtagcttcctgccagaagccagaaacaggcactccgagggagaggtaaaagaaacaggaatttatgctgggcagggtggctgaatacacgtatttaataagctgtagcaggggtcatgaatacttgtgaaaggagaaacagacccaagtgcaattgagcttcatgcttccagatgggtcatgtgttcaaaaaatggcattggcatgatcagtgggtggagattttggccctctgatgtcgaaaagtgaagcagaggccaaatccctctgtgtgcagcctctgtagactggccagaccactcagtggtcagtggtctcttaccaggaaggaatgctggtgggttgttgtgtcaaaattgcaaaagggagaggcagcagtcagggggctgggtgaaatcagcggtgcagcaagtcttctgaaagggctggtttctgtttagcccttagggaagaaagcctaaaggcacttagcgcgggaggatgcatattaaattgtcctacctcactttcactcacagccgggaactcagtttttaaaatttgcctgggttctccatcgtgaagaggcagtttgttcaatgagttcggaagacgggcagttaggatttcatttttatttctcaatccatttatttacagtttatactcagcctggttctagaaagttgttgggtaagtgactgccccacaactttactaccatagtgaacaatggtcaaggagaaggaaattcagaagatcttaaggaagacaagggcttcaggatggtgtggatcatgctcaatgacatgagatgcaggaagaagaaatcctacacaagttcatgtgtaatgggccagctgggctgtgtggagcttaagagagtaaaaggtgttgaggctgaggcagtaagtgtagacagtatgaaatgtaaaggagaaggtggagatttgttggaatgagattgatcctataatggattcattacatgatacctatttgtgtaatactctagcagttgcaaagcatgctcacttgatttttttccttttaacctcctgaagattctagttaggtgggacagtaaaattgttactgtcttccctatttttcaaatgggaaaatcattttaaaacagtgagttgcataaatcacatagagagtagctgagctaggatttaacagaagtttatcttaatccactcctgtgatctttctgctttttcagttgtcttttcttctaatttaaggctattagataacaaaagcagaaagaaaggaacttctgaagatgctcagagagacattgggaaggacagactccctcagaacccaggaggagccaggctctagaacatggtggatgagagaggacattactcttaaagagaaagaaagattttcattctccattatttcagaacaagctgacaggtagaatttagggtctggaatttggaatatgttaagtaaagaaagaatcttggtgagttctcatgagatgggggtccctgggtgaagcctgatgcaaagcctttgaatattctctgttgataatgcaaaagagcacatttgattgcaagttttaattggtctcacatagtcatgcaactgtgtgtttgtgactgctgttcgccaatcttcatggattattgaaataaagaaagcaagcacttggctcctttcattgccaaatcttttctacattgatactgatgtctctttcagaactggctcttgcagaataaagactttaagagattttaaaactctcaccgtattccttgggttcttgcctacccccttaaggagaagaggccaattgtgcttttgtaggtgttaactggctcattccccagcctctgtttccataaagctaaaggtcagtctgatcaaaccatcaatgacagtccatctcacagatgcttaaaatgtgtttttcagtataatcttgaaatgtgataccgagcagacatctcgtgtctcaaagtgttaatatatcaataacatattacaactttgtttcttaaattatcctcttcagataatattaaattctaagtccccagataatgaaaggtgcattgttccatcttgtggcagagaaccatttagaaaacattttgatctcattttttaaatcattagaatacgctgttgtattttttattgttttcatagcttaagaatgacccctattttttattgtacccctgttttggacaatttaacccttttgataacccatattttaaaaaaaaattttttgtttatctattttaactctgaaaaagtgaataaattgaaaaacaaaattagtatttatatggttccgactcccaggattattgattcctccttttttgtatctttatgtaaagcattattctttctactttctagttacagatacacacacacacaaacacacacacacacacacacacacacacacacacacagtgactattccttgggttttgcatagttaatttctttctttctttcttttttgagacggacagagttttgctcttgtcacccaggctggagtgcaatggcacaatcttggctcactgcaaccttcacctcccaggttcaagcgattttcctgcatcagcctcccgagtagctgggattacagtcacccaccaccatgctaattttgtatttttagtggagatggggctttgccatgttggccaggctggtctcaaactcctgacctcagatgatctgcccatcttggcctcccaaagtgctgggattacagatgtgagccaccttgcccagccttacatagttaatttctatagcataattatactgctctgtaagcagatttcctgtgtgactgcattttgtcatatatagcaaaattagtatgtagttttgtaaggttcaaattgatgttagaactaaaggtggaagagtacttagctttgtttcttaaacttataccatcctcctaaaagcaatcttgcagacagatgcaggggtaaaaaaaaaaagaaaaaaaaaaaaagtagtgggaaggcctttgtcttttgaaagaaaaaatcacatagtgatactctgaaaagctctcatcggagaataaaggatgcaatcgctgtattaaacacagatggaatatttcagtctcagctgtcattgaagaatctccacattagtttggattgcgcacctttggggcatgtataaattgacagtgataaaactacctcgttgctgagctggagtgtacaacatccctttatctgtgccatctggtgctacagaggatggcaaattcttctctgccatgatttttctttctgggggatttctagacttccttagcatagaatgtgttggaccaaaatcactctttgcccagatttcagtgacagtagcctgaaaagagaaacagaattctaagagattgtaagtgtagcaggaggcagagaaattatttgatgcactgtaagatattttggagggtagtggttgattacaatgtgatgctttataatccctgaccatatctcactccctagtgatggcaagctgttcctagttttgtttttgccatttttactattgcttgtagcataataatattaaacaattaatgctttggttcttacccactgaagcaatgaatggttgttattctgccttagggctcttatttattgtggattcccaaacaagtttacaatgctttatcatcacttactcaatttatctaatttaagaccaataacaagatttactggctgttgagtcttgcaacaacctgtgttcctttattatctaccactgcctgtgattaaaatgaaaacaaagttggattgcattttattaacaaaaggatatttccaagaattatgaattagtgatagaaggtttataaatgattaagttttaatttttccccccaaattgtacttagcttatgtaaaacagtctagacccgtttaggagtttatttgttgtcataaaatatcaaggtgagagttgacttttctctggatttgttcagtagagaactatgctgggaaggactatggagaccttattaatagaatcacacctgaattgactgaagccaggttacaatcatgaaaaatatgaatgaaaattttaaccaaataaaaattggggctgtttgggttaaaattgaataaaactaagttaaatatacaactgtttgtggcctagaggaaagttacattggttttttttagttcttaggtagtgtagtgtggttagaaccttttctgaccagacgaggttgtattcacctctactaatttcttagctctgagcacttccagtgaattacctgaactctctaacacccgttttagctcatcaaaattgttcatatttcccttttcattagggaagggaggtttaacaagtaagttctttcagtcttaatttgcagtgaggttgtttcctgtttgtctacgaatttagccataactcaccattcctctttccatgtagaaaataattgtggtttttttttttttgtataaaaaagtgaaagtgtgtccagcaaggaataacttggggaaaagccaggaaagcactatcttattagatataaagcattccagtgtcaccacaagcagttgtacaaagaagaaagattggattatgaaactggactgtaattcttagacgcagtaccactcctagaacacgcttgggaaaaagtcagcaagaagattggacctggagggagtgctagaaaggcaagttggtggcaggagggcaaacagcacactttttttctagctatggttttctctggacattctcagtgccttgatattccagtgctggatgggaaaccactgatagaacattaatttcttactttgctcattagtttaagattacagtgttaattattcacaagagaagaaagtaaggatatctttttttttttttttgagacggagtctcgctctgtcgcccaggctggagtgcagtggtgcaatctcagctcactgcaagctctgcctcccaggttcatgccattctcctgcctcagcctaaaagtaaggatttcttacttcttcttcacatctccccctttagagactgtaccagatttaagcctgagaactcattggttccttctggtctaattctagagacatgtgtaccttacttatggatacttggcaaggtaggcattagtatttggatgcttatcttcacaaacctgagtgaggttcattgtgagggtagaattttggagaaaaatgcctgatttgataaaaaagagtttttcagtaaaggaccacctaatttctgccttctggacagacttcacaattggggatacaagtggtattctaattgtgagcatcatcctggtttccattccacccctagcagagtgcctgccatgatggtgctttttttttacttgataaagggattcacacaagggagatacaaggtgagcctgatgaatcttgttccccaacctagaagatgctcagcctaatgaaatcacctcaaaaggaaacaggagccgactggatggcacttgcactggtaaaattttggaattttgagcatcaaaaaagaataacgactgtaatagattgcaatatattgaataaataaaagccattgagtaagtgatacacttagtgatatacaataataccacttagataacatcataaaacatgaaatacttagggataaatttgacaaaatatgtgaaagatctgtacattacaaactacccagcattgttgagagaagtgaaaaaagactgatgtaagtaaatgagagatacagtttttatgagtcagtttttatgtcattaaaaatgctaatcttcaaattgtttatatataaatttagtgtaatcccaacaaaccttgacaggcttttttttttttttttttggtagaaattgtctggaattgatagaatcaggtataagctgattctaactttatttggaaatgtaaagaacctagaatagtaaaaacatttctggaacaagaaaacctgaaatgaagagaacttacagtactgaatttccagacttcctataaagctacttaagtcaaaattgtggtattgacgttaggttagaagatagatcaataacttgaatagaatccccaaatagaccacagttatacagtcaattactttttggcaaagatgtctagataattaagtggagggaaaggacagtctgatcagcaagtggtattactaaacacacccatctccattcaatacaaaattcacttgaaatggatcatagaaccataaaatttctggagaaaaagaattggagaatttttttgttattgcaattgtagcttaggcaaatacttcttacatacagcatacctgaactgcagaagaaaatgataaattgtcaagccaaagactgggagaaaatatttgcaaagcgtatgcttaataaaggactagtgtctaacatacacagataactcttataatttaatattaagaaggtaccctgattaaaactggggtccaatatttaaatagacatatttccaaaaaagatagacacataaatatatgaaaaagtacacaatgtttctagtcatcagagaaaagcaaatcaaaattacagtgataacattatatacactgaaatcactaaaattaaaaggactgaaaatagcaagtattggctggcaaagggcaaagcagcttgaactctcatacattgctgggcaattcagaatttagaatagtctaatcattttgaaaaagtttgacattttcataagttaaacctgtgcttagccattgtgttcttaagtatctacttaaaagaaatgaaacttatggtcccacaaatagcagtaagtgaatgttcacagcaactttgttcataataacctcaaactgcaaccaacccaaatatccgtcacctggtaagcagatgagcaaattgtgctatatctatacagtggaattctactcaatacagtggaacaactacttttacatgcaaaaacatggatgagtctcaaaagtgtttcacaaagtgaaagaagccagacaccagagactgtatactataatatgattccattaaatgaaattcttaaagagcaaaactgtaatgatacaaattagatcagtggttcctaggggtgaagtgaggaaattaactgcaaagagcaggagggaaattttgggtagtggaagtgtttctgtatcttcatcgtggtgatggtcacacaactctatgcatctatcaaaactcaaactttaccactgaaatgggtgcattttactgtactcaaattagtcctcagtataattgtttaaaaataggaccatagtggtatttgaggggaaaagaggtaggggtgatgggtgttaaaataatgaaaaaaggaaaaaaggaaaaccttcagcagtctgcctgctaataaatgtaggagaaattatagaattggcaagatttcatttttaaaatcgttacagtagcaattgatccagtcaagtggttgtcagtgacaaccacttgagaaagttgttgaataacaagatagtcacaaatactgcgctacaaattactgactaccttaattggataaagtgcacctttctaatacccatcatttccatcaaaactcacattgctagcaatgaacaacctgacaccactctgaaaatacccatccttgtcatcaaaattcacattctagcagtggaccacctgatatcacgtgtttgttaatgtgcacccccatgaaatgttcttgttcatattgtttaatttgaatctaaaccaaactaaaaccctaattttcaatgtacaggaaatacaagggatagagaaatgagtttaacaatgtcataagtaaatgattggccaaatcctgaatgtagaacattctacaaggcaattgactggactcttcaaaaagttatgtcaaaaacaaacaataagaaaacaggaaagaaaggggaacttttccagatttagagttgaaaaagtcacagccaaacgtaatatatgcagcttgattggattcttgtaggtggaaaaagttgtaaaagacactttagagcaagtggaaaaattttaaaatatggatgggccgttagacatagtggaatttggttaattgttttggtgtgataatggcattttggttttgacgagactgtttttattcataggggaagcatggtgtgttgcatcatgttgttggcaccttgctttgatgcggaaataaaagaaaggaataattcacatccgcataaggcaacaataacagaatataaattattaaatctgggtgaagggtgtatgagcatttatttactcattaacttttctacgtgcttaaaatgttatgacaaaaagctgaaatataaatatacccttctctgggaaagatagctctgaagagtagtttacccccggaaactctttgagacttttgattcttaagtgatgtgaccatttaagaaggcacatccctcttactccctcttttctatcaagtcctcagttctactaaaaaattatgtttctatacaggaggagaaatctatgagtactattttttttttttggtcagaaactaaagattaactgatttttaaatttagattaattcagaaagaaaatgcattagttaaaacaaagatgtaaaacgtttttattttttaaattcatattttcatttccatagcatttggggtacagtgcttttttttgttacatagatgaatcctatagtgatgaattttgagattttagtgtacccatcaaactgtgtgtacattgcacctaatgcgtagtttttatcgctagccccccctttcatcctcctcctcctgagtctctaatgtctattatatcactctgcatgcctttgcgtactcatagcttaacttccactagtgaggacatacagtttttggttttaggttttctactcctgtgttactttttttagaatactgtcctctagctccatccaagttgctgcaaaacatattatcttgttctttttaatagctgagtagtattccatagtgtatatgtaccacattttctttatccacttggaagttgatggcatttagattggttctacatctttgcaaatgtgaattgtgctgctgtaaacatacgtgtgcaagtgtcttttcatagaatgacttcttttcctttgggtagatactcaatagtaggattgccggattaaatggtagatctacttttatctctttaaggattctccatactgtttttcatagaggttgtactaatttacattcccaccagcagtgtataaccattcccttttccccacatccacaccattatctattgttttttgactatttatttattgagatggagttttgcccttgttgcccaggctggagtgcaatggcccaatctcagctcactggacctctgcctcttgggtttaagtgattctcctgcttcagcctccctagtagctggaattacagctatggaattacagctggaattacagcacatgccaccatgcccagctaatttttgtatttttagtagtgatggggtttctccatgttggtcaggctggtctcgacctcaggtgatccgcctgcctgggcctcccaaagtgctgggattacaggcatgagccactgcgtcccactgactttttaatcgtggccattcttgcaggagtagggtgataactcattgtggttttaatttgcatttccctgatggttagtgatgttgagcattttttcatgcctttgaccattcgtatgtcttcttttgagaaatgtctatgtcttttgccccctttttaatgagattatttgttttgctgatttgtttgtgttccttgtaaattctggatactagtccttagtcagatgtgaactttgcaaatattttctcccattctgggtgttgtctgtttactctgcttattgtttcttttgctgtgtggaagctttttagcttaatttggttccatttatttgtttttgttgcatttgcttttgggatcttagtcatgaattctttgcctaggccagtgtctagaagagtttttccaacattgtctgctagaatttttatagtttcagatcttatatttaagtctttggtctatcttgagttgatttttgtatgaagtgagatataggtatccagtttattcttttatatgtggtttgccggttttcccatttaatacataggatgtccattccccaattcatgtttttgtatgctttgttgaaaatcagttggctgtacatatttggctttatttctgggttctctgttcttttccatagatctatgtgcctacttttataccagtaccatgctgttttggtaactgtagtcttgtagtataattcaaagtccagtcatgtgatacctccagatttgttcaaaaacttttgcttaggatagctttggctattcgggctcttttttgattccatattaattttaggatttttttttctaattctgtgaaaaatgatgttggtattttgatggaaattgcattgaatctgtagatttctttaggcagtatggtcattttcacaatattgatccttctaatccatgagcatgggatgcatttccatttgtgtcatctgtgatttcttttagcagtgttttgtagttctccttgtggagatcttttacctcccgcattacatatgttcttaggtattttattttttttcctgatgttgtaaaagggattgagatcttgatttgattctcagctaggtcactgttggtatataacagtgctacatttttgtgtatattgtaaatctaactttctaatgtggaactaatgagattggaatctgaggctagagtattagctttatatttttgcgtaataaattaccacatagcttcttaaaacaagtctagtttattaggtaggagttctgaaggccagaaatctggacagactgagctgagttctctaattagggtctcacaaggccaaaatcgtggtatcagccaggctgggctcttttatggaggctttgggatgctctgttgcagagtttgacctcctagacaggcaggtctgaggtccccacatcctttctggctgttcattatggtcactccctgctcctagagggtgccccaattctctcttgcatttccctttcatcggcaaatgagcaacatctgattttttttcttccctaacttccccttctgctaacatcaggagaaaactgtttttaaatggctgatgtaattagatgagacctactaaatagtctctctggtttaaggccaactgtatcatataacataaaataattccagggatgatgtctcatcatatgcacaggttctagctatactcagtgggaggattatgcaagggtgagtatcactgggaattcttaggattctgcctaagagtttctactttggtttttgggagacaattttttaaatctactttttaatctacttactggcatgtgtatgttagttctctgtgctttatcacctgcctatttattgaattgtatgtgttacttcactgtacctcagcatctgtcaacttatttaaatgtgtgtgttggttttctgtgccttgggatctactcattcattggaatgtgtgttttggttgattgtgccccagtatctatgtattgaaatgtgtgtgttggttcactcagcctttccatttatctatgtattgaaatgtgtgtgttggttcattgtgccatggcatctgtctatttattgaaatgagtatgttggttttctggacctgggtatctgtctatttattgaaatgtgtgtgggggtttcatcatctctattattatattattattattttgagagacagtattttgctctgttgcctaggctggagcgcagtggtacaatcatagctcactacagcctcaaactcctgggctcatgcaaacctccagcctcagcctcctgagtagctaggactacaggtgtgtgccaccacacctggctaatgtttttgttttattttattgtaatggatataaggtcttggaatgttacccaggctggtctcaaatccctggcctcaagtgatgctcccaaactgcagggattacaggtgtgagccaaccatgcctggcctcattatgtctattttatctgtgtattttctcaatgtaagataaacagttatttttatcggaaaaaaatttttggttttaatattatttaagagggcaggcatttcctttttaagaataaagcttctcagctttattttgtaatcataacacagtaatgacatttttaaaagaaatatacaatgccccttttttttttgtattagtttcaaagatattccctaaactttaattctgttttctttctttctttttcttttgttttttcttttttgtgatggagtctcagtcactctctcatcacccaggctggagtgcagtgatgccatctcggctcactgcaacctctacctcccaggttcgagtgattctactgcctcaacatcccaggtaactgggattacaggtgtgctatcatgcctggctaatctttttttttttttagtttttagtagagacagggtttttgccatgttggccaggctgatcgcgatctcctgacctccagtgatctgcctgccttggcctcccaaagggctggaattacaagtgtgagccactatgcccggccaactttaattctttacatcttcggcacatttattttctgattgctctgtatgaaatcaaatccagccataactttattgctagcatgcttcagttatctatttctgtaaacaagccagcttagccgcagtagtataaaacaaaaactgttttattatgcttctggattctgcagtttaggaatttaggcagggtatggcagggatgcctggtctctgcatcatgatgtctggggcctcagctagaatggccaaggcttcaatagccagggagactcaaaagattgaaatctaaaatcctctgaaggcttctttactcttatgtctgtatctgggctgagatgactaaaaggctgagctcagctggggctgtccaccagagtgcctacatgtagcctcctcatgtatcttgggcttcctcagagcatggtgacaccagggtgcacagatttcatacatgacagctctaggctcccagtgcaactgaaaagttaatctaaaaatcttatatcacatttgaaatagaacatgtcccaatattgtttctcatatttgatagtggatgtttttgtgtatcttaaagtgtgttcatgtgttttaagttatggttttatctctagagaaaaagcaatgatgacttctaaatcataaaattgagactcttagatggatggaaaaataatatattacctatatattattcatagataagtagcatttttatttcatttcaaaataattggcatcaatttgaataacgcatagtttaagaagcttgtagcataattaaaaatggcaggttttgctttgttcctgtatcactaatgaactgttagaattttgtagagagctaacaacttttggaaataggaaggcagaaaacattactgatatagtgatataaaagaaaggagaaaaagatacaattagtatttataaaatgaaattatatttgccttgttcctggctttctcaaaggaaagaaataactttttcttgtgttacttaaaatgagatctgatgctgctgagttctttgtttttttctatgataggcctgaggaaattaggacttcatttccccaaatcttcatgggtcttgaaccaacagaaatgtgttatagtagccacctgcgacactaactctcctcacagaacccatcatgatatggtcttagttcataattcagtatttccttagatttatagtgttgtgtttaatcttagagccctccatgttattttccaagtagtctttagtttattaagactatgtttattcttactagtttgagaagaaaatcttgaaaagtcctggcttcaccttccttttctaccacctttatagaaaatacacctcttatacctgtaatttagcaaattatacccgtaatttggcactttgtagacataaggtaaagtcattttagggggctgtcccagtggggacacaagccatctggcccagggatattatgtgcttctcaactgtgacagttcttcctactcattatataatgggcttttctaaaagcaattttttttttcttaaaggattcagcaaacccctgagctgtaacaataggattaagtgatgctgacattcaaagtccggaggttctcagtgtggtccctgggccaatagtatcagtattacctgggaacttactatgaatgcatgttcttacacttcacccaggatctacttactcagaagctctggggctgggatccagcagtcttttaataagctatgcaggggatactgatgcaggctaagttttagaaccactgtctaaggatttgcaattgttcttagtatttaacatgcattgtaccttcttatccttctgaataagtatttcttattatttatgtaaggtagctttatatgtataaaatagtcatacattttaacattatacgtatatgtatatgtacatagtcacatatatttttcttgatttttacattaatttaaaaatggggaatgcactgtctctgccattgtcctctccagattttgagatagaaatgaagaaaaccatgtaaaaatgaagataagtagaccagggtgggactctgtggagctggagatcgatgggcaagagatgtgaagaaggtgaggagaaagggatagagtaagggggcaggaccttggcctgtaacttgtgctgggagctcagctgagagcatcactggggcagctgagtgagaatagagcaaaagctgttgctctgtctatatggttttaaccagggttgttttattccagggataatgggaaggttggatcaacacccttttctcagttgattcttctcattgatacctttgcctttagcactgtgtaaactcattcctgcagtaaaatgactttttaaatgattgctcacttgtcactaacttgatctgcattgtcacagacttaattataaaacttttaattctacttagtactgtaacataggatagtgttttaataggtagaataggattgttttgctatgttagattaaatatggagggggtgttcatatacaaagaaccatcagttgctttttccaggaacattatatcattgttttaacaagtaaaagagatttcatttacattgtttccatttacaaagctttttctcagagtttgtcttttggaagtccacactctttgttttgtaataggttgggaagcaacatggctctaagcaagttaaccctgttttaaatttattcctttattaattttttggaatagtaatttagttatgattcacaatttcaatgttatctttaatgtgttaacttctagttttagtgtatgtacccagagtagatacttactaaatgttggttaaatgaatgaagattggctttgttaagatttttggagagagctccttctgtgttgtaaaggtgctcagaagggtgattttttttctgctgctctggtttgatttttgcattatatttttgtagttaaatattaatctctcttttgaaatccttaattgcatatagatttttaaagttgatctttattttatggttctttgctttaaatgttccacttaattttaaatgggaaggatttaaaacaagctctaaactagtatagaggacatgtacatatcttgaaaaatgacctgttataagcctgtacactgtggcatttactggtaaggtttctcatcatgtgcatgtgaagagaaaagaaacaaacttattttattgctttaatggcgttgtaaaaaatggcaagaacttcagcaggggtttatatcagccagctcatttgggtttctaacttccttcttattgcttttccttcccatagcttcctgagtggcctttcaagtttttttttccacttacatatactcatatttttcttttccatgtaactctgacacatagttactctcacaggtctgtcactactcagatatcctctctatggtgatctcagaccgtagccaagtttcatccccctaatgctactcagccagtggatgctgacatttcagaagggaagtgtggatgggccacaaagtaaggacttctcatttctttcactgagaagtattttggctctttggttggttctaataacaactaggactaccttggagtaggaaaacctgatttcagagtctaacaaaacccaaaggtaggcattcagaaacctggacctcacaaagggaaatgaaaagtgatcaagaagctagatctggccccttttttctatctgtattagatatctgctctgttcttttctcaactctcaattgatttggtaaagatggttaaatgagaacaactgaattgtaaaattatctacatttcatgattaagcctgactgaattaagatctttgtaccagagagtcattcagattggtccaacttggaccatatattctcctgtatccgacagactgtggacaaaagatggggttcacagtaaaacagaatgtggaccctcaggaaccttgtcccatggcaaggtcagatctattctgattcaaacgaggccaaagcaaacaaaacccaaaatttggggttttaattgatataaaaacattttgaattttgtagcacatttttctaattcttaggtgccaatttggagctgacagttcttatttttcaagatggaacagacaaatgtttttaatctgtgtggaatgagaaactggggaggatgcagctgaatgtatgttttaaaagagagagagggtttaatggctgaaacaagatctaagaggagtcagaaagagatccagggccagtcagatgaaactggtggccttgggcagaagaaaaattgttctctaagacaagggatatcaatgtgcctgtgtatcaggatttggagagttgaacttaattcctgagtgggagtcaaggctgtcagctaagattgatagggttgagtagggaccaggcggaaaacagtgaagtttgtggaatagaaccatgaggaaattaaagaatttctgacggtgagactaaagtttaaaatttaaaatctagaccaagaggtaccactctaacccattcccctccagtaaaagcaagtgattgattaattgagtggggctgtccagtcagatgcaacagaaggactgagggaaaagaaattgaaaaaagatagttgacaagtgagagagtagaagtgcttcattgtggggtcctatctgagtagggaaggaaataaagacaggaagagacacagttgttgaagaagaggaatgctttaaagttgaggtctcaatgttctaggctcacacttagtgatagaaagatggaggatagaagatggaattccagaatcgatgatgttggaggaaatcctgttctggtgatgccagggtctgtgctatggccactggcttttcccgtggtagcatttccttggagaaggtcaaggaacttgtgttttgcggctcttcaatcggcctcccatatggacattgataataatagctaactttctaggactacctattctctgccaaacagtgtaacagatttttgcatacgttacttccaaccattataataatcctttgtaaggtaaatactacctttttttttttttgttacggagttttgctctgtcacctgggctggagtgcaactgtgcgatctcggctcactgcaacctctacctcccggattcaagtgattctcctgcctcagcctcctgagtagctgggattacaggcacctaccaccacacctggctaatctttgtatttttagtagagatgaggtttcaccatattggccaggctggtctcaaactcctggcttcaagtggtctgcctgtcttagcctcccaaagtgcttggattacaggcatgagccaccatgcctggccgatactaccattttcattacacccagaaggttgagccaatctaataatctgtccaagattgtatcgctattaatagtaaattctggagatggaattgatattcaggtatgtctgtctctaaggcctagcactattcacttgctgaattccgccatggactcccaaagccccatcctcccagtttctgtttttcctcttcattcctttgtttttgccttccttaatttaaaaaaagggcgtaaaacgaacaaaaacatgtaatatagcaggattttttttctttttttttttattatactttaagttctagggtacatgtgtacaacgtgcaggtttgttacatatgtatacatgtgccatgttggtgtgctgcacccattaactcatcatttagcattaggtatatctcctaatgctatccctcccccctccccccaccctacaagaggccccagtgtgtgatgttccctttcctgtgaccaagtgttctcattgttcaattcccacctatgagtgagaacatgcagtgtttgtttttttgtgcttgcggtagtttgctgagaatgatggtttccagcttcatccatgtccctacaaaggacatgaactcatcattttttatggctgcatagtattccacggtgtatacgtgccacattttcttaatccagtctatcactgatggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccttgaagaattgccacactgtcttccacaatggttgaactagtttacctcccaccaacggtgtaaaagtgttcctatttctccacatcctctccagcacctgttgtttcctgactttttaatgatcgccattctaactggtgtgagatggtatctcattgtggttttgatttgcatttctctgatggccagtgatgacgagcgttttttcatgtgtctgttggctgcataaatgtcttcttttgagaagtgtctgttcatatcctttgcccactttgtgatggggttgtttttttcttgtaaatttgtttgagttctttgtagattctggatattagccctttgtcagatgagtagattgcaaaagttttctctcattctgtaggttgcctgttcattctgatggtagtttcttttgctgtgcagaagctctttagtttaattagatcccatttgtcaattttggcttttgttgccattgcttttggtgttttagacatgaagtccttgcccctgcctatgtcctgaatggtattgcctaggttttcttctagggtttttatggttttaggtctaacgtttaagtctttaatccatctttaattgatttttgtataaagtgtaaggaagggatccagtttcagctttctccacatggctggccagttttcccagcaccatttattaaatagggaatcctttccccatttcttgtttttgtcaggtttgtcaaagatcagatggttgtagatgtgtggtagagccaaatcatgagtgaactcccattcacaattgcttcaaagagaataaaatacctaggaatccaacttacaagggatgtgaaggacctcttcaaggggaactataaaccactgctcaacgaaataaaagaggacacaaacaaatggaagaacattccatgctcatggataggaagaatcagtatcgtgaaaatggccatactgcccaaggtaatttatagattcaatgccatccccatcaagctaccaatgactttcttcacgtaattggaaaaacccaaagttcatatggaaccaaaaaaagagcccacattgcgaaggtgatcctatgccaaaagtacaaagctggaggcatcatgctacctgacttcaaactatactacaaggctacagtaaccaaaacagcatggtactggtaccaaaacagagatatagaccattggaacagaacagagccctccaaaatgatatagcaggattttaaaaagaaatgagaaataagcattaaaaataaaaatttataagatataggatgtaatcaagggtaggttagcatacaaattcaaggtgttaattttatcgcatttactaggcttaggctgtaaaattggctttaacattttaagagcaagcatgaagaaacaaaaattacatgatactcagagttgagtaagactactcccagtactgagatgtgggagatgacaggccttgggtaatgggaaaaacatcatcattaggaagactctttataaaaatataataatatattttattgagttcttactgataatatctatcatgtaggcaaataaaattctgggagatttaaaataatatggttgagtacggttgctcaaagacaggttggaatgcaggtagagctaggcagatgccacatttttttcttaaagattggcagattaaatgacacctaaagatgggtagaaaaatgtcaccagttcatacacgtaaaaattgttccatgtggaatgatctgagatttggaatcaattactgtaatttcttcaactaagagttcaactccttcctgagcctggattagggctcatatccagaatatactaggacagatgtcctagtgtaatgtcctgctatgacctcgtgacatttttctactcatcttcctacaaagaagtaggatatgaagtctagagggatgagaaacgattgtggaattttttttctctctgtatttttatgtcttttgactagacatggggaggttgtttcatctcacaatctttagggcagtggttgtacaaagttagcatgcattttaattactcaaaagcttattaaaacacagattgctggtcctcaactctaaactatctgattcagtgggtgtggagtagggtatgagaactgcatttttaacaagttcctaactgatattgatggctgctggtcagaatgcacactttgagaaccactgctgtacaaataggaaataaaatgaaattggataataatttagaatatttaatgctaacattctaaattagggaaaatcctagattattttaatgtcttttttcctatatacccatatcctcattgaaagtagttttgacagtaaatctgatagaatttcagtttgttgagatggagaatttgttcttgcaaacttgatcatttacatacttataattttatttacttgagccaacccccttttcgttaatatcaagggtaaaattttatataacctgtctcaaattcataattaattgaaattgtaaagttttgcagggaatttttgtccccctaacacccccaaactgatctgttaattatctcaagtgcaaaagtgcaaagattctagcctctatctttagaatggtaataccaccgagggctatttgaataaaaaatggataatttcttgattagttacaatgctttaaagccatggtttctaagggtattgaagcagagaactcattttaatgactttatttcccaagtatcaaggggccttacatatcaattttttggtttaggataataattttggtgtattgtaacaacactctttttatatagtgttgatctctaaggagtgcttcactatttcttcatttttaggatatctcacaatattagtaactcaaatatttcaagttcatagagaatatgagtaggaaaatagatgactaagagttgtggtttaccagtttctcccaatttggcacccaccaatttgactcatatctaatgagagcataaaatagcctttatctttttttattctaaaaataaagtcattgaaaaacttgttgacaacaaaaaaaagattagagatctgaattatatttctccttggttctcgatacggtttaaaagctaacctgaacaactctgagaacgtcatgcatttactgggtaaaaacatgtgggctaactgggcttgcgaagattctaatataatactttctacaccagctgatagtggtaaaggaagtttcagaacatcaatattaatttgtgtccagctgatcgcctcatacggcatgctggtggctctgatttttctttttttaaaccttgttttaatgtctaataagataaatttctacatgtggaaaatattaaagtaattaaaaacatttggcttttttgcatatattttctaaaattaacttacttgttaacactcatctctcttgtctctaattgggttgaaatgtgtgaaaaaaagctttgatatggaactgattttcaaagtatggctcaactgtgatacacatggaggagccaatatatgcagctttgaaaaagtttctgatgtcagtgtttttacttaggtggcataagatttgaataagaagttgctacatctcaataactaaggtttctgttatcatttggaaatctaagcactatcactttagagctttgagttaaaaggtggtactccaaggtctgcttctgaagaaattgtttctcttttttctttaaaatattcatagtgttggcctggtgctgtgactcacgcctgtaatcccagcactttgggaggccaaggcaggcagatcaccttgagctcagcagttcaagaccagcctgggcaacacgacaaaaccccatctatactaaaaaatacagacattagctgcgctttggcaactcatgcctgtagtcccagctacttgggagggtggggctggagaatcgtttgagccctggaggtggaggttgtggtgagcccagatcgcaccactgcacttcagccttggtgaaagagtgaaacgctgtttcaaaaatacacacatacatacatacatacatacatacatacatacatacacacacacatacatacatacataaaaggaaatattcatggtgtcatctcatttcctagtaaagggggtggggctatatttagtaatttgtttttctaaaggcagataaatactatcctcctttcaagtgctctgtagctggatggctttgtttgactttctttaaaattatttttaaagtgtgagcacacataattttatataatatcttcatcagatttaaatgatgtaatttaggtaactcttgcaaaggctttacatttttttaaaaatgtaaaccatccttactctactatttcaccatagatgaacactcagtacattgacacagcttatactattttttgaaggttgaattttacataaaaacaaggttatattctatgcctgtggaaaagttaatattcatttctttcctgtcatcctgtgagctttattaaaactgctaccacctgtcagcaagaggtagaagagcgtcataatgaaaggaattgatgctgaaatatctttctgaagaaaaatagaagcagcttctttttttgacttgtgatatttggggcctcagctaatcaacgttgcagaagtttgagatgattggaaatcttaatggaggcaaatggagccatatccaggcttgatgggatctgaagcatataaaatttgggaggtttcctttaaagaaaaacaaaaacaaaaacacaaaaaaatgctttcctttagaaatttataaaacttctaatggaaggtgttggattctctcctggggccctctgggcaggagaagcccttaagcttaaacttctttaacttcaaggtacacactgccttttgggcaaagaggagaaatattagttctgcctatgggcatgaggtggtctccaaacttccctccagatctggcccaatttttcaaaccttcaatccctactgaaaataagttttatttctgctatagaatttccaccttgtcttcttcagtcctggtttccagtacatctgtcttataacttgaaatctctgaataaaacttgctgagtaggtattttttaattggtagatgatgagttgaccaaaattcagcacttggccaaaattgctgaaaattgagagaaactgtcatggatgtagttgacaattcattggctttcttcatgttttaaggtagtattaagataacacaccagcaagcaaagtatcttaatcacattatccctgaagaaatgtaatcactgacttaaaatttaatatttcatattatagaggctcaacaggagaactctgtgttggaacattatttccataatacatcttgttcataagatctgtgatgtcaagggctatgtattcatcctgctgatcccaatgtcaaatatgtcttactagatatttgcttcacaagaaagagaagtgctgtgtttaaaaatgtaggctttggaacttaaaatatctgataagcataatcattacacaccagggttacttccttatatcatcctaaaacatttaggaaatgtgctcattttatatattgagaaagtaagattatctttaaaagtgtggattttggagctaggcccagtgcctttgactgtattgcttactttctgctatggggcaatctttatgtctttatgattccattttctcatttataaattgaggtatcttaaggttatgatgatgattaaatggtataataaatgtgggctacttggtaaagtgccacataagtaagccctctgaagtgtttacctattgctgcagctgtttagccattgattcagcatcatacaagcacacatctaatgaattcgtacttttagtgaatgaataaaaaatggtatctttataaactcgaatgttgccccttgttaattttctaacaaattagaactgtgaaacccaacttattttcatttttgccttagagatcagtaagcttagaacgaaattcattattccaatggtgtaacttgttcagttcaattctaggaacaactactactttattttcttcagttgatccctattctctttgatcctttaatttctgattttatgtcatctccatccataaatcactgccaagccttttgaaaggggtataatttatattaaatggcctatctcccattccctgttaacatcttgaccatgtacaattgcgtgccgttctcatctgtgaggttttagttgtagcatggattctttttaggcttaattggaaaagccgtcaatcctgtaaaccacctacgacatcccacagtgtactatacaggttaattttccatgactattacaatttgtgacactggtttaaagagcaaaatccaaattatctgcttactaaatgtataaattcagaaaatgacatcttttcaaaattcttttaaattttgggtaagtttaggtaacgccaaaagtcctattcggtattttagagccaaaatctagacagaaggtgtaatgtaaaacacagttttgtcaaaacactcagaccattggcttatttacctgcttgtagtttatattaaaaagtaaattatcattgaatgagattttaggtctttctgaaaatgagaaatttccattgaaagatatggctagtcatgtttttgttgcttaagattttatagctggaaatactgcattttaaaaatatcttcagtttttcatccacattacagctaggtgctcctaaatgtgttgaaagatttctattaatatatggtattaaatgattcataatttgaagactcttaaagttctttgatcttatagctaaaaatactgcaggtattatagttactagaaaaaatttcccattctatactggcttgtctattatctgcagcttacttagaatttttaaaggacagtataaataaacggaaccccccaaatctggtacttgactgatttgactggaagacccatggcctagttccagctgtgtaatcagtagctatgtgattttgaccaaataagttaacatctctatgcctcaattttcttatcaataaaatgaggaaagttgggctaaactgattcctgagatcccattcagctgtggaagcctttgattctcttgtcacaaagcagcacacaatgaaatactttattcaaaatgaaatggtgagccaggcatggtgggccacagctgtaatcctagcactctgggaggctgaagaaggaggattgcttgagctcaggagtttgagatcagctgggcaacgtagtaagacctcatctctaccaaaaaattaaaataaaataatataaaataaataattggtgcagtgttattaagcattggcccctggaatatatccaaaggtcaggaaagaagttcacaattctgtatagtctgcatagctgcagccaggctggctgatgcaagtgtctgtaaagttactgtggctttctatttgcctgctgggattctagcattgaggatagcctctgaaaaacagtgccactatgagccagtttcagttccattgaaggaaaaaatgatttgagaacctcaaaatgggatccatggacttctgtattctaccagggctcagcaaatacttcacaggtgatttggttggtagggatgaaaagaacgttgagacagctttgttcacatacattcttcaatttgaaatgttaattattatgacaggcactgtagcatgtgtaatcatgaataattataagaagcaataaagctcataatgttaaagagagggaactcgaaaggcagtcttcctgggtttaaatctgagcactgtctgtcaatagctttgagagttcaagcaagttgtttaacctctttgtgcctcagttccttcatgtagaaagtaagtataataatagaacctgccttataaagttattctggaaatcaataaattattaaatgtaaaacatttagaatgtctggcatgtaaattcttcataggtgttatctattgttattacattattttcacagaaaatatttaatgtttgcaatatcaggaatagatttgggtacaaataactgaaaatcctaagataataatgacttaggcacaacaagatggctgctaaagcacttcccttttaaacacaagttttagaagtcacatttgaccatttggtttacctcttcttgaccagaacttaattatgaggccaaataagcttcaaaggaagatgtaaaatgtgcaatttaatctatggggctatgtgattagttcaaaatataatggctttattattgaggattaaagagagaatattgggaaacagcatctttccacaaatataattacattttgaaaaccgagttcctcagttttctcagttaagggacagcttctttgccaaactgttcatattatttgcatatctaaatatttaatttcagttattagtgttgtgttatttaattgccttgcacgcaaaaaatggactgatttctcaaaaatgattacatggcaaaaatagaattaaaatattaacatcagaactccagttcaggcactaaatttaaattgacataagttggtagaaaggactctgctagtgccataatttaggggaagctcctaactacggaaatgtgtgaataggaagtatggcagtgaacactagtgttcagatttgattggactgatgatctactgaccccctagtcacctgttaggaaactgtaaaaataagctacccaaatatgaaattgatgattcttttttcccgaaaggcagaagttaaaacccttcagatgtcatttagaatttcaatcctttgtgtgacacaagtcacattattactgagaagcttgtcaaccaacccaaactcttacgataaatgggtgtagaggggaagcagattaattattggcaaaacctctttgttaaatgacattttttgttcaatgacacatcacacattagtagccatcaatgtgtaagtacagtcactattttatgtactaatatttttctcccagtaaagcacaagaactggggtacagagactgaatcacagttcagaatatattaattacatgcattcattcatttatttgttcattcaacatacattttttcagggccaagagttattccaggcaatggaaatatggcagttaacaaaagaaataagctcttaccatcatagaacatataattctaatgacagagaaatgcttgatgacttttaccactatttatctcttatgaccctgtgttacatgaaaaggaagtgattgctgtgagcattcttgtgtaggctgagcaaggtgaattaggatttttagagagagtgaaacagtttttggttggggcaagagtagcattgctatgtatataagagtttacctggatacttgtctatcttctgctttacttccaagagcatttcctaatcaatagtatacgtcctggtggtgattaagagatgaaggaagtagtcaaaattgtgactaggatggaattgcagtcattgagtttctatgttagtgttctgggcaaagaaatacaatacagctttctccctactccttcccaatggcaagggggtcacacaagattacctgaaatatggaataaaaacatctttttatggacagtagattgactcttttttatattaagtggcatgatcagttggtgtttctttatgatatttagtgtcttgagtagtgtggccctatctttgtatggctgcaatattactgtatttaacattaaggataaattattggagattttgaagaagactgaatagtgatacaaatggttgttaccaagagttatattttttctccattatttgattttctttatttgaataaataaatcgaatagcttatgtacaaatcagtgcaaatgctgcagcaggatataaaagtgcatttctttacgttgaaggaaatggttagctttgctttaaatgtgacgagtttttcaactgaaagtagacataagggagaagtctctccataattcccaggtctacatttgctccaaatattcccaactctctgagagaggcacgccagacttgccgtcattcctaatgttttataatggtaaagaagggctttctaatttagatgaaatagagtaagaaaagaaactgaatggatatggaatccgattttttaaaaattttagatttagggggttcctgtgcaggtttgctgcataaactgcatgactctgaggtttgggcttctaatgatcccatcacacaagtagtgaatagtgtactcaataagtagtttttcaacccttttcctcctttcttccctcccctcctttggaatctcgtgtttattgttccatctttgtgtccatgtatatccaatgtttagctcccactgttaagtgagaacatgcagtatttggttttctgtttctgcattaatttgcttaggttaatggccttcagctgcatccatgttgctgcaaaggacatcatctcattctttttatggctgtgcagtattccatggtgtatgtgtaccacattttctttatccagtccaccgtttatgggcacctgggttgattctatgtctttgctgttgtgactagtgctgccataaatatatgaatgcaagtgtcttgttggtagaatgatttattttcctttgggtatatacccagtaatggggtttctgggttgaatagttgttctatttttagttccttgaggaatctccaaacttgtttccacagggactaacctcatttgcattcccaccaacagtgtgtaagtgttctctttcctccacaaccttgccaacattctttttgaccttcttatagtagccattctgactagcgtgagatggtatctcattgtagttttgatgtgcgtatctctgattagtgatgttgagcattttttttcatatgtttgttggctgcttgtaggtcttcttttgagaagcatctttgtcctctgcctactttttaatggggttattttggaatctgatctttggctcatgtcagataaagatacctttgtgaaagattgcaaacagcaaatctcttgctgatatgaaactagcgattttaaaacttttaatttttatttaaaattcagatgactttttttaaacaaaagattggtgactgtatgctgagtgcttttgaagtagtctacaaatcccttcagtttgagaaatactactcttggcagaagaacagaaataagatacataaaagacaatatgaggaaacaagaaaagtcagagttgggcatataaaacttcagggaatagtggtgggcccagatgttgtttaaggagtaaatgtaaagtttacaagtatttaatgttctggttatctgtgaggtaacaaaccacttcaaaacctaatggcttaagatgacaactatttatctcacaaatctttgtgttggctgtgtgctgctttgttcagttggggccacaccatatgcattcagcctagcttagcagaggcctcttggttttcctccatgtggcagtgtctcatcctccagggcctctccaagtggtatctctctagttggacttacttttaaagcatggcagctgagccccaagatgggtgttccaagaaggaaacccgaaagctcagtgcttgcttaaggtcacttggctaaaacaagtcatgtgcccaagcccagagtcagtatgagaagcacaaaggcatgaatccctaaggcatgtttcactgggatctaccagtgaaacagtctaccacaagtgtggaaagaaagaagcctgtcattgcaatgtttatatttcttatcaaacctgaaggacattctatcttggaaatgggacaagttcacactgtgatggtttgaatgtctatgaatgtgataatcagaatattttaaagcagtggctctcaacttcggctgcacagaagaatcacttaggggaacactgaaaactgcaggtgctttagattgcaaaggccaattaaataacgtttctccaggtatgagtatattttaaggctctttggcagatttctaaagtgccatcaaagttgagacagcactgttgtttctgagattgacttgaaggaggacagccatatattttctttgcaccactgttagaatgcttgcttagatgtgcagtgaataaaggatcaagcgtggcattctttatgattcttgtttggctccgtggttatgatttcttccagtgagataccatctcaatcatatttctccccttagaaccctaaaatagttaagtattttctcaagtggccttacaatatttcttatggatatatctgatttgagttcctcagttgtccttctctgatgttcttgtttcttattcatatctcatatagacttgtcacccttctgtgtctgtgtcacttcaaattatttgatccttactgtccttccacatctcagtcagagcagatgccttcctaatatctaagctatcaggcactttttcctgattgtccttcttcttgtaatgttctcataataattcttcatgactgcagttactcaaatgagttctataattcaacacctttttggttcctctgaacacataaaattaaaatttaaatgcataaactttcctatctgattggccacacctttaagttttttgtagtgttaatttatttcaaaatgtagtatgtatacctggtaaagtaaaacttttcaaataagtataaattaaaaaggaaatctctttccatggcgcacccacagtttcattccatggaggaaactattagtgcttgtttgtgtattcctccagaaatgtttttatataccataatatacatatttaaaaatatagcagtgtttttaagcataatgtattgttttgaacctttaaaattatttgatatatcttggagattttgtcatatcagtggttttaaaaatgtcattatagttcactatatggccataccataatttatttaaatgttcctctgttgttaacatttgcatgcttttaagtgttatttccaacacatatctttctgtaaatgtataaattactagtggggaattgctgggtcaaatagtctgtttccttggattttgatacctattgcccaagtgccttccaaagagatgccactaattttatattcccacaactgtttatgtgattatacctgttttcttatatcctcatctgcatctgcacaggatttaaaccaaattttattttttgctttagtttaggcctttactatctcttgtctggtctaatgtaatctgttttttgtttaccctcttatagacattagcagagtctggaacatatagaagattacctatgaatgttagaatgatagattttactgaattgtaggacataaaatttctgcttttgttaatcagtaacaaatatccaatgaaatataaatactgcatggtattactctgaaaacagaacccatgctgagcattaaagtagccaaatagtctaacaggcattatatgttttttaattagtttaagtttttatatttttgagttaaaaatcccagcaaagtcctagaaataatgcttgtatgatatttttcaccttagtgggttgtaacatactcaaagaggaagaatacatgaattttcattagaaatagtgatatgaagagttgatatacatgaaattaatatttatttttgaatcgtgttaaaagcatttttgcttgtattgatttttgtggggattttctcttgtatacaaacaatggaataaatcatgacaaaaagcttaacatatgtagtataatatttcataaagtcagaagaaattatagcttatataatgaaaaactgacattgagcagtattttattatattgtgattaaaaaatcatgactttacaaattacatttcatatctggctcctgtagtttttcttttaatatattgaaactgttttattaataaggaagtttcaacttcttgggaaccctttactttgaggcaaatacagttttcctggttcattattaaacttatctctcttttaaataccttgccaatttttgagagtggtggaaggtgtggaaagctctatgttctttagagtttgaagaaatatttattgtgttaggtatattaatagaaaattatttacttttcgtaggtgaaagtactgtgctataaaatgtctctccttttcaaaatttgcattatccatcattaattcaagtgaagtagtactttcaacatggaattgtgaaactgaagttgttcactttctatttagaagttacttctgttcaaggatatttctttttacctgttgcagaagagcatcttaatagctgccacatttgttgactattttctatatgccagtatttgcactagacattttacagatattcttttatttaatctttacaatagaacctttaaagggttattattgcatttatggctgacaagagtaaaactccaacagattaagtaacttggccagtgatgacacaaacttgttaggggtggagctgggatgcaaacctaactccaatgtccacaatcattgtatggccaaggatgactttcatgggattgaattttagccaacagatcaaaattctaaagaatttattttagtgtttcatcatcttctcaaaccttcagcttcattaaggttcagtaattaaaaatgggaataaccacattttatgatccttgttagaatacagatcactaaaaggcacaccattcagtttccttgctgaaagagtagtcaccaagatagtctcctaagttgagagcagaggcagatattaataatgtcaagttgctcaatcagtccttaagctgtgtggcttttaaggaattggattcaagaatgtgaattcagttgtgtggccacttctgggttggctatattttcccatttattaaattcacccatagttgtttttttttaaataaggggagcttgcatttctacctaaaaattacaaaaaaaaaaaatagatttttcatggtttctttgaaatgtaatttcttaccatgatatcttcaattatcacagtttagatgtattacaatataaaaatctttgcttagaaagcttacgtctttgaatgttcatctggattttatgttaagagaagaaattttcctttattttggctttaatgaaagaccatgtcaaacagtgatttatctgacatgtaaatagttataagccttgttttaattttatattttaaaacacaaatgtagtccgtggtatagttataatatgcattatatatgttgccctagtgtcatgatatttttatgaatcaggctttcaatttcaaaaatcagcttttgcttttttatgctcctgggttggatactgtcattgtctttaatatctaaggaaaatgtctcttcttgccattgagcccacaattttctttttaaaaaaaatcagataatgcttatatattgaatgataaagattttcttttcttttccttctttttctatttttttttttttttttttttttgagatggaatcttgctctgtcacccaagtcggagtgcagtggcacaatctcggctgactgcaacctctgcctcccaggttcaagtgattctcctgcctcagcctcctgagtaggtgggagtacaggcacgtgccaccatgcccagctaattttttgtagagatggggtttcaccatgttagtcaggatggtctcgatctcctgtccttgtgatctgtccaccaatccacccggcttggccttccaaagtaataggattacaggcatgagccacggcgcccaacccgaatggcaaagattttctaaagctagatcagataaatttctagcagctcaagaggcaggatttctatgaagttagaagtaaatttaaatttaagccttgattcatctatagacagatatttgcattgaattaggaattaggtgtacattgattttttaaaggtgtcaattaaacagtatgggaattggagttttaatttgtttcttttaatgtctcaggtcaggcaatgactttttcccatttgttattgttttgaatcttatatgttttctttagtgtgatgattagggggacttaactgccagctgttcatctttcttttttctttttctttttcttttttttttttttttgagacagagtttcactcttgttgcccaggctggagtgcaatggcacgatctcggctcaccacaacctccacctcccaggttcaaacgattctcctgcctcagcctccctagtagctgggattataggcatatgccaccatgcccggctaattttgtatttgtagtagagacagtgtttctccatgttggtcaggctggtctcaaactcccgacctcaggtgatccgcccacctcggcctcccaaagtgctgggattacatgcgtgagccactgcgcccggccttgttcgtttttctttacttgacaattaggttccctctattgccctctgcctcatattgtataaccctataacatagctatatgatttcttcctaaatatgcatctcagggcttgacctaccagggacagcatggattgttaactgctttccgatgttgacagcactgctgttgttctatccacctaaatctgatttagctaaaacaaaggcagtatatctgctaccttaagttattatatatagattcagtttgctttgtgtttgttcttttaatttggttttacagattaaaggtttgactctatctgattattttgtgtaaatgcatttttcaggtctgatgcataggcaactttgcctaaataaattagcttcctggctggattagcaaaagactcaaaattcttcaaaatataggagtaatttttttccgaagagctactaaagtggtttccattaaactggggaaaaatgaatattaaaaaaaggaaaattgatttataaaagattatagcactttctgaacttattccatagaggagataaacagtgcatttttactcccaataatagaagtgactgacgcatagcctcagttttttcttaaaacatgtttcatgtgcacataatgccagacagtcctgaacaatatgtggagcactatcaaggataattctcctgtttaaacattgaatctcctgtgcctggtgtatatatgtgataaatgcactgtgccatttattcaccttcaatacatgtgtatttttattttggaaagataatgtgtatgattgttgattagaccaacttttcttccatgcttatagaatagagtgaaatttttaatctatgtaatacttagaaaatgaatatgtggtctattcttatgatatttacttttttgagaccaagtttcttttttgtggaattgtagcagtctctcattgcctgaggtataccctaaattctttgtcccatgaccaagaaaattaaggagtgtggacactaagggtgaggctgtagcaagagtttaatgagtgaaaggagaaagctctccaccacagagagagggccccaaagagggttgctgttttacagttgaatatagaggcttttatgagaaatcagtgaaagctgggcatctcatttgcataaggcatgaatttctggtagctccaccgcatccttctagtgtgcatgcaagcccttagcttgagttactccatagttactccatactgctttgtttcctttaaggtacatgtgtcaggggatggaattttccattgtgagcatgtctgggcaaatctcctgtgtagcctttcttatctatgtggcagtgggcatgtcttaagcaagttcccccgtgcaaattcccttttctgtgcctgcagcttgatttctaagctcgttttttgtttgaaagaattttaccgaggacccaccctaactgcctgcctgaccatttccttcctcctctctcagaatgatttcttcacagttttgatagaagttttactaagattgaaagaaaacaaactttgaataaatagatgcacacaccatgtaactggatgttagtactgaattttatcatgatattaatctgggcaagttggctacctgaccagcaggctgaatctggcatgcatgcgtgtgtgtgtgtgtgtgtgtgtgtgtgtagttaattttttaatttacatttgaaataggcttggacaggacaggcattctgcagctgccagttacctccatattctcttatataaacctcatatttaaattcattccttccctcctccctcctgcgctggctcttagattcatttgagtttttgacagttttgtttaaataaatctaggaaggactgatgcatttttttttgtaattctgattaatattccagtgagactttagagaagggaaggaacaaatttacaggtcatctggatcatttaactcttagagaaaatagttaaatggagatttaccagtgtattttttaaataagcaagatgggatttggttaactgagagaagaaactaccttgcaatatttagctggcttgactgcaggataaaacagaggtcagtacatttgtttcactgagcagatggtgactgcacttgttctcaaagtgtggttgccagaccagcatcagtatcacctgagaggttgtttgaaaaatatttagccccatccaagacctgctgaatcagaaagcctggggttggaggccacagtctgagttttaacaagtcttgcatggtgttcttatgctgtctaaaattggagaaccactcttctgctgaatcttcttgctgcaagaagatcagtggaagacgtggtgttccctggattgaagaaatctgagttctgatcttaacctagcctcttgtcagctgtgtgaccatgattcctctagatccatatttcctaattgcaaaacaagaaaattgtgttatttgactttcttccaaatagtctgaggcattaataatttcaaaagtcttttatagtattatttcttcaaaacagcatattttggtttctttcattcttctctcctattgctatgcaataaaaaaaaattcagcctgaaagaagtaccatttaattttcttttgtttaaggggctgtgggaaattgaagtagaacatttatcaggtgcccttaggctacaaactaataatggaggaaatggccctgaatcttcctagcacctgtgggccttgccttagaagatgcctgacaaggacagttgaaatatttagtggtacttgatgtgctagagtatgaaaccaagtgtaatttcagcaatttcgagcccatcgaacttgcctagctagtgcagttagtatagcccacaaatggttatgaaggaagcagttaatagtaatggtttcctgtattacttggcatattttgaaagcaaattaattttaaaattttacttttaatgctagcttatttgtgattgtctttcctcccaaacttgatacttgaatttgtattaggtttccacttttaaggcaattctatatattttgtttcatattattgccagtgaaagctatcttatagtattgttagaacagtgaaacagaggtgaaagttctcctgctttatctggtcaatacccaacaacacctagaaactttcttccaaatctcactgattgattttatgttaagtagtacttaatacttatgtgtttaaaatacatatcagtacttacctgttttaaaaatatttaatattctcattataaaaacagtaactacccattgtagaaaattcaaatattattggggtacataatataaaaagtaaaagtcctttggaatccactttctctacttttgcccaccacccatggtaactattgtcattagcctgaagtttgtcataagttcctttatatttttttctaaattgcactgttaaaaattttagtgtactatactcttaatgtactattgctataccttatttcatattacattcacagtcaaaattttgatttccttgacaaatctaagacagaatagctagcatattggtgaaattttgaattcatattcatcctcataacaatgaaatgcagacatcagtgctgttataaataaaaaccagaggaactaaaaaaaaatttgaggaaataatcagcaaactaactttgttatgctttgcaaagtaatttttctaaagcttatgaagttgaaatatgcccttttgtaaatcaaaaaaaaaaaacaaaagcaaacattagagattatactgaggaattgattgaggtaaaatattatccagattcggtttagaaattaatggtaatatttctgtaggaaggtctggactggagtattctgctctctgctgtttcttgtattttctttttctttttttttttttttcacattttttattttatttttttatttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactgtgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattgttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtcttttgttggtgtataagaatgcttgtgatttttgtacattgattttgtatcctgagactttgctgaagttgcttatcagcttaaggagattttgggctgagacgatggggttttctagataaacaatcatgtcatctgcaaacagggacaatttgacttcctcttttcctaattgaataccctttatttccttctcctgcctgattgccctggccagaacttccaacactgtgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccggtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtagcagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttactgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttattgcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgtggtgtctttgttctcattggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacgtttgctgaggagagctttacttccaactatgtggtcaattttggaataggtgtggtgtggtgctgaaaaaaatgtatattctgttgatttggggtggagagttctgtagatgtctattaggtctgcttggtgcagagctgagtttcttgtattttcaaaataatgtggcaacgttctttgagagagtataccaggttaaattgctaagatgatcagtcaacaaatatttttggcagatctgcgatgcatgatgcgatattttgagaggtttgtgcaagatttttatttccctcctcctttgtaggaaaagatccactactcatacctactgacatcccctggcacttctagaaccagcttacaccccatcctctgctcacccttctcccaccttccacctgtattaacacctgacaggcacttatttccctatcaggagtctctgtagttgttttgccattgaccaagatatgtttagaacatttttaatctcttgtgcaattttggcaaacagcagcctgagctctgcttttcctaacaaataacttgcagattgtcatgtttctcttgggagaaggagaaaggttcaatcagagcagaattgaaatgatataaattaggcttattgtttagcaaatcgctggtgttaggtaagaattgtagataagaatagcctagaccctcttaaagatcagagcaggcatgtgtgcatgcatgaggaaaccaggcctttgttagtatcctttctgaaatggctattaaagtaattacagtaatttatagatttttttttcttcttccatttcaaaatgggttccattttttgccttttgtcttgagttcctcagttggagtgtgtatgtgtgtaagcatgtcttgggtagcactgccatagatagtatctatgaattatctgcacccaagctgatgaggtgtggtgaccacaggcactcacagatggatttgccagctttgctttcagggagccttggtcctttgagaataagagaattgtactgagaacactatgttttaatggttagttatagtttgtcatagcaccatttaaaattgctgtgttttatggacataaagatggcaacaatagacactaaggagtactagggcagggaaggaggggggcaagggttgaaaaactacctgtagggtactatgctcaccacctgggtgatgggatcaatagaagcccaaacatcagcatcatgcaatacccatataacaaacctgcacatataccccctgaatctaaaataaaaattaaaattaaaaagttgctgttttttatttaaagagacactttttcccatgtctttaaaaacacatccattcatacctatggattttattattatactttgttgcttttttatatcattgatgcttgtgtataagaatggcaatactttatgtgtatgacttttagagggagactttaaaaattattgatcacataagatggtatgtgcttattgtgcaagacctgtaattttaatatgctggaaagacaaaagaaattttatgcactagtctttttctgtatttgattttataaagtaacttgaatagtttcaaatcctaaggcttccttttaacaatatatgcttattttaccttgtctttgcatgaacaaaacaattagtaaaggtgactttcttcctaagaagttcattttgaatatggagattaggcaatttctaaataagccttagaattagtattgcttacaacagtagttattaatagtattatttatatataacttagttttgaatttaaccaaatgagatgtttactcacatacagacatttcacaaggcagaagacgtaacatatgttatttcccttctttaggagagtcagtcctgaaagagttaaggttttcttgttctggagatcaagcattgtaaccacagtaaccaatttactgttatttgcttagtcctagcagagaagaaaagtcagagtttggaaaaaagtctaattcatagacaagtacaactgcaattgatcccaatacattaggatcctgaactgtaattaactatttgtggttgtagggaccatggttttaatcaaatattttgcattttatttttcagatggtttgactcctcagcaacaattcaagtttaatgtaaagaaagtagaacacagtttatattttgcatttttgtaagggaacagttgacaagcacattttcaaggaagcagtaacagataggatttaggataaataatagaaaaattaaatgtacattacagaaacttcagttcctccataaaattacagtaatgttgagttttgtaaaagatgtgaatggtaaatttatgacttcccattgaaatgcaacaaatggaaaatgattgtattttgtatggtttatataaaacaacacgtgttacagctatctctaagaaatgttggaataagtaaatgagtgtatgctaactagagtggttagggcagttttgaagaaatataattttaaaattaatctgttccaagccccagctcctattctttataaattttctccctcaccttggatgctttatgaagaagttgattttattgttttgagtttacatatatatcaatgttaagataatttccctcttatatctgggagaattttgtgtaattgatatgggtagatttatgaataatatatttaacaataatcatttgaagtatttaacaaactggtaaaagataattttctttttaaaaagggcttattgagtattttgctttacttttaaatatatcagtgctggcttctatataaaatgcaccattttcctctctaccattcaatgaaatacagtttagagtctcttacggagtaaactggattagtcatctgcatactagaccttactttgcttagaattttacagtttacaaaacatttttgcaaaaacaatgcaaatatattgtttttgcaatatatatttgcaaatatttgcatatatatatattttttttcttagagatagctgtaacacatgttgttttatataaatcatacaaaatacaatcattttccatttgttgcatttcaatgggaatagtcataaatttaccattcacatcttttacaaaactcaacgttactgtaattttatggaggaactgaagtttctgtaacgtacatttaatttttctattatttatcctaaatcctatctgttactgcttccttgaaaatgtgcttgtcaactgttcccttacaaaaatgcaaaatataaattgcaatatatattcttataatctctactattgccttggacagtaattgaagccaacattatcgttttggaccagtgcagtagcctcctaacctctctgatctcctttcaccctgacttcctcttctcttccacgtaccccgctctcatcccagttagaatgaccctttagaatgtataaatcagattatgctacattttgctcagaaccatttaatgattttcgatctcacttagagtagaattcagagtgcttgtcatgggtgtcgaccctgcctgttcctggcctcatttttcattccttttctctaccttccttgactctggccatattagcttcagtgctgtgctttcaacttgtagtttccctaataggagtttttgtccctgtcttcctctgcatgccaatctctcactgatattccaagtctgcctggactcctcttgatttctgcttggatgccatgttgtcagagaagccttccctcaatgaccctgtctcaaatagcacctttcttcttctgtatctattatgctgttttgtttttctttattagcacttaatacttcctaacattatgtatttctttactgtcttccttccatgagaatccacgctctgtgaggatgggaactttgtactttgtcctcagaattctcaggacctaatttttgcatataatagtccatgtaattgtttaaaaaatgaaaattccaagaactaaggctgaacaggcgtagaaatcacattttcaaatagatgaccaggagcaggtttgggatatagtgtggggaggcagtttggactcagcaaatgctggttattttgaattattttagacccttctgattgctcatgtattgtatgacactttttaaaatctgtatttatggataacattagggacaaacacctacctgtctctagtgtcttctctcccacttgtgctactagcctactttttgattgctcttctcatcagatatgattggaatcatcttttaggaaaatacactttgatttataactcagaacatagtaagaatacctttgcataagccctactatgaaaatgttatgattttattgtggtctgtatttctaagaagttacccatagccggaatttgctcagtatgctttctgtcttcttgggtgtatttcagtattactcttcagttattcacacttgggagtaagggcaaaaaagtgtgccgaatccttccagtaagaaattgtggcatttctcagtgctttcacagatcagcaactctttccgcttatgacagtattttgggaagaaatatttcactgaatgttctctatatgtctaaaaatgccaatgtacatcctcagaatgggtaatttcctttctaacacaaatagctattacccaaatgtctggatttccacaagcctgaggttctcaaatcttcctgattttgtttatggaggatgattttgttgggtaacttaaaaatccaggggttaaagtaactttgttcgtaaatacggataaaaaaagtgtcgtataatacgtgagcaatcaggaaattaagtgtactgcataaaagtatgttttagttatcagaaatttaatcactaatcttggacagttttataaaatttcctcttttcaatgaagtctgttatattaaatattgatcatggatctagctaataataatgatagtggtaataattgaatggtcaggtgacagaaaccatcctaagacttaacaaaatgttatctcttttaatccccaaaacattttataaagtgaatcctcttaatcctattttgagttgaggaaaatgagatttaagcttctttatgtaaatggagctggaggagccaggattggaatccaggaactcctaattctcaaacccaggatctctacacaaggaaacctccatgacttggctgaggttcttaatgatgatcccattttctctgtcataatacagtgctgccttctgagtctactaaagcatgtaatcctctttgtttacctccccattttaaagtcccagatatcaagtaattctgcttacttggctgtctcttctagttatttcttagggcttcagtttctggcaggtgccctcaatgtgtagactctgttagctccctgtcatctgaggagaggaatcaaataaacaccatggttaaattagggaggctaattttttctatttaaaaatctttctggcttgcaggtttctccacttctcttgggaaaagttttatgacagcatgtttcccagaagcctgcatgctggagcaagaagcagcattgtcatatttaactcttctaagagaaatttacttttttcccacttgtttgttcagcagaaattctggaatttatgtggctttgctagctagaaaaaactcttccagtaactaaatatgtggtctgataatctcctgacatacagttttcttcttatttgaccttttctttaaggaatattattgaatgacacaatctcttgagaaattttgctgaaatgctgagataggattctatagatagcaattacagctgttgatatgttttctagctttgggactaatgtgagtgagttacaaggggagttgaaagccttgagagtttacacgtgtggtttgatgggatgacaagcattaattaagatttttaatatggaggtgatttattgaaaatagattctggatgaactctttggcctcagaggtgaggtaatagaataatttcctctttaagttacctgtataagcacagaatagattattagtgatggaacatcttcatcattctgtggtagtctggctgccagatgtgatattttattatattagttagttcttaagtaggcaagtggccatttctcaaaagcagaattgtgtggatatttatgactccctttccaagcatattccttttttccccgagacatggcataattgtaaaactttgccttttgtataataaaacttgcctaccgttctgtggttagggttagggaagtgggcagtttgctaactatttgcctggggtctggtaggaatttaagttgaaccagaggaattcggatatttgggggtttgccttcaagaaaaatgatgcctcttctcttacctccacctaagggaataaattctaagcccaggagaggagggttatgttaaatatgcctgggccatggcccagagaccgcaaggagaggatggcatacataatgggggtgggtaaaacaggagtgtgtatgtgatatggaaaagagaagtgagtagatagcaatgcctctgtgagaacaagaaggaagccaaaggattacatctgaacattgcatgatgtatccttggcagcagctttgctcagtgaagatgataaataaacctaatggtatgttcattcctgttgtagataaagttcactttcagattggtgaagtctaagaattaaagtccagaaaaacaactttgaataagttgcacagaacattatcagtttacccagtagagaccaaataactttgatggttagaaatcatttgaaataggagtagacagatcattttttttcccctggagctagaactcatttaaatatactgaacatttaaaagtattgtgccatctggctagcacccagtcctcctgatttcaggccaataatctttctgctacactactttaatgtgtatgttggggctgtgggggtcaaggagtcagagagagagtaatgaaaggaaacataaggtttatatgaatttaaaagaaggtgactaagaacatgtgttattctctactcttagatcatcatccttccaggcatagtggcccatgcctgtaatcccagtactttgggaggctggggcaggaggatcacttgaatccagacttagagactggcctcagcaacatagtgagaccctgtctctacaaaaaattaaaaaaattagccaggaattgtggtgcatgcttgtggtcccagctacttgggcagctgaagtcggaggatcacttgagcctgggaggtcaaggctgcagtgagccatgattgcaccactgaactccagcctggtgtcaaagtgagccactgtgatatgctttggctctgtatccctacccaaatctcatcttgaattgtaatcctcatatgtcgagggagggaactgtaatccccacatgtcgagagagggaggtgattggatcaagagggtggtttccccattctgttctcatgatagtgagtttcatgagctctgatggttttataagtgtttgacagtttctccttcacacactctcctgctgccttgtgaagaggctgtctacttccccttcagccatgattgtaagtttcctgaggcctccctagccatgtggaactgagagtcagttaaacttcctttgtttataaattatccaatcttgggtagtatctttatagcaatgtgagaatgggctaacacaccctctatcaaaaaaaaaaaaaaaaaagatcgtcatcttgttcctctatattctgcttccttgtggtcttattgaaattcagagttttgcaaaacatttcttgccaacttggatgttatcatgtggtcatttagtctgctgataattgagagccatttaatattttgaagcagtgaaataacttagtcacttttatgttttaggaaaaaaaaagacactggctgaaaggcagagattaaattggaattgagagagtttgtagaaatgaacaacatttaggacaagtgcaagtcaagaccctaaccaaggcagtgacacgaaaaatgcagagaggtggtaaatgtacctgaaaaataatttcaggtagagtgtgtagattttgccaggtggttgtacatggatgatagtgtaaagtgcagtattggatggatctgaaatttctaatgtggttaaggaagtaagtgacttcataaaactagaactagccctgccatattcccctctctcatcacccaccagtagctcactgccaagtcctgttgatggtcgttataaaatatatagtgaatcctccttacttacttaactgccatcatgctagtccaagctgccatctcctgcctggacttctgcaatgtcctcttaattgatgtcctggcacctgctattcccccttcccatgcattctcctatgactgtgccagtcatcctatgcgtacgtccgatcatgttactctcctacttagtattctgtcatgagttcttattgctcttaagatgaagatcaaaatctttaccatggcctacaaagctttatactttgggcactgcctgccgcctcagcctcatctcaaaccactttattatgtgtacatggggctctagcagttatattcatccttctaggtgcccagatcttttcagacttgcaacatctgcacttctattacctgctggagatgctttaacctgtcctcttcatggggtcaacttctcctccccctcaggtttctgataaattatttttttcctcagagatgccatcatcccctggaccagtcttgcccattttcttccatactttaccttctctatataattatttttttagcgagttagctccatgcgaacagggattatgttctatattttaaaaattgccaagtcctcagtgcagtgtctaatacatagcagctggttgataaatttatttggggcagatgaatagtggctttaacagaactgatatgcattggtcataggggtcattaagaatatttagtgagctgtctactcactagccatcacgtatgtgtcttaacagatgacataatggcaagtcgtgttttacttggctgtttttgtgaggaccagaataatatagtgaaacatggaacattctgatgatctgatagaaaagtaaagttcagaaactctagaaaactgaagacgtgtctggtaataacatggctggtaatctttgccttttgttatttcctaccaaccactgtattaaataaccagggcttcatcattacaatcaaatgcctccttaaggaagcccagggttgtgaggctagtaagtggtagagtggatggtattcgaggccaggtcccactccaacacctgggctcagacacttgcctattgaaactagaaatcataaagtgtttttgcaaaaatgttttgtaaactgtaaaattctaagcaaagtaaggtcttgcatgcagatgactaatccagcttactctgtaagacactctaaactctatttcattgagtggtagagaggaaaatggtgcattttatataaaaggccccattgaatgaattgggttgagctgttttgtgaaggcttgattgtgattgcatggctgttatttggcaagcagagaattcctaatttcctctgctgtgagactcccaaggagacatttatattagtaaaactgaatttgcaaacctgcattttaaaatttagctttatttgtattccatgtctctctgggaggtgttcagtacattatgaaattctgtgcttttacctcctgctaaggatttgagttcttagcctaattaatcattaagtgttgtcagtctatcatgatgtggttaattatcagagagagtgtatgtgtttcagacagtcatgaccctttcctgggtaactatagaaaccttaacagtactagttattatctaaaattatagaatttggttttaaagcagtttggcctttgatagttatgggcaaataatcggttatcatctagaaagaaaggaaagcctgcatgaaacagattttttaaataatttatacataatagaagtgtgttctaaataatttataaacaacagaaatgtgttctatagaatatttctgattatatcttaaaaggctttcccccacactagttctgtttatttgttatgaagctttctcacaaacaatctctttttcccccaagaatgtttagaacgattttaatccaagactagggtaattcttaagactgccatttggtacagtgatcttatagtgcatagaagctacgtatctgagtggaaaaacagacgcatttgggggcatatacatatctgtgcagttacagagaccagtattgacaatgtgaagtatcattggtggattcttgaagccgtagctctttaaagatgggagcaaaagaagaacatgtccttttccttttttcaattctgagaagttccatctgagccagaaagaaaaaaaaaaagatatgtcattgcacctttaaatgtgaagctcggcaaggattgctgtctgaatgggggtgaccatcaatatggaaaatggaaatctgtcatattttgtacaatgctttgcatatcacatcattcagagaacaggtaaagtcccctttggagaaggcagtgcttgaagagggttttccactctcattggtagggtggatttcagtggtatgtaatgataatgatttgcttccatgttacaacatgtgaacagcttatttatagatcatgagctgcatccctctttcctctttttgtgcatgtttgctttcaaggagaatatagtgacaaaaattttaatctgccttttagctcaatgctaggttcttggtaatttgttgagcaaattaatgactttcatgtacatttacagataatataagcaaagtatcataatattggcacaaaaaaacattaaggttcaacttaattctgtttttcaaaatatattttaataaaactatacatgtaaacatctgtacttgattttaatcattttgtctttatactgcataagcttaattcataaagctagtctgtttccacaattgactgtatcacagaataaaactagctttaatgttgatgtttacttttcatatcaaaacgcaaattaaagattttggcaataaggattcagctgtcaacttatttgatgtacaagaatggcaataattgctttccattgttgagcttttactaaaaacactgaagtataatttgtttttgatagaaatattagtagctacagatattaatgatttattggtttgaaaaagatgctttttaaaaggtttctaacctgtagtaaccaagtccagtaggtatgcataatggacatacctagccagaacatcatacatgctctttgcatcttaatatatatatttttagtatgattttgctttgttgaaacaaagtgcttaaccggctgtttatttgttgttattgtggcattataaattgtgccatttcagatctcttattatgtgctaatagtttttccagcttttattatcagattctgctcttaatatttatcttgttcttttttactctacaagttttcaagctaataatgatgttagaagtttacttgatgagaaacaatgaaaattaaatctcttatttaaaacaacaaaagtcacaaattctgtgagctgagagcgtgttaggctctggaatggagagtgtaatatcactggtttccttatgccagaatgctgatcagcctaattatccaagaatcttctggttctctggcatgctacagctgtgactttctctttgtctctgaaataactgtctgccacactgcatatgcatgagagaatgttttttatatcagtaattcacttatgagtttcattccttgttaaaatgatggtgtttgcttaatttaaatattgtgtatgtgttgtatatgttatataatatataccatcacatatgtattacatatgttatatattcatgtcacatgtatgtattgtgtgtaatatagacacattacacataagtattatatatgtaatatacacattacatatattatgtaatatatagtatattcatgttatatagtatgtatgtaatcggtatgttattacatatatgtaatatatataaaatgtataaatagctatatacgtagatacatctgtgtattaagacactccttgttgtttatctgcttgagtagagtatgccatccatccatttgtaggacattaaaaaccagccatataaaaatgaaattcagtgcaagtaaagctatttcttatatttttgtaaaaatgtatattttcactatatctttttcaaataggcaatgtattatttatctcttacagttttcttactttacttggttaagtatggctgtttctaatgcagtgttttaattttttatttccatactgttggttattaatgataattggagccacacaaaatgctgttcagttcaaatttctgacaagaaagtgggttttctgacaaggagagtgggtcttccagatctattattctttatcactttcaaaagagtgcttattccttgaaaatttctgttctatctacctgttgtattttcaacaggaatttgaattcaacaggaagttatctgtgccataaactctacttttcctgctaagctgctttgtcactggaagaatttcaactgactaggcaacttgatttgtctttcaatgatttcatatctgagctcttcatgcaatggagacaatgcagtttagaacatggttgtgacgttatagaatgatcaaactgacccaaatggagggaacctggtgtaatcataatcagtgtatattagtcaggaatagttgttggtaatgcttctttttctgacttgtagacagcagtcatcttgctgtgtccttatgtggcctgttctctgtgtgggtatggaaagagagagagatctttaaagtcggttcttttcttctaaggggaccaatcttacaggatttgggccccacccatattacttcatttaaccttaattacctccctcaagggcctatctccagatatagattagggcttcaacactgaattttgaggaacagaattcagtccaaaacacagtacaaatacctacagagcactttctatagattggtgcaaaagtaattgtggtttttgccattgaaaataatggtaaaaagaacattacttttgcatcagcctaatatgtgccgaacactcatttagggacaacctactttacaaaggaggaaactgaaatcccaagaggttaaatgtctcactcaaaggcacagtagtaagggacagagttgagattcaaacctaagcagcctggcttcagggtccatatccttacctattagctattctgcctctaaaattgtggagacatatttagagcttttccttgctaaatttacttagggtatcatcttcgatgagatttcttttggctttttggaatacagtataaaaactagtttccagcgtttttttttctttgtaattcattctttacctattgtaacagttaagagagcagactctagagactgagttcctgggttcagaagtgtatttttctggaaaaaagagagaatagaatcaacgacctagttgggatgttgtgatactaaaatgaaagaacacatagaaagggcttagatgtgggctgtctgcacacttgataagcgagtgattgttaaagcaggagtagtaaataaagtgtgatctacctacctgcattagggaaggcttaccttttgctttgttgtaaatcctacatgcctactctaactagtggcaacacaggccttcttcacagagttcttatgctctggcaaacctgtcagttagatctttactaaatggatttttttttcaacttttttgtccttaaatgactttgaagatgcgagggctatatttttgttcgtttttggcttgtagattattggattcctgttaaaccagatgatccttttaagttgcatgcttaaaggacaaactatacccttctggtatacaaatagtatacagaatagtacttgcccaatgtggggacatggcatgtaagcattcatgtggtgtgttaaatgccacggatggaggaactaattttactttggggtattggaaaccaacagtaagaagagaaatcatttgtgttacgtactgaaggttgatgttgggtaccaagtttaatgttgttggaaccaaactaccaaggctaacattgcttctgggggcaattgtttctgtttaaggccacttatttacaaatgtgactttggtacctagcccatttataagttgatacgattatttttataactacttatttgttacccacctttccttgacaaagatgagattgctggtcaagttaacaatgagatttttcatcaatgatttaacatttgatttatactgttctatcagcattctttctcaaggtctactttgacaaaagccgtgtatttttacgtcttgtgttaagagttcagtctatgaccatgaaagaaattaaagctatggagcttccatgaaaatcaaactcctaactttggtctaacaattaaaaaattaactacagtaaccataaaactctaataatcaatagtagtatagagaataaattatgaaacagataaactgaaagaatatatacccaaactctaaaagtgtgattgttttactcactgaacatatgaaaagaaattatttttctaaatgcttaatcagtttttaactaatgaattttcattagtctttgatggttccttcttgtaatgctcctttcatcattgaaacttctctaacctacctgtttccctaggaattatataaatgcatctgttccccgtgtaatctggcacctctctatctctctaacatacttttcccccagcccctcctttaaactgtagatttccatcagctgaattatgtgccagcccctgctcttacctctgctcttggctgtctcaccttcgccattccaaacatgacagctcttcccctttctggactcagcttagaagtcaagtctccgtgtccatccttccttaatatgacactttaaggttggatagatactcctgccataacctaccaaacccataaaaatacttgctgttctcagaacccttatgagagttatgtgtattggtctctagtccccttatctaggccactggactgcttttcatccattattttatcccagtcacttgggcccagtgcccgacatgcaggaagcactcaagaaatagaaatgtgttgaataacttagtaagttttatttatttttacctttttcccccatattgttttaattattgaactgatagccagggtcttcactgggtaccattcaaatatcaaaatgggttgggtgtggtggctcacgcctataatctcagcactttgggaggccaaggcaggagaatcatgaggtcaggagtttgaggccagcctggccaacatggtgaaacccccatctctactaaaaatacaaaaaaatagctgggcgtaggggtgggtgcctgtaatcccagccactcaggaggctgtggcaggagaatcacttgaacccgggaggtggaggttgcagtgagccaagattgcaccagtgcacaccagcccaggtgacagagtgagactccatctcaaaaaaaaaaaaaaaaaaaagtagatgtttgaaaccaacgaatcgctattctctttattttgggcatcacataaatcatatgaggacgaggttatgcaggtgacaatagaaactggtagatggtataggataacaggcacagtttgattctatgggattttacattcaggaaattcatggtgtcttttatgtagacttaatttcctactcctggagtttctttattttgaattctgttggaatctgtaaaatgagttcctgtcaaacaaaggatggctttcttgtgcaaggtgccttgagcatgtcttctgtttgcttgcttttggtcctatgaattactgcagcccggagctccagtgacttgcatacacttcagagtccacacagtggcctgaattgactgccatctcatcggatggcaataagcttaacaatctgaaaaattcctgcactgcaggattaccaggggaggtcactggaacttcatctggctaataagttttttgtcctgtttccccttgtcagtgttcctctgagctccttaggttggatttccttttttaacttaaataaaaatcattaacactgattttctttagtgagcgaataacaaaacaccgtatctaaaacaagagtcatttcagagatggtgtatgacattaccaccaatgcaatgagaaaccgtattcatcatgatacagatgccctggggatcaaatactgtgaaaatcacaagcatttcgctctcattctcaatgtaataaagatgaaaaatatcaataaaactaaaaagcatttgccagtcgtacactctggaataatcgtgacttaaagacctgcttagttctctggacgtatgggatgtcaatgttttgtttctttagagtctagatcaacaacacgtactttttttgttgttaacatagctttttatatggctttattaaagttgaaagcagaaatcatttttattgcagcctaggagttactcagcacatctttttgaatccccttcatgtgctatttaggaagactacacaactcagagtgctgccattcctcagccttggagtaagagatcacttcacctggggcatgtttgacttgctgccccagggctaccttggcactcatccgtgaaagtacctgatattctgtttcatggtttatcctacccctcacctgttagagacccctcaacttctgtcagccttttgtgtgttagggagaaaatctgcttgctacatatcatcaggtgtgaaggtaggaatgtgaggaggaggtgtatctccagcccagttgagaaattatgttgtgaaatatatagtctcagcaccattgccactggaggtggcaattctggaaggcagtctataactcagagttttatctagtcatacttgatctcacctcttagaaaacaggatttctggagagtcgacatgatactagcaaaggtaggccttgtttcccatgaccatgtaagtgaaagagttctattttcacattttagtgtagccaattcatgttcaggtatcagaaatttagaccatcagtatatttctaataggtggaatgtaactctcctctaccactgttcaaggataaaatatactgtaaatttatcagctgtctttaaaggaaaatgactttaagctggactcttaacaccaactttttgggcagggttgaatatatggacagtagtattctattttctcgctcctgtagaccttgggtgggttgtcccattttccagttttctgtcatggcagagtgtggctattgaactggatttgtccattgatcctaccagacggagctcctgggggcctcctgatcatcatctctgcacttccgtacagtatctggtctgtattagatgtttaatccatgttttgtgaataaacttcctttcataataactcctgaatgatgtgtgtgtccagttggctagaaattatgttttgtaatggttatgctcatgagaatcccatgtgtctagctgaatatccacttgtattttactggatgtactgggacagtagaatacatatagtttaatggactctgttggaaaggcaaacacccttaacagggaaagtggctgagatacgctgatacttttcaaagaagatagccactgccttccagcctgacattctgtttcaacagaatctatggaacatattcttcctcaacagccctacactgttatctcatagggattgtctagttcctttgcaaaagacagaggcatagacctcacattgtacaaaaatgacaagctgcctgttactctgtggataattttgtcattcacgtagcagagttcttaatcagacctaaattattttgaagatattataagccacccaggtgcagatgatcttttcttatgttttatcaaatattttagttcaaataactttaacagtctttggatgtcccatcatttctgatggtaagatttctttaagatagaaaaatgtgtgaactcacagcaaggaatccagaatcgtagctccagatcttctactaattattacatggtccagcacaaatcacttaaaggtactgggcactggatttgtcaccttaaaatattgaggtgagatgattgcaaattaggaaggaaaagacaagatatgtaaattatgatgcaagttagaataatagcaaaataattatggatatatttttcaaatatgaagatcatagtatatttgacagcattttgcatagtatttttatacaacattatgtatattatattgtataatgtgatgtagagcatttcctctactgctgtatctcatgaattaaaatatagatttttagaactttagacgaatttgtcatacattcacttacatttttatcacttgttcctgttaggcagttgtcatgttctattattaaatggaatataattttattactattgctattattattttatagtcagggcctctctctgtcatccaggctggagtgaagtggtgcaatcatagctcactgcagcctctaagtcctgggctcaagcagtcttcttgcctcagcctccagagtagctgggaccataggtgtgcaccaccatgactggctaatttttatgtttttaatttttcatagagatggggtctcatttggtctcgaaatcctggtttcaggtgattctctctccttagcctcccaaagctctgggttaacaggcatgagccaccacaccgagtctggaatatgttttttgagtaggtgaaatgatttttattttgtgacaaagtattaatgtttgaaatcagcttttaagatactgtaacaattatgtcaaccacaatgtagcaaaaattggaagatgttttatatttatttaaaatccatcagaagtagtaaaatccttaaaactcacatacataaaacaactgtataatttaggaaagtgatgtcatgaaggtttgattttaattctgcaatgaagcaagaactactgggaaagccatcagcctgaattctgcaatttttttaagatgaaaattaaatgtttaaactttagataaaatacctttctaaatctagtctatttgttctcggaaatttttagtctgttacattattcttgtcaatattagttttagtgctccatatcattacacatgttatttcattaaccttgtctacataccaagaacctgtgacctcctcaagtcctttacataaattctctaacttggtgaaggtgaatttttagttttcttcttttttttttttttttaagacagagtcttgctctgtcacccaggctggagtgcagtggcgcgatctcggctcactgcaagctccacctcccgggttcacgccattctcctgcctcagcctcctgagtagctgggactacaggtgcctgccaccgcacctggctaattttttgtatttttagtagagacagggtttcaccgtgttagccaggatggtctcgatctcctgatctcgtgatccacctgccttggcctcccagagtgctgggattacaggcataagccaccatgcccagcctctgatgtttttataaaatagttcatggaacaatttagacctcttgagttgcatttttctaccagctctttatctctggttgtttgttttgcagttaaaaacaagatagtcagggtcctgtttgaaaacttgctttctagtcttgagtacctggaattctgcctaactgtttcatgaagaggggttttttatagtctcttcaattgaagttagttaactcacagctctgtttttgataaaccagcaaaatctttgaatcattaaataacttcaagcgttgggaattatttcatttgcagttgaagttcagggaagagattaagacgtggtgtgttataagaagtgttctgggtgctgatgtttacattctggtaccagtgactgactgaatgaattttataatgtggagttgacaccacctgttcccaaaagcaccatctaagagtctgccaatttagtagacccgtatggatgaggcatcctctgaaatagccaattactataacagagaatgagtttttcctaaaatcctggcctctaggttgttgtttttattttttacttcgtatttcgtctttgtcagcatcctgtagagtctagaaaatgaaaacactgtccgcttattatttgagtttatagtataaaagaaaatgggctgggtgtggtggctcacgcctgtaataccagccctttgggaggctgaggcaggcagatcacctgaagtcaggacttcgagaccagccgggccaacatggtgaaaccctgtctctactaataatacaaaaattagctggacacagtggtgcatgcctgtaattccagctactcgggaggctgaggcaggagaatcacttgaacccgggaagcagaggttgctgtgagccaagatgacgccaccgccctccagccaaggtagcagatctagactctgtctcaaaaaaataaaaaaaggataaaaaaaaaatgcctcttcatgttagaatcagagcaagcccaaaggctttcctttagtcatttggtggttgtgacattgtggacactggggtactgcaacaatcaaacttttaagttgacccttgaccacagtgaaaatcatagcaattacttttgatctacatttaggtctcattctccatagaattgtttcataatatcactttatgtagtattgtttcctattgatatcttcttagccatattatatcattcccctcatagttataaaatgagttgctattcatgataataatcctggtgcagtagtaaggaaacattggtggtttacagaatgaatttctaacatagttctcattgttttactctacttcccaaaataaaagtttcaaagaatcagaagattttaggtattggatgaatctcagaaaccattttggagaatgaggcttactttgctgttgaagaaaggactctttttcagtggcttacctgaacttagtgagttcttgacagtaataactattgattccagttttctgattacttttaattaaattgttctttttgaattgcctcacccttttaaaataaggattgtgcccataatcagattttgcaagggccagagccattatttcattaaccttgtctacatacctattattacatcccgattattgtagtagtagaaactggaattgcctagttatgatctcaacttgattttcactatttctatttgcctatgtatttattaatccacatcgcttatgcactttagaacagagagtgaggagctttgtatgtggatgtgtttaaaagttcctaatgttgataatcgttggtggtaccttatactgtctaaaatttatttttatcacatttactaaaatgcatacagggatatggcttcagaaagaatgctagactcttttacatttaacaaaaagttctctggagctcatgcccttgggaaacttgataatgaaagtcagaagagtgttacaaatctaatttagaaagattttaccaatttggtaaatagaaaaattctgaatagtgaatctggtagcaaatatacatttattagacttttgattggttatggatatgtgctgaactttatgggtaaaagcacaaatatcagaacatattgtatttcacctatcatattttttcttaaagtgcttaaaatattatccctttgaacctgcttcactgtttttgcttgttaaagaatatagcaataatggctttaaacttgaaatcttaaaataaatcactgggaccagaacttttgtatttcttctcaagttttatattgaccaaagaacaataatatgtatgctttattttcatagtgctgtataataaagaaaaccagacaaattcctgagtttccctttcaagtaagaccatttttttttaatagctagagaaactgaagaagaaaacatttggaatttaggacttcccagcattctatctccaccactgtccattcttcagatttcaacactaccaccaacacccccacaccaaatacatgtacttcaaatattgtacctaaaataaaaactcagtcctatgatgaagtcctgggctttcttaagtagtcaattagaaaggtcagtggtttctaatgcagagagtttatgacctggtgtgtttcagctaatttcgattctttcagatgtcttctgcgcaaattgcttgattacctcctacatctctcttaatctgggttactgaacataataataaggctttacctatttttttttttttatagacccgttcatcacctgaatcttttagcacttcaccaacagctggtaacaagcagaatcactgacattcttttagatttctttaggctgctttttaatcctccctgattgtcatgagcaggaataaggaagggagaaggaagaccaattttttgtttaatccaaggtgatcaaaagaagtccccagtaatagtacagactgactttgacagtgatttgtatttgcaaaatatatgaggcttgctgtattccactttttctcttttttttcctctttgacaaaaacaaagttttcgtttcatccagaatatttcatttatattttagaggactatttcccagtccctttatcatgggaatggcttgtctattctctgctacttcatttgacttttaaagagtctcagcctttcttgaaaattaacagattatttaattagttatacatgttttgttttgttttgtttttcagtcgtaatataaatatatatgcttgtaggattgtaaatctggaaggtagccctttaagtgagggtattcccagtcgaatctgttatctttttaatattctcacttatcattgaccttttttatttttatttttttggtgagaaagcgtctcacactgtcacccaggctggagtgcaatggcgtgacctcggatcactgcaacttctgcctcccaggttcaagtgattctcctgcctcagcctctggagtagctgggattacaggtgcccaccaccaagcctggccaattttttgtatttttagttgagatggggtttcactgtgttggccaggctggtcttgaactcctgacttcatgatccacccacttcggcctcccaaagtgctgggattacaggtgtgagccaccacgcccggccatcattgacctttttcagtataaatgccctcttatttcctttttatcattacacatgtcaaaataaatttctgagactgcagtttttactatcactgaatagtctcatagagaggcatgtttgcaagtagtattacaaatcataactttttttctggcactttattatagggccttggagattaccttggatttgtgtaatctcaatatggatgtgttcaaagctaaaggaatttatttgatgcgaggggagattgaaataggctttactacagttacaggtagttagtagacttggataaaagaaatgagggtactttggggtttcataaatgttggtaatgttcaaagcaacattgctttacttttctgaaggtcagaacattcctatacaaaatttaagtcagttttgatagagatttagagagacttaaatctctataaatttcatgtaatgaaaatacgttgttacctcaaggaaaaatgaattatattattacaagattgtttttaagtttgatatttataatacattaatgaaagtaacgtgaacccttgatgtcatgatgcactagcgtatggtgctccattgttttgactgtgtctgcatgagtgggctggtagtggtttatcaaatggctttcagggccaggatgaggtggagtggaactggcttgtagtatttgctgattaccgtggtggaaacactttgacgtggacaattccagcctaccaatgtggtgcaccccagggcactattatatggtcttcccagtgtataattgtagatataaatgaccttgagcacagataacagtaacatgtagtcaaataatcaggtagtgatgagttctgagtctttattacatttgttttttaacaatttaattgtaatataaaatgtttaataatgaatatggtttaatgactggctcacaaaatacatgaaagtttaagtttcctctcctgagttggtacaagccagcttcagcacaccgctgaaaatatattgcgacactgagttctattatacatgtggtttctttccttgattatggcccttgcctttgaaaatgctgctgtttcctctctctagataatttattattcttatcatcattaatataaattctaataagctgtttatgtttgagaatattcttgtttctgcataaagttagttaaagattggtgtcattgtccctcagaaccttagaactcagtatagatagagaaagtagatagaaatattcaaaatgtaaacattaaacaatgatcgggttaaatgcttatattttgtcttgctggttaggaattgaaaagtttaagctagagcttaagcttaggttaggaaaataggttctcttccattctgattagtccagtaatacttctggtggattaaagtaagattttgttaagccctgtcccctttctccctcaatttttgggcaaacagattgatagtgattgagtcattttgatagtgattggagacattccttcaccactgcaaacaggaagggtctgtgagtcattttgttatatatggagttgcttccaaaagcaagagacactaccatggtttgccaagggtggacttctgagatgactggtcacgtttgaggatttggggcttatttggaacaatcaaaggaagcaggagttgcctttatactgaggagaaatgttcaacagaagggtcaaggctgacagtaagatatcagtctggccacttgtcaccatagtttatgaatttatttctgttacagagtacttggtatcagctggaactttctccaaagatggacattctaaagaaatttccaaactttcatcaggttagatcattggagaacttattaactgagcctgccaagcaacacatttctgaactccattttaatatttaagctcgtattgagacaattataggcaccagttgaataaagaaagaaaacatttcctactttacatttgatattttcttctattataatcaatgtgaaaatcatttttagtttactaacaggaagtaatttctttcccttaaaattcccttattttaaaagaaagattgtgtataacatatgaatcctgtcatttttgtcttgttggtcaggaatcgaaaataaaatttaacaggttttaacaagtgtgattgagatttgtttcctaatcactctacatgttttttctcttttgcatatatgtcattatttataagcaacttcaaatagaacagaaggtagggcataaattatcaacaactttagtccaaaaagatgttaatgaaaaaagtaacaatatttgtgatataatatatgccgtgctggtgagtattgttggttgtcttataatcccaattgctgtgtgtagttactgttccctctcctttcctctaccagggtggtcttgcaatatgatcaaatggttatgttcagaagtacagttagcctggtatttcacagggagcaatatgacactgcataagcagggaaaatatcatagatgggaagatatattatctggcaaaagagtgatagtccttcttgggaaaagaacattgatctcacttggaaaatgccacagtcagaaagctcgcagtcctccaatacatggaccagagaaagaaatttcttcatcccctgggccaagaggcaaagaagttgtttcaaagcctaacaagctcagtggccactttgtccttctgaacatctcaacgtagaccatgaatgtgaaactagggtgcccagcacaaagtgagctgttgtgattcttcattctcattgccaaaattcagacatgcagaatgagcatcaccagagaaggagcaccctaacaaaattaagattcattgcattacatgtcacacaagttcttgtgaagcctagaggttcattagcttttctactgtccagtttctggatgactttttgtggtcagcatacttacgtcgttggttttcagtttctgctcttgtgtattcgaatccaggtactatgttttgagtaaccatatgcctctggctatgctaaatttagacctatttgcatttttctttgactgtacattaaactattcattagattaagaagtttattcatgcctgtaatcttagcactttgggaggtggaagtgggtggatcatttcaggtctggagttcgagaccagcctggccaatatggtgaaacctcgcctctactaaaaatacaaaaattagctgggcatggtggtgggtgcctgtagtcccagctactcgggaggctgaggcaggagaatcgcttgaaccgaggaggtggaggttatagtgagcagagatcatgccactgcactccagcctgagagacagagcgagactctgtctcaaaaaaaaaaaaaaaaaaaaagtttatgctatagaattgtaagctttcatagaaaaataaatggattagtatatcattaataattaacaacttagaattataacatatgaaataactttttcaattaaaatttggttatgggactcgaggtataacattttattgtattttatgtttaaatggattacaaaagtacatgctcacactttactgatgaacaagtttattacctcaaagaaaatgtaatcagttcaaaaacattttgtatcatgaggagctaaacatgtcttattttctttggttgtattgttattgtattatgctgttctcataaaggaaaattattaaagtgcatattgcaccaggaaactagacctgtacataacactgacttactagaaaattgcattaaaaattgtttgggcaatgatattaaaaattattataaacagataccactattttactgttcttcaaagcttccttcatttgtaaaatacatatattttatataaacatattgaacatcatacatttctgaatttaaattaaaattttttaaatgacgtttattgccaaattagtgcttctacaacagaagactttttttggaagaatgtcattgaaccaatgagataggagaaattctctctataatttgaaaccccattactttagttgacttaaaacgcaatttgaaatcacattactttaggtgagttaaaatgctaaggatgccatttttaaatttatataattatcttgggatatatagtcacatgaaaggatactgatactgactatattgggagcaagattgtggaatagaatccttcagcaattgtcctccctgtaggaacaacagatagaacaactatccactcaagaaagtaccttcataagaatcaaaaatcaggcgagcaatcccactatttggttttaatatcacagaaaaggaagaggcactggagagggtaggaaggacagtcttgaattgcccacaccactactccctcatcccccagcagccgctgcttggcaccaggagagaatctgtatgcttgagggagagagaacgcggttcctttgggacttggcgttggaactcagtgctgcctgtcacagcagaaagcaacaaggggcagaattcaggtggcactcatggagggagcatttagaccagccctggctggtggagaatggtccatcccctgagcttctgccagcccccccacagcaggctaaagcactccggggttctaaataaacttgaaaggcagtctaggccacaaggactgcaattcctggggaagtcccagtgatgtgctgggttcagagtcagtggaattggaggcgcaggccacctacggaggcaccagaggaacagcgaagggagcgcttgccatcactcctgcccttagccccaggcagcacaactcacagctctaggggagaatccatcctgcttgaggaggttgggggagagtaaagaggactttctattacaacttggataccagctcagccacagtatgatagggcactgggcagtcttgaggcctccattcccggccctagttcccaggtgacatttctaaacacaccttgggccagaagggaacccgatgccttgaagggaaggatccagtcctggcaagatgcatcattaaggagccgttggtccttgaataaatgtcagctgtagccagttagtacttgccatgggccttggttgagactcagaggcatgctagcttcaggtgtagcccagcgcattcccgcctttcttggccacagggaaagactccttatgcttgaggaaaggagaaggaagagtaaaggggacttttcctttactcaccagctcagccacagcgaagtggagcagcaaatggggaccctgagtccaggctttggctcctggacattatttttggacctgctatgggccagacgggagcccactaccctgaagggagagacccagacctggaagcattcaccacaagctgcctgaaaagcccatgggcctcgagggaacatctgcagtagccaggcagtacttgccctgggcctgggtcgctggtggctgcagggaaactccctctgcatgaagaaaggacagggaagagtggggaggactttgtcatgtggcttgaatgccagcacagctgcagtagaatagagcaccaggtagattcctaaggtttctgactccaggtgctggcttctggacagcattcctggaggtaccctggatcaaggaagacctcattaccctgacggggacacaagcctctctgggtttcccatctgctcactgaagagcccttgggccgtgagtgaacattcacagccagacagtggtcactgtgggtctttggagagacccagtgctatgctggcttcaggtgtgacacaatgcagactcagtggtggtggccacaggtgtgctcatgttatccctctccagctccaggcagctcagcacagagaaagactgactctttttgggggcaaagtgagggaagagaacaagagtctctgcctggtaatccagggacttctcccagatcttatccaagaccaccaagatggtacctgtacaagtctgcaaaagccatagtattattggactgagggttccccaaatgcagatatggctgcagtgactaaagatttatatcacagcatcagttcccttggaatacttggtaagccttcctaagaagggtgggtacaaacaagccaagactgtgaaggctacaataaatacctaactctacaatgccctgacactgatgaacatccacaagcatcaaggccatctacaaaaacgtgatctcaccaaacaaataaagtaccagtgactaatcctggagtgacagagatgtgtaatttttcagacacagaattcaaaatagctgttccgaggaagatcagtgaaattgaggatagcacagagaaggaattcagaatcctatcagataaatttcactaagagattgaaataattataaaaactgaagcagaaattctagaggtggaaaatgcagttggcatactgaagcatgcattggagtctctcaaaagcaaaactgattaagcagaagatagaattagtaggcttaaagacaggatatttaaaaatacaaagttggaagagacaaagaaaaaaatcaaagcacacctataagatctagaaagtcgcctcaaaagggcaaatttaagttagtggcctcaaaaagtcagtagagagagagagagacagagatctaggtaaaaagtttattcaaatggataataacagaactttcctaaactagaaaaatatatcagggtttaagtacaagagtgttatataacaccaagcagatttagtccaaaaacgacctcaaggcatttaataatcaaactcccaaaggtcaagaatagagccctttgtcagacagatagattgcaaaagttttctcccattctgtaggttgcctgttcactctgatgatagtttcttttgctgtgcagaagctctttagtttaattagatcccatttgtcaattttggcttttgttgccattgcttttggtgttttagtcatgaagtctttgcccatgcctatgtcctgaatggtattacctaggatttcttctaggatttttatggttttaggtcttacatttaagtctttaatccatcttgagttaatttttgtataaggtataaggaaggggtccagtttcagttttcctcgtatggctagccagttttcccaacagtatttattaaatagggaatcctttccccatttcttgtttttatcaggtttgtcaaagatcagatggttgtagatgtgtggggtcacttctgaggcctctgttctgtttcattggtctacatatctgttttggtaccagtaccatgctgtttgtttttgttactgtagccttgtattatagtttaagtcaggtagagtgatacctccagctttgctctttttgcttaggattgtcttggctatatgggctcttttttggttccatatgaaatttaaattagtttttcctattctgtgaagaaagtcagtcgtagcttgatggggacagcattgaatctataaattactttgggcagtatggccattttcacagtattggttcttcctattcatgagcatggaatgtttttccatttacttgtgtcctctcttatttccttgagcagtgatttgtagttttccttgaagaggtccttcacatcccttgtaagttgtatacctaggtattttattctctttttagcaattgtgaatgggagttcactcatgatttggctttctattattggtgtataggaatgcttgattcttgcacattgatttttgtatcctgatactttgctgaaggtgcttatcaacttgaggagatttggggctgagacaatggggttttctaaatatacaatcatgtcatctggaaacagagacaatttgacttcctctcttcctatttgaataccctttatttctttctcttgcctgaatgctgcggccagaacttccaatactatgttgaataggagtggtgagagagggcatccttgtcttgtgctggttttcaaagggaatgcttccagccttttcccatttagtatgatattggctgtgggtttgtcataaatagctcttattattttgagatacattccatcagtacatagttaattgaaagtttttagcatgaagcagtgttgaattttatcaaaggccttttttgcatctattgagataatcatgtggttttgtcattggttttgtttatgtgatggattatgtttattgatttgcatatgttgaacaagcgttgcatcccagggatgaagccaacttgattgtagtggataagatttttgatgtactgctggattcgttttgcctgtattttataatctacgaggaacttaaacagatttacaagaagaaaacaaccgcatcaaaaagtgggcaaaggatatgaacaggcacttctcaatagaagacatttatgtggccaataaacatatgaacaaaagctcatcatcaatggtcattacagaaatgcgaatcaaaaccacaatgagataccatgtcatgccagattgaatgacgatcattaaaaagtcaggaaacaacagatgctggagaggatgtggagaaataggaacgcttttacactgttggtgggagtctaaattagctcaaccattgtggaagacagtgtggcgattcctcaaggatctagaaccagaaataccatttgacccagcaatctcattactgggtatatacccaaaggattataaatcattctactctaaagatacatgcacatgtatgtctattgcaacactattcacaatagcaaagacttggaactaacccaaatgcccatcaatgatagactggataaagaaaatgtggcacatatacaccatagactactatgcagctgtaaaaaaggatgagttcatgtcctttgcagggacatggatgaagctggaaaccatcattctcagcattctaacacaggaacagaaaaccaaacaccgcatattctcactcataagtggcagttgaacaatgagaacatatggacacagggaggggaatatcacaccagggcctgttgtggggtgagagcataggggagggatagcattaggagaaatacctaatgtagatgatgggttgatgggtgcagcaaaccaccatggcacgtttttacctatgtaacaaacctgcacgttctgcacatgcatcccagaaactaaagtataataataataataataataaagaatagagaaatgttctgaaggaagtgaaagaaatgaaagaaaatgcagttgtgctccagtacatctggcagcagacttttcagtggaaacttgacaggccaggagagagggacataatgtatttaaagtgctgaaggaaaaaaaaaaaaaaaaaaaatatatatatatatatataatcctagatagtatatccagcaaaagtatccttcaaacatgaaggagaaataaaatccaagggatttcatcaacaccagaccggttctataagaagtgctgaagagagtttttcaatatgaaattaaaagacattaataaacaataggaaatcatctgaagatacaaacctcactggtaatcgtaagtataaagacaaacacaaagtattatgacattgtaattatgatgcatgaactcatatcttgagtagaaagtctaaaagatgaacctattaaaataactacaacaacttttcaagaaatagacagtatgtaatatatgtatagaaacagccaagagttaaaaagcaggggacatggagttaaaaagcatgggacacgaagttaaagcctacagtttttattagtttcttctttgcttgttagtctgtttatgcaaccagtgttgtcgtcagtttaaaataatgggctgtaagatactattttcaagcctcatggtaacctcaaatcaaaaaacctacaacagatacacaaaaagaggcatgaaattaaaatatacttccagagaaaaccacattcactaaaacgaagacaggaaggaaagaaggaaggaggagaccacaaaaccaccagaaaacaaataacaaaatggcaggctgtaagtccttacttaccaataataacattgaatgtaaatagactaaactctgcaatcaaaagacagatttgctaggtgggttgaaaagcaggagttgtggccagcgagatagctaatgcctgtaatccctgtactttgggaggtgggcagatcacttcagccaggagtttgagactagtctgggcaacatggcaaaaccctgtctaccagaaaaaacaacaacaacaaaaaaataaattagccaggtgtgttggcatgtgcctgtagtaccagctactcaggaggctgaggttaggaggatggctgaagcccatgaggtggaggttgcagtgagccaaaatcacaccattatactccagcctaggcgacagagtaagaccctgtctcaaaaaaacaactcttgcctacaagaaacacagtttacctataaagatacacatagactgaaaataggggatagaaagagatattccatgcaaattgaaagcaaaaaagaacaggaatagctatatttttataagacaaactagatttcaagacaaaaactataaaaagatacaaagtcattatataatgataaagggatcaattcagcaagaggatatcacagttgtaaatatacatgcacccaacagtggagcacccggatatataaagcaaatattactgtagtgaaagatagagaccccaatatgttaatagctggagacttcactctgcttctagcattggacagatcatccagagtatcaacaaagaaacactgggcttaatctgcactatagaacaaatgtacttaatagatatttacagaacatttcatccagtggctgtagaatacactttttcctcagcatatggatcattctcaaggatagaccgtatgttaggtcacaaaacacgtcttaaaactttcaaaaacaatgaaataatatcaagcatgttctctgacaacaatggaataaaactagaaatcaataataagaggaactgtagaaactatacaaacacatggaaattaaacaatatgctcctaaatggctattgagtcaatgaataaggaaattaaaaaattccttgaaacaaaatgtaaacagaacataccaaaacttatgggacacagagaaagcagtattaagagaaaagtctacagccatcttcaaataaacaacttaataatgcatgtgaaaaagtagaaaagcaaaaatgaaagcataaattagatgaaaagaaataataaagatgagagctgaagtaaataaaatggaaacaaaaaaattacaaaagaccaaggtaacaaaaagttggttttttgaaaagataaaattgacaaatcttttgcctaaaagagaagacctaaacaaataaagtcagagatgaaaaaagagacattacaactgatactgcagaaattcaaaggatcattagtgactactatgagcaactctataccagtaaattggaaaactagaagaaatggataaattcctagacacatagaacctacaaagattgaaccatgaagaaatccagaacttgaacagaccaataacaactaatgaaattgaagccctaataaaacaaaatctcttagcaaagaaaagcctgggacctggtggcttctgtactgaatttcaccaaacatttaaggaagaataccagccctacccaaactattctaaaaaataaaggaggagggaatacttccaaactcattatttgaggccaatattgccctgataccaaaagcagacaaatacaaatcaaaaaagaaagctacaggccaatatccctgatgaacattgatgaaaaagtcctcaaaaatcccagcaaactgaattgaacagcacattaaaagatcattcattatgaccaagtgggatttataccaatgatgcaaggcaagggtggttcaccacatacaaaccaatcaaagtgatacattatactaggagaatgaaggacaagccatgtggtcatttcaattgatgctgaaaaagcatttaataaaattcaacatcccttcatgataaaaacactaaaaataactgagtgtagaaggaacatacctcaacacaataaaagccacatatggcagacccacagctactatcatattatgaaacattgatgtgagaaattgaagaggacacaaaaaatgaaagctactccatgttcatggattggaagaatcaatattgctaaaatgtacgttctgcccaaagcaaaccgcagatgcaatacaacccctgtgaaagtgctcatgacattcttcaaaaaaatagggaaaaaaaaaatcctaaaattcatgtggaaccacaaacgacccagaatagtcaaagacatctggaacaaaaagaacaaaactggaggaatcatactacctgacttcaaattattctacagagctgtggtaaccaaaaaagcatggtactggcataaaaacagacacatagaccaatggaacagaatagggaacctagaaagaaatccacaaatctacagtgaactaacttttgacaaaggtaccaagaacatacattggggaaaagatagtcttcaataaatagtgctgagaaaactggatatttatatgtagaagaatgaaactagacccctctctcttgccatatattaaaatcaaatcaaaatggattaaagacttaaatgtaagacctgaagctatgaaactatttgagactaaaagaaaacattgaggaagctcttcagaacgttgttctgggcaaagatttattgagtaatacttcacaagcacaggcaaccaaagcaaaaatagacaaatggattacatcaagtttaaaagctgcacaacaatggaaatactcaacaaagtgaagagagaacccacaaaatggtagaaaatatttgcaaactatttgtcagacaggattaagaaccagaatgtataaggagctcaaacaattttatgggaataaaatctaataatctgattttttaaatgggcaaaagatttgaatagtcatttctaaaaagacatacaaatggtaaacagctatgtaaaaatgtgctcaacatcattgcattagcctattttcatactgctatgaagaaatacccaagactgggtaatttataaagaaaaagaggttcaatgaactcacagttctatatgtctggggaggcttcacaattattgcagaaggcgaaggaggagcaaaggcatgtcttacatggtggcaggcaagagtgtgtgtgcaggggaactgccctttataaaaccatcagatcttgtgagacttattcgctctcatgagaacagcatgggaaaaacccacccccgtgattcaattacctctaccagatccctcctgtgacatgtggggattatgggagctacaattcaagatgagatttgcatggggacatatcaattattgatcattggtgagatgcaaattgacattacaatgagatgtttcacctcagtaaaaatggcttttcttcaaaggacaggcaataacaaatgctgttgaggatgtggagaaaggggaacgtttatacactgttggtcggaatgtaaattagtacaaccactacggagaacactaggaggttcctcaaaagaaacaaaaatagaactaccatatgatgtagcagtctcactactgggtatttatccaaagaaaatgaaatcagaatgttgaagaaatgtctgcactctcatgtttattgcagcagtattaacaatagccaagattcggaagctacccaaggattcatcaacggatggataaagaaaatgtagtgcatatacacagtgcattattcagccataaaaaagaacgaaagcctatcatttgcaacatggatagaactggaggacattgtgttaagtgaaataagccaggcatacaaagttaaacttcacatcttctctctcattcatgagagctaaaaattaaaacaatttaacttatggagattgagagtacaatgatggctaccagtggttgggaagggttgtgggggttgggggtagtggggatagaatgagtaagatctagtatttgagatcacaacacgataactacagtcaaccataatttattgtacacttaaaaataactaaaagagtataactggcatgtctgtaacacaaagaaatgataattgcttcaggtgatgcataccccatttactctaatgtgattattacacattgtatgcctgtatcaaagtagctcatgtaccctataaatatatatatctactatatattcataaaaatttaaaaattaaagatagagattatattcgatatttctacaagaaatttgtaagttttaattcataaaaattcttgtgttgcatttctattctttttttactagttttatttttaagtttcatcttcattttagtacctaagagtgaaatcacttatttgtacacatttttcagagttgtgtgtcccttgcatatatctatttgtacttctcatttgttttgttttgtttttaacttttcttttagattcaggagtacacatacaggtttattacataggtgaagttgtgtgaagggagtttgttgtacagattattttatcacctgtgtactaaacctagtacccaatagctgtttttttctgatcctctccctcctcccacctgcctctgtcaagtaggccctagtgtctcctctttgtgtccatgtgagctcatcatttagctcccaattataagcaagaacatgcagtatttggttttctgttcctgcttaagtttgctaaggatgatggcctctagctccatccacattcccacaaaggacatgatcttgttctttttgatggctgaatagtattccatgatatacatgtaccacattttctgtatccagtctgtgatgataggcatttaggttgattccatttctttgctattgtgaatagtgttgcaaagaacacatacatgaatgtgtctttatggtagaatgatttatattcctatgagtatatacccagtaatgggattgctgggttcaatggcagttgtgtttttagatttttgaggaatcaccacactgcttttcattttctccacaacctcaccagcacctattatttttgactttttattgccattctgactggtgtgagatggtaccccattgtggttttgatttgcatttctctaatgatgagtgatgatgagctttttttcatgtgtgtgttggcctcatgtgtgttttcttttgaacagtgcttatttcctttgcccacttttaatgggtttgtctgtttttttttcttgtaaatttgtttaagttcctcatagatactggatattagacctttgtcatgtgcatagtttgaaaaaattttctcccattctgcaggttgtctgtttactctgttgaaagtttcttttgctgttagaagcacttaagtttaattacatcccatgtgtcaatttttgcttttgttacaattgcttttggcatctttgtcatgaaacctttgccagtttctatgttcagaatgatattacctaggttgtcttccagggtttttatagcttttggttttacttttaagtctttaatccatcttgagttgatttttgtatatgatataaggaaatggtccagcttgaatcttctgcatagagttagccagttatctcagcaccgtttattgaacattgtcaaagaacaggtggtcatagatgtgtggccttatttctggggtctctgttctgttccattggtctatgtgcctgtttttgtaccagtaccatgctgttttggttattgtagccccatagtatagtttgaagtcaggtaatgtgatgcctccagctttgttctttttgcttagaattgccttggctatttggccccttttttagttccatttgagttttaaaattgttgttttctagttctgtgaagaatgtcattggtagtttgataggaatagcattgaatctgtaagttgctttgggcactatggccattttaatgatattgattctttctatccatgagcatggaatatttttccatttgtgtcatctctgatttctttgagcagtgtttcataagtcttattgtagagatctttcacctccctggttagctgtatttctaggtattgtattcttttggtggcaattgtgaatgcaattgctttactgatttggctcgtggcttggcagttgtgaatgtataggaatgctagtgattttttaacattgatttttttttttaatcctgaaattttggtgaatttgtttatcagctgaaggagcttttgggctgagactgtagagttttctagctacagaatcatgtcttctgcaaacagagatagtttgacttcctctcttcctatttaggtatgcgttatttctttctcttgcctgatagctgtggccagaacttcccatactatgttgaataggcatgataagatagggcattcttgtcttgtgcctcttttcaaggggaatgtttccagtttttccccattcagtatgatgttggctgtgggtttgtcatacatggctcttaccattttgaggtatgtccctacaatacctagtttattgatagttttttaacatgttttttaacatggaaggatgttgaattttatcaaaagccttttctgcatctattgtgcatcattgtgcatctattgtgataatcatgtagttttctgcatctattttctgcatctgtaatcatgtagtttttgtctttagttctgatgaattacatttattgatttgtgtatgttgaaccaaccttgcatatcagagataaggcctacttgatcttggtggattagctttttgatgtgttgctgggttcagtttgccagcattttgctgaggatttttacatcaatgcttatcaaggatattggcctgaagtgttttttttgttgttgtgtctctgtcaggttttgatatcaggatgatgctggcctcataaatttgatggggaggagtccctcctcttcaattttttggaatagtttcggtaggaatggtaccagctctttgtccatctggtagaatttgctgtgaatccatctggtcctgggcttttttgttgttgttgttggtaggatatttattactggttcatttcagagctcattattggtctgtccagggaatcaatttcttctttgttcagtcttggaagagtgtgtgtgtccaggaatttatccatctcttctaggttttctagttcatgtgcatggagttgtttctggtggtctctgatagctgtttttatttttgtggggtcagtggtaacataccctttgttgttcctgatagtgtttatttgtgtcctatttcttctttattaatctagctagtggcctatcttattaattttttcatggagttctacctgtgtctctcaatgtttcttggagttaaattggaacttttgtatctgttgccgtaatagaaggtcttgaagtacttagtataaactgcccattttatttcttatgtatatactttatcaaactctactggtttgtgtatactacatgatgtttgaaatgtttatttcatctcccatggtacctggcacagagtttggggcaagtgaaagacatagaagttgacatgacttgtagatttctgagtatatctggatccattagggctgtggaatttgatgctgggtgagatggattcttagcagctttctaggttcctgatgaggaagcattggagtgactactgaaatggaagaatggggtgggacaacatcagattctggactctggaatgtaattgtctgcataagactttagcagctaaagcagctctctttatccaccaatttcaaaatatgcagttgttaactcctatatcctctttctcttactgtcaatctctaaagctttagcaggttggggaaatttttctccggcctcagtctgctatcatctacattaaaaaacaaaaaacaaaaaactaatgtttgcataaaccttttctccttcatactattttgatcacggtccttattggcttttttagaaacatttggcctggcaatgtttgttttatttaagtactttttttaacatatgtatatacccataaaagttcaccggaattaaagtaatgatcatgtccatttttctgaatgtttctgtgagatttttaataatttttctcccatgcacccttccaatccattctaaacttttttctatcactgtatattagtttgcacatcctacatttttacatatacatagcatgcattcttttatatctggcttacttcactcactaaaattattttgagatttaatgatattgcagtgagcataaagttttttgtatgtttctaatccatatttattgtatggatataccacggtttgattgtccatatgttagcaacggtgaatccacatgggtctgcagcagcttgattcttgcctccccagaggaaagaattcatcacaggggcataaggcagagtgacagagtgaggcaggttttagaatgggagtgaaagtttattaaaaagttttagaggaggaatgaaaggaagtacacttggtagacggccaagtgggctacttgagagatccaagtgcaccatttattctttgtcttggagtttttatacattggcatagttctggggtctgcatttcttctcccctgattcttcccttggagcgggctgtctgcatgctcagtggcctgccagcacttgggaggggccgcatgctcactgtgttgaccgaagttgtatacatgatcatttgagtgtttttgccttaccagttgaatgttcctaaaagaaggtcatataccagttaaacttagcctcctagtgcacgtgctacagcccacttgcccaactcctgaaatcctactaggaagctgctgatatcagcttcaggtgttttctatctgctgggagactgcctttccctggcagtggctcttaccaattattattctagggagacacttaaacaactacctgaccatcccgtgatggtcacctagcatttctaggggtagggggtctcctgccatgctcatgtttgcttaactacttattctaacacattcacctattgatagacatttgggctttctccagtttttgattattacataattaaggctgccataattatttgtgtataaatcttttttatgaacctatacttttatttctctttgtaaatatctagagaggaatggctggatcatatgatcagtgtatatttaaactaagaaattgtttccaaaagtggttgtacaatttttacactcacaccaatattggagttccagttactatacttcctcaccaaggtttagtatagttaatctttttaattttagtcattttaatagttgtgggttatgatttgcatttccctaataataacgttgagcctctttttatgtacttctttgccatttgtatattttctttggtaaagagtttgtttaaaattttgcatatttattttattggattaattgctttattactgagttttcatagttctttatacactttgagtacaggcctttatttgatatatgatttgatagtactttcttcaggctgtggattatcttcttattttcttaaaaatgttacacaaatagtggaagcttttattttcatgatgttcaatttattcttcatggaccatgcttttagtgtcatgtctaagaaacttttgcctaatctcagtttgcaaaggttttctactaaattttcttttagaagttttatcattttaagttttcaaattaggtcaatgatctattaattaatttttctataaagagtgagacatgagttcaagtttattttttttacatggatattcagctgcttgagaaccattttcaaaagagactattctttctacgctgtattgccatttgcaccttgcttgaaaattctgatgtccatatacttttggatatttcttggctcatgactatcttgattactatctctttataatattgtaagttttgaaatgaagtcatattggccctttaactttgtttcttttttcataattgtcttggctattctaggttctttgcattttcatagaatcagcatgtcaatttctgcagcagtgcctgctgggaatttgaagggattatgttcaagatatagtccaatttagggagaacttgcatcttaataatgttgagttttctaacttatgaagaaggtataacatatctctccatttatttaatgctttagtctccctgagaaatctcatgtttttagtgtatagatctttgttacttatttgatttatacttacagttttcataatttttaattctattgtacatatattgctttttaattccaattttcagtttttccttactgacataaagagatacaattgatttttttcgtattgaccttgtatcctgaaactttactaaatcactcattagttttataagttatatatcatgtacaattatatataaaatatagatgatatataacacaaaaactcttataatctataacataaactgtaggatatatattaaaatgtatatatcatgtatgtaaatattttttctattggattttctatatagattccctggtcctctaggagtaaagagttatattttttcctttctaatctcaaatgagtttcatttttttaacttaccttatttcattggctaggatgtccagcacaatgtggaagagaagtggtgagagtgaaatccttgtttagtttctgatgttagggtgaaaacattcaatatttcaccgttgagtaaaatattagctataggcttttcatggatccctttttccagtttccttctgtttctagtatgctgagggttgttctcttctgtcttgttatttttaagagcaggatgaatattggagatatcaaaagctattttctgctcttagtgagatggttatatggtttttcttttttgttaatatggtgagttacatcaattaatttttgaatgttaaatcatccttcagtacaagtaaaattgtaataagttccacttagtcacattatattttctatgtattattggatttgacttgctaaaattttgttcaggatttttcatctattctcataattttctgtttctgtaatgtttctgtatgattgtcagggtaatttaatgctggcctcatagaatgagtcttgacttattttctcatatacttttctggaatagttgatgtagaattaatatctattccttaattatttaggcctggtgtttgggttataaaaatgctttaaaaaacaaattcaattactttaatatatatgggattattcaggttaatgagctcacttgatgaatgagcattggtagtttttatctttcaataaatatttgcacttaacctaagttgttgaatttattggcataaagttgttcaaagtattcccttatccttgtattatgtatagactctgtcataatattatctgtcattcctgttattggtaatttttgtccgaatttgtgtcttctcttttgtattcatgatcaatctgcctagaggtttattcttttaaaaaaattctcaactagcttttgttttaatttattttctgtattatttctgctttctagttcattgatttccactctgttctttaccatttccattttgctgctaactttgccattcaatttcctcttctttgtgaagaggtcattgattttgagacctttcctcttatctaatataggcatttattctgtgctattagtttccttctaagtgctgctttagcagcatcccactgactttgatatgctttgttttaattttcactctgtacaaagtactttctaattttccttttgatttcttcattgaccctgaattattcagaagtgtatttttcccagacatttaaatttttctggagatgttttgttactgatttctaatttaattctgttctggtcagggaacatgcttgtgtgacatgaatgctttcagtctgttgagacgtacatattctgctatcgttggacacattgtttgatagataccaattcggttacattggttgataatgtttttcaggtgtgctatcttgagtagattactttttttgatgattttttgtttgttgaatcaaatattgtgataagggttttactatgttagtggttgctgtaagatttatactctcatctgtagcttatgaaaatctacctttaagtgatattaaagcactttacatacagtataagaaccttgtaatagcatgtttcagtttctgtccttctgatcattgtgctattgttgtcgtacgtattacttttagcatgttataaacgtcaaacaacattactattatttatgtttaaataatgaattatcttttaaatatatttaagtaatttaaaagtatttgcctatgtcttaccaaatccgatgctcttcttctttgtgtagatacgtttttctatctggtttcatttttcttctgcctgaagaactttaacatttcttttaatgctggtcttctggtgatacatttttgcagcttctatatgttttgtaatgtctttatttcatctttgtctttgaaaaacttttgggttggatatagaattacaggttaacaattatttttcttttattactttaaagatattactacagtattttctcacttgtgctattactaaagagaaatgtgctgccattcttacctttgttcctctgcaaaaaaatgtctgtttttcctggctccttttaagattattttttttttaccactgattttaaatgatttgattatgttgtatccccatatagttttatgggtcttatacttggagtacattgagcttcctggatctgtgattttatagttttaataaaatttaaaacattttttcattacttttagaatatttttctcttccccctctcttttagagaacaattacatgtgtattcagctcctttaagctgccccacagcctacagattgtattttcaatttttaaaattgtttattccctctttttgtttcatatgatttctattgctatgtctaggctcactcatcttttccttctacaatgtctaacctgctgttcattccacccagtgcatttttcatccaacacattgtagtttttatctctagaagtttgttgggctctttttatatattacatatctatatttgagtttttgaacttacagattatttgtaataactgttttaatgtccttgtctactaattctcacatttttgtgagttctgcgtcagttttgattgattcctttatctctttattatgaatcatgttttacagattcttggcacatctaggaattttttttttttggttgccagactattaccttattgggcactggatattatttttattcctataaaggtcctagatcatatttctgagacacagctagatttattagaaacagtttaatccttttagaccttaatttaaatgttgttaggtgggaccagagcaatgatcagtctacatgtaactacccactactgagccaatacccttctgtgtactctgcccagttctctgtgaatcttgagcatttcagtgttccttttgggaagaagcactcctcggtcttgtgtgcatgttaacactattatgtttaatccattcaagtagttttctaataggtatgtgttgaataatactcagctgcaggggaccctctgcagatctctggagttatttctttgtgcagccctctcatccttcctatgaaatgtagctgctttggactcttcaaactctcagcttcatcacttgaatataggaagtctgctagtttttcacaatggctttttcttcctaatctacagacaggaaactttgtaggcagtaagctgaagcagttaatagagctcaccgtgtttgtttcttctgtctcaaggatcattatccttttttgcttgataggtatcttgaaaacttgtatattctgttttttggtggaaaaaactttttttcaggcaagcagattaaatatctggtctcttctccttcctctaggccagaaggaaagtttacttggagtatttcttaagggagaaatttatttataaaggcatacgcccaaactgtccctctttatttatcagtgctggtatatcctaatgacatactctctactggtgagaatagttccaccagacagacagacatctgctttagcattcagcagattcttggatagtttatggaatgacttctttcaagtgattatgaatccaaaaagtagaattacaagaattaactagtaatatttaagaaatgcatgatcttgagagtcttatgtgttgttcacctataatcctcagttctcacaggagtaagtagaaatgttagtttaatcaggttatgagaacaaatgaaagtagatattaattattcacactgattttacattttgaagatataaggtgtttattaatgtaaactatttgcttctttctaaaataggggttgtagaatcattgagcttgatagagatctagaataaagtactatttttatattgatcttaaatatgttagtgtagtttcagtaattcctgtgggatcgtcatacagtaattacaattttaaggagtttatgtgtctcaaaatgttatcattgcatatattaatgctattataaatgcagtcataaaaagaaatgtgaggaaaattattaaataattatcagaatgaagttgagttaataggtgtgccatccaattataacttgccctaagagaaatatcagtggaggttgaacatttcagcctcagctaagacatatacttgtgctaacttagactaggaagtatcataaagaaaaaggaactttttattagtatctcctattgacaatatcttgttatagtttagaacgtatgtattataggtgtggattgaactattaaatggaagatcaaacacttttttcagatgttgccattttcatgggagagtatgttgaagtgcgttttggaacatgttaagtaagctagagtgagaaggtatagacaagcatatggggagactaagatgatccatgtggtggtggattagagctagagacatcagcatgaactcatgtttagcttaatatagatacagttggagatacacacacatacacatatatacatacatatctataagtatttacgtatacatacagaaattcttcattttattgtgccttgcattactgcacattgtagatattgtgtttttttgcaaattgaaggtttgcggcaaccctgtctcaagcaagcctgtcagtgccatttgtccaacagcatgtgcttgcttcacatgtcactctgtgtaacattttggttattcttgccatgtttcaaaccttttcattatcatatttgttacggtgatctgtgatcagttatctttggtgttactactgtaattcttttaggcattacaaacagtgcctttataaggcagcaaacttaataagtgcatgtgttctgactactccaccagtcaactgttctcctgtcttctctctccttaggcctctctcttccttgagacacaatgataatatacttaggccaattgatgactctacaagaatgtctatgtgttcaaatgaaaggaagagtcatacatctctcactttaaatcaaaagctaaaaatgattaagcttagtgaggaagacaggttgaaagctaagataggcccaaaagctaaacctgttgcaccaaacagccaagatatgcatagataaagttctcgaaggaaattaaaaagactcttacagtaaacacatgaatgaaaggcaagcaaaacagcctcattggtgatatggagaaggttgagtagtctagatagaaaataaaaccagtcacaacatactcttaagtcaaatccagagcaaggccctgactctcttcagtttaacgaaggctgagaagaggtgaggaagctgcagaagaaaagttggaagctagcagagggttggttcatagagtttaaggaaagaggccatctccataacatcacagtccagggtgaaacagcaagtactgttgcagaagctgcagcaagttgtctgcaagatctacctaaaataatagatgaaggtggctacattaaacaatagactttttttttttttttttttttgagacggagtgtcactcttattgcccaggctgcggtgcaatggtgcaatctcagcttactgcaacctctacctcccgggttcaagtgattctcctgcctcagcctcccaagcagctgggataacaggcgtacaccaccatgcccaattaattttatatgtttttagtagagactggatttcaccatgtttgtcaggctggtcttgaactcccgaccttaagtgatccaccccccttggcctcccaaagtgctgggattacaggcgtgagccaccatgcccatcctaaacaacagatttttatgtagacaaaacagctctctattggaggaagatgtcacctaggactctgatagccagagagaagtcaatccctggtttcgaaggacaggctgactctcttgttagggattaatgcagcaggtgactttaagaggaagctggttgggcatgggggcttacacctgtaatcccagcactttggggggctgaggcaggcagatcacttgaggtcaggagttcaagaccagcctggccaacatggtgaaacctcatctctactaaaaatacaaaaattagccagatgtggtggtgggtgcctataatccaagctacttgggaggctgaggcaggagaatcacttaaaactcaggaggcaggggtttcactgagccaagatggtgccactgcactccagcctgggtgatagagtgagactcttgtctcaaaaacaaaaacaaaaacaaacaaaaagccactgctcatttaccgtttctaaaatcctaggactcttaagaattatactaaatttaccatatctgtgttctgtaaataaaatagcaaagcctggatgctaacacccctgtttacagcatggtttactgattattttcagcttactgttgagacctactgctcagaaaccagattcctttcaaaatattactattcattgacaatgcactttgtcgtccagaagttctaatggagatatacattaggagagtaatgttgttttcatgtatggtaactgatatgttttggctctgtgtcccaaatctcatcttgtaggtcccataattcccacatgttgtgggagggacctggtgggaaacaactgactcatgggggcaggtctttcccatgctgttctctttgatagtgaataagtcccaggagatctgatagttttaaaaatgggaaccaacccaaatgtccaacaatgatagactggattaagaaaatgtggcaaacatacaccatggaatactatgcagccataaaaaatgatgagttcatgtcctttgtagggacatggatgaaattggaaatcatcattctcagtaaactatagcaagaacaaaaaaccaaacaccgcatattctcactcataggtgggaattgaacaatgagaacgcatggacacaggaaggggaacatcacactctcgggactgttgtggggtggggggagggatagctttaggagatacacctaatgctaaatgacaagttaatgggagcagcacactagcatggcacatgtatacatatgtaactaacctgcacattgtacacatgtaccctaaaacttaaagtataataataataaaataaaaaaaattaaaaaaaaataaaaaaaatagaaatgggcatttccctgcacaagctctctgtctttgcctgccaccatccatgtgagacgtgactagcttcttcttgccttccaccatgattgtgaggccaccccagccatgtggaactgtaagtccattaaacctctttttcttcccagtctcaggtttgtctttatcagcagcgtgaaaacaaactaatgcactaacataacatctattctgcagtccatggatcagcagtaattttgactttcaagtcttattatttgggaaatacatttcataaggccaaagctgccatagatagtgattccttaacttggcaatgtaaattgaaaccttctggaaaggattcaccattctagatgccgttaagaacatccatgattcacagcaagaagtcaaaataccaacattaacaggagtttggaagaagttgattctaaccctcctgggtgactttgagaggttcaagacttcagtggaggaagtaactgcagatgtggtagaaatagcaagagaactagaattagaaatggagtttgaagatgtgactgaattgctgcaatcttatgatgaaactatagtggatgaggaattgcttcttctggatgagaaaagaaagtggtttcttcaggtgagatctaggcctggtgaagatgctatgaacattgttgaaatgacaacgcaggatttagaatatttcataaactgagtttagctttattttggcagttatcagtttatgttgaaacaaaatacaagcactacataaaaggactttaaggttcaaataaaaaatagatttaattcattttgtatctatttgtataataaacatctttcttaaattgttgtgtaatttctcttaggtacctgtgcagcacaggtaatttggaatgaatgccacaccacccatctttccctgttaatgatactgagtaaatactgagagcaaagaaatggggaaaacagctcattaaaaggtgtcccatgctgtgaaatgtggaacatatttttcctacttacttctttgattgaagacaaaatatttaggcacttagatggcctttgagagaatctttgtgtcacagtggagctgcttatttgaaataattttttgaaaatattaactttccccatttttaaggtaaaagtattgattagctacatattgttaaactcttctctttagcttcatctgctctctttcttgcttttgggatcctcatcttcttcctaaggaatggcactaatcaggtttgaaagtttgggggacacttcaagttgctcatcatttcccacagccagctttccctctggaaatacaaggtagtcttgtatttacctgtgttcctgtgctgcagaatgacgggtcttgcagatttgttataggacagttggttatcttgtgctcttactttaactgattgattgtcaacataaagatttctggggttagtgaaagaacaaagaaaaagggtgtgtgttatggtgaaatatttaggaactgttatggactgccacttattattttattgaaaaaataagtgtcatttatatattacatgtactattattttattgaaaacatgagtgccatttatatattacattattttcaataaaataatgctctcattttcaataaaataatatatattattttattaaaaaatgagtgtcatttatgtattacatgtactatggtaaatatggagatgaaaggtaacaattctgccttcatggtttttataggctactggctacatacataagtataattcatacagggtaagaaatagtatgaggccctaggtactgcttattgagatgcttgtggatgcatactggggagctgtattctgcttattggcactgatacttatttccttattaatatcagaaaaatatagaactacattgggggtggctgggcacagttgctcaagcctgtaatcccagcactttggaaggccaaggcggttagatcacctgaggtcaggagttcaagaccagctggaccagtatggtgaaaccgtttctctactaataatacaaaaattattcaggcatggtggcacatgcctataatcccagctacttgggaggctgaggcaggagaatcgcttgagtccaggaggcagaggttgcagtgagccgagatcacacctctgcactccagcctaggcaccaaagtgagactcagtctcaaaaaaaaaaaaaatacattgagggtagcaagagttaaaagggagaaataataaaaatgaaacagctataagaggaggaaggaagttaggggtgggagttctgaagataaagcacttctctaataatctgagctccagatgaaagcacagtgagcaagaacagtgcaaggtttcaaggcatcaagttgtcagatatctttcctttcccctccaaaccagctgtctgtcactctctgctctcatctgtacacccagggactgatatgttatcctctggcttccaattgcatttggccaatggagaatcctacaagtacactggagaggagaggagagtgaaaatatattatttttatcttggagcctctgcacagctgcaataaataggctggctgtatccttctaccaaagatcacagctcaaactaaggtagccctttctccatctctctgcttgctagttctgggaacacttgcatcttcttgcttctttaggaatagctcagtggctcctagctctggtgtactgcttattaccttgttggcatagtccctatattaagccctccttgaactatctctatttgagtacatcatatgcttccggactggcacattgagaaaatagagctgccagaacttctccatcacatagtcttcttcccacttcattttatgagtgatgaaaaggaggccagggagagagtagcttttcccaaatatttaagtaaagactagtgtggaatctagacatgccatttcctagtcctcccagttctaatttcccacttattttgaaattttgtaaatatatttctatttagtttcccacttccaaggcttctaatgctgaggctgtgaacattcctacaatcaggttttgagcttatagaaataaatgaagacgctggcccacctaaggggaacagaggctttttattcagagctggctgtagcaaaggagtgagccaccatcacatgctctgggcggcgtatgtgttctcattggtggttgctgcatggtgaagctggagcaggctaactagaagtgaggcatctaatttgattggtttagggagcatatgttttttttcctggttggtcctgagttggaacctggggcaaaaaattagagaagcaaacagtcattgtccaagtcctgactgttctgagctgattattgcagagcatatgggtcagagttctactgtcatatatgatctagctgttatctgttcgtgtagtcagtgcgtcaagcatgaaagcagttgatttgcattccagctttcttactcatcatctgaaggaacctgggccattgaatagcacactaattataatgtccccagggagagttcaggatctctagaaggagaaagtgtggctctctagaggaagtgatggtagaattgggaagcacacagtgggaggcaaatgttgcacagcttggagcagttcttttgacagtctcctagatgaaggcaaatagggacagtgcttgcaggatttgaggtcattcatatgtatttgtgccttggggatataggtttgccacagccgactttcttcataggagctttgtcagtcattagcatgactaggctacaacttctttgcgagctctttcattgcacatagcagcaatattttcagtgaagactaaacagaaaactttattcttacctgaggatctggcattggagagtggccaccacatgagtcaagcaccaagttaggtgaaattctaaattcgattctcctatatatagtttcccagtaattatccactgaagttacagtgagcttcaatggagcgagttcttgaaaaaggccctgtcttcatctcatcctaatccagctgaggatgcagaaatgcagctgttgtgtatagagtaattggtttcttcaattcttgtgaagtcttggctcctactctacctagattttcgttgttttggttgttgaatcacttccctttttcacagtatcttatataccttagcctgagattggctgtgtgatgatcctaaaggctcaacctccttcgtagactcactcccactgcacgggagtctccaaagtgactccacttccacttttattgctttttctgaggaaattccaggcatgataagtcaaatgagaaatttaatttgagaggaaaagagggaggagaggagcctctgaaattacctttacagtcttataataaccttgaaaagtattatatagtttgggggcaaaaggagctgacccttatctcttatcatacttgattaggtctctgtctgaggtttccaggagttgtacctccatagctagtgctgcgtgctcttataatggagcagaggtactgttgtttgggacttaatactcagagtgaactattgactcaggataggaccaattgccgccattgttcttctccagcacttggtagagacagggattctaagctgtcaaattgggataagttggattttaattctattcagtagggcacaattcattgccctgtgatttcctaggggcaaaaaatgagtctgtttttatgtatctatggactaccacaataatttacataaagatattcagatatttattgttacttttctaaccaacatgttaaaaagttacttatgatagctatccaaaaaattgctgattgatagatagtatcttttctctggaaataggttgaatttttaaaaatatttttatttccacatatatatgtgaaaacaaaaagtagtatcacatctttcattttgtttttgtttacttgaaagttgcattctcggctgggcatggtggctcatgcttgtaatccaagcactttgggaggctgaggtgggaggatggcttgaggccaagagtgggagaccagcctgggcaacatagcaagactctttctctacaaaaattaaaaatattagccagtcatggtggtatgtgcctatagtcctagctactctggaggctgaggcaggaggatcacttaagcccaggagttgaaggctgtagtgagctatgatcatgccactgcactttagcctgggtgacagagcaagactctgtctcttccaaaaaaaatctatattctcataggttttcgttcttgttctacaatgtgaagctcattgagttttctagtggttgatcttatgtgtttatatttgctcagaaaataaaaactagaaaatgtgactgtcattatttgtgtaaaatttgaataaagcaacaatccatattaacagttattgaaatattgtgtattgaaccagtgttagcaatccagcattggcaacatcctactttatttatttataagtttttgcaaatcagtatagtgatagaaatgcatgaaattacaatacttggagaactttttataatagggaaagaagctagtgacagaggtgaggatttgttcatgtattacatgaaaatattaatttaattggtttcctttaaaacttttgtataaatggcagtgatagttacagaactaggaaagatagttcatgcttaaagagatctggccttctcttttgttaatgaatgactttaaagttgaaatttgcattaagaatattaatgtgataattttcaaagtacccattagtctaacacttttaggataacaaaactaaattctaatgaagttgacatgtggaagaacagtggtaggtattaggaaaaagtaatctggtcacaataaaaatatgcttttgctcgaaaatctgtcaagataaattccaagcacttcaaaaaatgcatgttaaatgtgctttactacagttttgaaatagattaaaattatatgcaaattaatgcaaatcatgtggcttcaagattaagttttgaagtgctatcttcgttccctggagtaaatggctgctgaatgaatagatgcataaatatctgactggatgactggctgaatgaatgaatcagtttttcacttggaaagctgtttcattctcttctctgccagaagcccagttttatgatcttattcaaaatagaatctgggaggtgggcggttgtaactcaaagattagcctaatcaatccagttcaacccaggggacaccatctgccccggtccagtgtagagcgtaaaatgtagtgcatctgaactacaaaggaagaatgtcatttcctcagcactcatttgttgaataggtatctactgagcacgtattgggagccatgccttatttctgatgcatcacagttaacctctaagcagcaattgctattgtttttgatgttcattctttcttgaaatttcctcttctcttgaattctgccatatttcattttcttccctttccttctacttctgtaaaatttgcttcctttcaatctccttttctgaccttgttctgggagttccctgaggctcagtttttgccctgtgttctttctctgctccagtgattctcaaccctggctatgatcacagcctctgaggtgaggccccaagcatagtcaaatattaaaagctccgtaagtaattcttattcgcagctagacttgagagccttttttataccatagtccggggaattgtttgtgtctcaaaactttacttacgtctctgctgattagtgtcataccactatctcctttcacttaagtgcctgctctgtgcccctgcctaaccaagaagatatttccatttagaaataccattcccctggtttatctccaaaatatctttatatcctgatttttaatttattctttagttctaatctgaggaagattaatctttgatctttctttatttcttgattcaatctcttttgcatagtatgaccaaattaatactagcctcatcaaagagttagctactcttttgccccaaatccttttggctctccattgtctgcagggtcaaattgaaaatccttatcatggaatatgaaacttaaaattctagacccacagatcagcttccttacagaacatctctttgagacttttgtaaaatataagggcctgtgcattccagccttctgcatgaagtctttcctgacttcaaggtccatggtcacctgttccctccaagtcttatggatagtgctgtaaactgtgttatatcatgtaactgtttcattgaagtttggtaaccacctgtaagacaaaatcctgactgatcttgttctgaaacataactgtgaatatgtacttatattgagaagtgagctatatgttatagcagcaatgtaaggaatactaaaagtgcacatagcctattgtaaattctataagttcatagttaaccaacatttactgaatgactattatgtgctaggaacttgcttattcttactgtcttattttgtcttcatgtaaagtggcattatcccaattttaaatgagaagactgagtcctagcaactttaatcagctttcttcaatagaaagttatgactgggatcccagtttgatcttcagagttcaaatcttgtactttgtctccctaattcagtaagctcttaggagagagggcattttcttttcatcaaactcaatgacataggaggtagccattaatatgttagtaaataaagtgagagaaggatcctaggatgatacggtttggcttggtgtccccacccaaatctcatgttgaattgtaatccccagtgttggcagagggacctggtaggaggtgattagatcagaggggtggatttctcccttgctgttctagtgatagtgagtgagttctcgcaagatgtggttgtttaaaaatgtgtagcactggccgggcgcggtggctcacgcctgtaatcccagcactttgggaggccgaggtgggcggatcacgaggtcaggagatcaagaccatcctggctaacacggtgaaaccccgtctctactaaaaatacaaaaaattagctgggcgtggtagtgggcgcctgtagtcccagctacttgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaatgtgtagcacttctcccttagtgtgctctctctcctgccaccatgtgaagaagtgcttccttcctctttgcctttctaccatgattgtaagtttcctgacttcccagccatgcctgctgtgtagcctgtggaaccgtaagtcagttaaaccttttttctttataaattacccagtctcagtagttctttatagcaatgtgagaatgcactaatacataggataactggatttaccagatccctctccaaaagtctttctagatttggtcccaagtagaaggcctgccgttggccaaaaatcagctttcagtggtggattgctgttagagttgtttaagtaataccttgctcatagggctgatgctgaaaatattctaaaattatttgtgctatttagctatattaagataccttcaggaattcatttgatgtgatcttacaattgtaggagaggagaattgaggaaaattagcataatgtttatatagtgaagaagattaatgtatggacacctggcatgtatattttctaagaaactattttaatgaactggaatttgaaccctgccattgttacttaaagattcagactaagaaatgctataagaccaagcagaccaagtttgtttccttcaaagggaaagaagattagggaactctctattctctcctatcactgtctctgacgtgggaatgagaccagttcctatgataacagctgtccagcttggaggaactttctgttccaatctttagggaatagaagaccatgggtactctgtagttagagagaagggaatttagcccaagggaggagaacacttattcagaagatcattgtcccattaggtctctgatatatgtgtaaagtacattttctgatttagatttggtaagcaaatgtgctttagaataaagaatttaatcccaactatcattgctggcatgtacctattatactataaaatgatatctccttttattatctaaataactgagtaaattgaatgcttatatttttattaattgaataaataataggcttcacctataaaagtaactaaattctgttgtctgaactcttctttattgctaaaatttagcttaatagctttgttttcttagatactatgttatttaaattttttgcttgaacttttctatgaatagaaaaattaggagtaggaagcagaacttcaaagggaaatgtaattttactcttttagctgcattgctgagatcaaaagcatttgagaagtgacctaggtggccattacacgtaattggaaaagaagtacaatttcttattactgcatctaaaaatgaggacaacattctttaaatatcacgcttatataaaaacttgcagaaactcaatccacatgtcttaattagaagccaccataaagaaagacatttcattgttttaataacttatgttcagaaataaaactgctcttacttaagcactgcttagcagaaacgttaaaatcaagtctagagaaaaagtagaagatggtaatgttcctaagatacatgagaactgagtttggttacagttagagagaaacagaattttttccactcccaaaccagatctattgaatttacttggtttatttttgtatatatttggcatctaaagaatgaattgccttttagacaaaacccttctcgtagttgtttcttttgtattaatagttcctactttgcactaataggatattcctatttgaaaggggactattgcaaacaacaggaatgtatgagttttatgagaaaagcttccagatttttttttatacaatataaatgaattactgaacagagtttgtgacaatgggtatatgaactcctgagtatatgcagatactaactgggagggccacaagtagaatgttcagttattttattcaccttaaaaaatagatatccacgcctgtaatcccagcactttgggaggccgagatgggcggatcatgaggtcaggagatcgagagcatcctggctaacacggtgaaaccccatttctactaaaaatacaaaaacaaaattagtcaggcatggtggtgggcgcctgtagtcccagctagtggggaggctgaggcaggagaatggcatgaacctgggaggcagagcttgcagtgagctgagatcacgccactgcactccagtctgggcgactgagcgagactctgtctcaaaaaacaaacaaacaaacaaaaacaaaaaaaaaagctatcatattctggaccaactggatgattttttagtgtacttcctcaagatttttgcgttcatgcttgcttttctgtttaaaatcagtgctatagtagttgattttttttctgtatggacaagaatgaaataatcattgacatatagaaaagtgaaggaacattgaatcatcgcatggtgtataccttctcggtctgtagcatgttcatgtttaagccactgaacttgacactgtgagacagtgaacatgcaacactgaaagaacagctggataaagcaaaagggtgtggcaaatcatgccatacttaggaacagctgtgcagaaggaggtgcagtggacataagagaagactggcatgggagacaaggtgagtggaatctgcaagagccagtagattcttggctgtgatgggtacgctgggcttgagtagtgaggaacctctttaggtctcagatagggctgtggctgaagcgtagttgtgttctggaagtattgtgggtttttctctccctcagtgtagtagtgcatttcctattcaacgacacctccaactgataggtattaattgtcttaaaaaatagaaaaaaacaactatagttcttacttacatagcacggtatgctgggcactataaagagaaaatgaacgcctggtccctatcattaaagaacgaatatgctttgaaactcaagaactgtacagatgtaaggtagcattattattgtaataaaagaaaaagcgttgttctaagcaggcagttaaacatacagaagaaaatttataacattgaaaataccctgaaactctagctcgttacctaacagtgatttcatttattgtgaaaaatggcgaatgcaaattgcatgccttattatggtgtcatcatcagcaatttcatcttgcaaaaatggacaccacactatagataaatcttggagtccaagtattcagcatttaaagtgtttgtcagtattcactggcatctttgaatgttatagctggggaaacgtttagataaccctttgtttttctcacaccattgaaaaaaaggtaaagagacattaaagagtagccccacatttcttgactgttaacacagcagagccagaactccctgtaaagactctgcttcccagatcaatattggtggtggtttaatttaacccagacatctcttgacttatgccccttctgattgaaacccttcgatatggtttggctgtgtccccacccaattcttatcttgaattggagctcccacaattcccatgtttcctggaagggacctggtgggaggtagttgaatcatgggtgtgggtctttcctgtgctgttctcctgatagtaaataagtctcaagagatctgatggttttataaaggggagtttccctgcacaagttctgtctcgtctgccagcatgtaagacatgccttttgccttccgccatgattgtggggcctccccagccacgtggaactgtgagtccattagatctctttttctttataaacacccagcctcaggtatgtctttgttagcagtgtgagaactgactagtataccttttcagtgtcttaccatttgcttgaaataaagtccagggccgttaacgtgacccacaagcccggagtgtcccagccccacctacctctccaaattcatccctgccattcttcccctgctcccatgccacaatcgcagaagcctgtcttcgtttcttccagcccaacaaactcccatggcaggaatgttgcaactacttcaactggtccccattcttcacctgggatgacacccttctgctctcatatgcaatattttttttttaggaactaccttggcatttcttgacctttccaactaaaccagctctctctgcacttataatttataacattgttttcctttgtggtatctctgattgtttttatgtatttatttgtgaatatttgctttatgtgtttcctcagctggtctgttctcttcatgaacaaatgtgtcaattttgttccttgctgtacacatagtgcccagcacagaatacagactcaatacataaatatatattggtgtttggatggaagaggaagtaataagaatatgattgtgataatcactggaaatagaagtaatttgtcagttttacatgattgaataattgaagcaaatgtctgccaaaacaagttagaatcctgtagaggagctacattataatggtattgagcaaaatatctttaggtgaaggtagtattatgtatttctgggcattacaaaaatataagcagaaatatattttaaaataatgagattttagagtagcatgtatatgtttattaattattatcctcactaggagatcaaaacagttgattaagaggaatacagttccacaatgggagagccattttgagaattaatagactgtagctggcaaaaggaaaataggagttagagcttagcaaagggagaggaaatttcttctacccctatcctcccatagttcagcagcagagtgtttattaaaccaaaagtgatcaaatcacttttactgtgtcagcgatgggctgaaaaaggcacctgcatttcatgaattgatgagtaattgtttttagtcctgattctaagtaccctgttgattgcaatagtgtgatgtggttgaaaaagcactaggtttagagctagaacacctggatttgagtcctagtgtcaccacttaccttgttcattagacctggtacaagtcacttaacctcactgagggtgattttgttaatgaaatggtaccctgcaggattcttgcatgtatcaaataagataattacaggaaagctcttggagaactggatgcagtgctgaaatgagctctgtggagtcatgtatatatctgtctctaagtaatgcgcttaatgcactttgtgcagataagggtgctacacccagtcctctgatctggacaagctcacgttccactgggtagatgagatgcatgctaagaaatgtgtcttgatgcagaaattatcacaatgccacatactttgggaatttatagatgtggggaagaagactccttactgagatatcactgaagcatttttggggaagaaatagcatttaacctggaccttgaaacatgagtatggtttctatctgacgttccatttcttgttccattgatccctccctgcccctccttacctctcctcccctctccttatgcctctcttctcttacctacccttcctgtctttatcccctgctccgtttgccactcccttccccaaacttgtattgggaaagcagtttgatggttggaaagggtggtttattgatctaagatatgaataccagttcaattttgaaataaaatacagatggtccccaacttaaaatggtttgacttgagattttttgacttatgctggtgtgaaagcagtacctattcagtagaaaccacacttccagatttgaattttcatcttttcccaggctaggaatatgtggcgtgatcctcacatgtgagttgttcaagacttcattataaaataggttttgtgttaaatgattgtgtccaactgcaggcttatgtaagtgttccaagcatgtttaggctaggctaggctaggctaagctatggcgtgttctgtatgttaggtatattaaatgcattttgacttacagtggattatcaagatagtaagtcaaggagcatctgtactccatttattgacaccccatttaaaaaaattgttaaaaactatcaaactatgaacatgaagtgaaggatgcatgtttcgatgtagtctgaaattagctttcaacatgaatgaagtgttaggttttagcttcgtgggcaactttgtctgattttcttccattgacataaaaatagtctcaggcttgtgtgggaaaattaagtatatagatactattgcatttatcaagggagatataacttgtggattcattctataatgttttacaggagaattttttttatctcagaaataagaattttacatctctacaagtaaatcagaaatataattagatacataaattcataaacatacaaaataggtaaaatgattatatggatttctaaaagtacctttaaattggctgggcatggtggctcaggcttgtaatcctagcactttgggaggccaaggcacgtgaattgccagagctcaggagtttgagaccaccctgggcaacatggcaaaaccccgtctctactaaaaatacaaaaattagctgggtgtggtggttcatgcctgtaatcccagctattcaggaggctgaggcagcagaatcgcttgaacccaggaggcggaagttggtgcgccaagatcgtgccactgcactccagcctaggtgacagagtgagactccatctccgaaaaaataataatgataaaataaaatacctttcgattatactatagagcaaaaaaaatcgtgtaggtgtggataagtgagtatgtatgtgagtgtgcatgtggatttgcttgtatgaagacatgaagaaaatacaaagggaaactcttatttctgagaggtaggattgtgggtgagttttttcctttatggttgtttttattttagatattttctacagtgatcatgtattttattataaaagtgttataaaaatgagtttttacatgctatatagaactaaaaacacttacaaatgcaaaaacattatgtcttttgaaatgcaaggcctctacagaaacagtatccctcctgtttttaaaatcacacttttgatacccaatgagatagttcaccttcggtaacatgaggcgtttaattaacatccagtggggtatgattggaccccctgatgtgtcatactttcacgtgaattattatcttgcaacatacattctagtaataacaatgacgttatctagtaagttttcataaatactaagactatataaaaatcttagcttttcctctttatctcttagacagtacgtagttcaaagtatactttttacaagagcccgtgtcttctaaaaatctagggacatgttagaaattaatgcatttagtttaccatttttaaataactgagttttatttcattgacataaaggatccaagattttaagtgtttggattttattctcttaaaaaataaaaattacttttttttttttttttgagacagattcttactctgttgcccaggctggagtgcagtggtgcaatcttggctcactgcaacctcctcctcccgggttcaagcaattctcctgccttggttcccaaatagctgggattacaggcacgtgtcaccatgcctggcctggtctttcttaaagagggctttccctgagtgtatacatccagctttgtaagttgatgaatttggttctcagtaagtttgtaaagagaccctgctgatgtctgatcatgaggagctcactattctgtaggaaagaccataccctagttgggcagctctaatcatttcgaattttcacctgatttccgcctctctgtaatttccagcccttggccatatgttgttttctggaattctaatggataagactatttgctctatgagataacccatcacatatttgaagaccactatttgtcctacctaacttttgtttctaaggctcaccccaacaacccacccccagtttggttcattcagcagaactatctggagcactgtgccctaagcattggggctaccaagatgacaatgataacatcaaggagctcacagtataatggggggagagacagatacatacacaggtaaaataagtgctgtagaagagtgatcaacaaagagctatgaaaccagtaagattctaaaaactgactttgtgctgagcaagaggaggcttttcagaaaaggtcaaggttgaatcaggttttgttttcgttattattattattatttttgagaaggagtctcactctgtcgcccaggctgcaatgcagtggcacgatctcggctcactgcaacctccacctcctgggttccagtgactctcctacctcagcctcccaagtagctgggattacaggcacccgccaccatacctggctaatgtgtgtgtgtgtgtgtgtgtgtgtgtgtgtgtgtgtgtgtctttagtagagacggggttttgccatgttggccaggctggtctcaaactcctgacctcagttgatccacctgcctctacctcccaaactgttgggattacagacatgaaccaccatgcctggctgcatcaggttttgagtcaaataaaatttttctttcaaagaagcagaggatggaagggtatgctgtgcagggccatttttgagctatgggtacacatatacagtgtgatagaagaaataagacctagtgtttgatagaatcagtagggtgactgcagtttacggaaatgtatatttcacatagctattagagaataattagaatctttctagcatacagaaaagagaaatatttgagatgatggatatcccaattatacttatttgatctttaaaagtatgaatgtattaaattattacatgtaaccaaaaacatgtacatctattgtgtatcaatacacaatgaaataaaaatttaaaaaaacaacaaaattgcaagacgttgaaagggcctaacctggctccctgagtaaaaattgtgtaagagggttctagggtatcctctgttcactatgtgtagatcataagttgaggaaagagattttaaccatgaagttaaagtcatatgctacaccaaagtaagctagatgttgatttgccaaatctgtagttaatttatctctgctgggctccatttaggatttgattttaagaagggagttgtttgccataatgttacaaggtcagccctgttctgggtttctattagctacagttagtgttttggagtatcagagaaacggtgcttccttatattcagctcatggcatcaggaggcacaaaatctgtgcttttacagcagcataaatttctctggtcaaggtcagttgtgttagcaaggcacatatcatcgtatcaattttacattttctaagtcattttgtagacattttgttgagtaaaagtattctcttacttctagtaaggtagtttcaggaaaacacttaagtattatatatgtaaaccaaacagacttttcccattgattaactgtattttccattttgattttagaaatgtttaccttaagcctggccacagctttgtggcgacttcttcaatgtactccctgcctcaatctgatgtggccatgcactcgaaattcttaactttctatttactcttttagagagagatgatttgtataatctttctcttctccacatcccactgttccctgtatgtccctccttttctcttgtgcctcattttgtgtgtgcatttgacaacaaatgcagggaggaaaacaaacaaactgagtataatcagcaagaaaaaacatcatcttatgaactggcaaccaaattcttcatgaagaatttggtttttgaagaacaactgtttttgttcaagataatactttgaaaaaagatttgtcatagaagtttaaaaacttgaatagacagctctcattgtctgtaaggctaggtttctgcggcttttaatgtgtaagagacttgtcccatttaacaataaatattttagtgccacttaaaagtataattaatatatctttcttaaaagtggtattccctccctctacgtatatttctctttcctcagccccaaaagcacatattcagggagggaaggtaagggatttacatcctttttccatcactacgtcaaaacttatacaatttatacaatttaatattattaaggtagttaatgtagcagttcatgtgaagttactcagtagaaatactttaaatcatataaaaatatagctgaatataaattgaagggtcagagattaagggtgaagcaagttttaaaaatcagaagcatttccaaattcaagttatttggggtagctgtagagaaataattgaatgacccttagcaatattttaggaaaacttttacctaatgaaaaattctactccaaagctgtgttttacttcataaaattaatagaaagtggggaatatctctacacttccaatatcatgctttcctttagtcctagtaaaaagggacccagaatctttgttttaccctcccaaattacccactttaatacgaatacatgaaaatagattttaaaaaagaagtgaataaaatagatgaatttgtcctttttttttttaactatggtccttagacaatagctttcaactctccatagaactggaacaacttgcacgatgttgactacagtaagataacaaaattgtatattgtatgaggcaaatacgtgtggttgtcttatctaaccacaatgataagtacggtagtgtcatccagggtttcatcttctgcagttcagttacctatggtcaaccacggtcgcaaagtaggttgagatcattacaatgagatattttgaaagaaagaacactttcacataccttttactgcagtatattgctgtaattattctttttcattattagcattgttagtctcttattctgcctaactgataagctttattgtatgtaagtataggaaaaaacatagtgtatatagggtttggtgctattaccagggtcaggcatccactaggggtctggaaacacatcccctgtgggtaagggaagactactgtacataatttgattctttctttctttttcccaaatagtggtcatatttgatcagtcacctttgctcatgaagagcacattggcaaggacaacacaaagaagcttgttctgcaactcggttttcttatgttaaatatttagttttctgcttgcttcttcttatctgtttgtacttggtaaggctccctccttcttatgtgataggttggatgctgccggagaggttactagtgcatggaagctccaaaacagagtggaatggaaaattatagcctcaagggtatccttgggaaggagccagacaaaaggtgcatgcccacattgagacaaagctaaagcaaaactaccaggtgttagaaaacccagagcacatatacaagaacaaggcaaaaaattcctgttactctaacagtatgccttacttttctttaattttacttatttgtaaagtagacaaatgcccctgttgtgtcttgttgagttacaagtgcaacaagtagcattctagagtgggatgttactgtcagtgcctgttttgggtcactttaatatactgctgtttaattgattttatatctgaagatgcaggtctttaacatggacagattttcataagatcactggaatactggctttcttttgttttgcgatgagggcaaattttctgtggtttatttttccccatttctggtgaaaataatattctcttttcctcttctacagggaagatggcagtttcctcagttaaacttaggatctttgtcccttttaaataggccattgtataaaatacaaatgatcaaaattgtatcacagtaataattagctaatttttttgcagaagttttttggtggggtttttttttggtgtcaacacaactttaaaataacaaataataagagaaaactttttaacattgtaggaatatgtgaaattgaatagcaaactcaatttagatgagttcacatgaataacatacttcaggttggtaatattccagaaggttcaactgcctcatagaaaattaaatctctgaaaaattccccgactaaaaatcatttgaaaattctaattttttctaattatttggattttcttatgttagatttcatttcatggaaggatattgagtttgtgtatattcctgtgtgtgaacatgtgcttgtgtgtgctcttaatagcggttatttttcaaagcaatagtctttcaagcctttctctaatctctccagcatctaaaatgaggtgatataaaactcccaggtgggtactaaatattagatttgttgacaccagcatgggtgcttgagtggtagtgggaaaaagaaaaatgattgtctagagtttgtatgctacagaattgaggtggtttcagctgctttcatttcctttaaagaataatattgtttttttcaaatgaggaggattaagtaagcaccttaaaaaaagaggagcaatatattgacaacatctggtatgaagagttattataaaaggtaagaggatctgtgccagaaaaagaatggagagggagattctctctaataaataaatttcttttaaatgtgcctaaaacattaagggggtttttcccatttaaatttatctttgaaaactccctagagaaggagagtggtttctgtaacagctggttagaattgctgagcaaatgtctggaaaagatgattttgaaacaatgtgttttgtaatgtttaaacattttacatttttgttgaaacctgacttctgatgaagaaaatcgctctgtacagcaggcctgcgctgtgggctgcttttctgctttctctagagctgagtcactgaggactgctaccttagctcctcaaagctgttaaatttctcgaagggaagctgagtcattaggaaatgtaccagaataggagaaagtaggtcattttgctagacttggcaaaactttcatcagcttcagattcgcaagatctgcagttctcaaactccagggttaatcagaatctcctggagggcttattcaaacatgcgtgtctgggccctcctggcagagttcctgattcagtaggtctgagctgagccccgaggatctgtatttctgacaggttcctaggtgaaggtgatgccgctaaacctcggcccatactttgagaattgttacactagtgaaagcttggagagaaaaaaaaaattagacaagccttccccaaaggtttggcagtcagcttcatagttggatggaggaggacactaccatttattaatcactagatactgtcccagtcttgacattcaatcttccatccaattctgtaacatgagtcatggtatatctatgctgcataatcatctgtacagaactcacagaactcagttagtttgtttccttcctcttctctcctctcctctcctttttcttttttttctccattgccctggctgaggtacagtggcgtgatcttggttgactgcaacctccacctgtggggttcaagtgactctcctgcctcagcctcttgagtagctgggactacaggttcacaccatcacacctggctaatttttgtattttcattagggacgaggtttcgccatgttagccaggccggtctcaaactgctgacctcctcagcttcgcaaagtgctgggattacagatgtgagccaccgcgcccagtccagaactcagtttccataatcaacctgcccagagtttaaagccagagaagcaggtgcatctgaatttctgcctttgtctgtttagatctaaaggttcaactctttctatcaaaacatacttttgtacttgttctcaacgtgtctttatttcctcttctttttcattcatacatgttattcagaggatctcaaaattctttggagttttacaaaggaaaagttcaatttccaaaatttttttgcgacctgacatcccctactatcaggtaacactaatttatttaatattgactttgcttatgagtaatggcaatgcacaaagctgatgaaagccgaaattccatcagatggatttagcaaattaacaggagagagaaactacttagtttgtgagaaactactcgtttgtaaactatgcaaaaaggatagacattgtcttacctaatcacaaataagcctttcccaaaggaagtggttaccttttaaatgtgtgcacttatgtttgtttttaatccaaatttgtgccaaggaattatgtaattattatttctgtacaaaagttacttagccattcctaaattatcattcattgatgtctgagagtaaataattttagtaccactacgattaaattgtagcaggaaaaaaaactatgaaatagactcattctgagtcattgcttatagccatttaaagttgattagcaatgttagtttaggagatgtaaaaatgcaaaattttatttttaagttataatattttaatttgtaatttcaatgagctataaaggaatgtttatatttatggaaactctatgaaatataaagaaatgctctcacagatgtcattttagatatattaagtctgctaaattcaaataaaagttttggtactaacgtgtgagcacctggatggcgggggctgggtgttatatatttttacatcgaagatgaagtcctgcatagtgacttgcatgtgaataggagtcaggaagcattgaccaaatgataaagcattgctccagctgagttacaggcctattctttttagctcaaatcaacccattaaattatttgtgagataaaatttttctcaagtgtatttttccaataagaacttgaaaaagttgtacgttttattttatttgaaaatgtattaataactttacactattgactttctcctttcatatatttttaaatatgagaaggctattatctgtttatatgtgattatattgccatttggcctcaattgctcttactctcctcccccactgggccacatttctaggtcaaattattaagggaaaaaagatgcaggattttcaagatataacctctcacagagtatatatcttaaaagaggaaaatgtatcctgcacgctgaggattacctatggctaaatgagagttgaaaatagaagcatgtgttaaactggaagtcaatttgagagaatgtaatagaggacagtctgacaggtgttaatgttaccctcaaagggaataagctggaagctataaaaagtgtatgtagccaccactcattatgatacatgatattcttgctgacttgaagtaggaagatgaaaataactagtttgtttaaagctgcatattctgataatttaggatttaactttctgctttgaacaactttttcatgtggaaaaccttaactttttataggtataatttgttatttttaataatgcttataaaagtttttttaaaaagtaagctgtattgtagaaatcatcaaataccaactagaattatattttaatattttatagattttactcatagagtaaaaattacattgttagatatgtaaggggtggtaacaccttttaaaaatcttggttgtccttgtttgttctgtagtttatgaaaaacagagattctaaagattgcacctatgcatgaaatctgatttgctcttttgtgcagtataagagtatggctgatttctttcaattctgagaaccttacataggagaccccaacctctacataggttacaagtgaatagactctgatttccgttgattttatttcatgtaaaactataaccttcacaactacacatcaatctcaaacttctttgaatggctcactacttaaaagtcatttttccctaaatgatatgtatagatataagtgatctgaaaaatattttcaagattttattgtccttcttacctatatgcagaattgacatatatgcctatataaaagtggaaaatctgtatatgatgaaacaccatacgtagttaaaatacaagagccagattgagaaagaatatctgcagattgggaatagaataattaatggtcaaaggattggtatcttgaatatgaagaaaagtttctataaatccaaatagaaaaacaaatgaagaaaaggaaaaaaaatgcaaaggttttgaataataagtttacagaggaaaggaagggcaaacattgacaagatgctcatgctcactgtctaggaattggtaattaaaagaaaatgctttcttaagattggtaaaatggataaggagtgataagatagattcagtgttggctttctacactggtgtgggaaggcagttgctcttcatattaccaatggtggggatggaaattgctaaagcctttttggtaggatagtttatgaaacaacttttagaactaaaaacaatgtgtaacttttgatcaggcattcaaatgctaggtatctgttctagagaaatacataggcgtgtacactgcagaattgtaatagctaaaattaatccctaattgtcattgctgtggacacaaagttcatacgttgaagcattaaccctcaatgtgagtgtaaggagttaattaaagtaaaataactttgtgagggtggggccctgatatgatagggttagtgtcttataagaagagttataagagaacttgtgctctttctgtttctctctctttccccagctatgtgtgtacaagtacaaacaaggtccagtgagcacacgagatagccaggaggcttcctatacctgaaagtatttcttaagccattttcttcttcgtacagatgacacattacctccttgttggatgaatgcattgccttcttgttgagaaaaaaattaattcttataccaggagattccgactgcctgtaatgtgttcagttccctgaatcacagggaatatgcccagtccaccattcctttcaaactcatcctctgactgtagatgaaaggagataattagagtcgtagacattgggattgctctcttataaaatttactctatattttaatatagtcatatttgaagtgtgttacttttatcataatctgtatatatgctggttcaagaatagagtagtcatcacacagattaaggaatagactatcgccacgtatttctatatcctgaaactatatattgtttaggtatgtttgtttcttgaggaaaatgtataacagctatttttctgtaactttctttcttttttttttttttgctaagcattgtttatgttttaactacgttgataggagtagctgctgtcctctattgctataactatagaacagtggttttcaaatggctttgactagaagccaccataagaaatatgcttaaattgcaaatcagtgtgtatacacatgcagaattgaaacaattgaaattttagagttagcttgtctagattcatgaaaaaaactggagagtttaacatggcataattaataaggtcttaaatagtaaatacagttgtccccctttatctatagcttcattttctgtggtttcagttatctgtggccctaaaatatgaactgaaaaattccagaaatacacaattcatatgtttcaagttgcattccattctgaggagtgtggtaaaatctcgcaccatctcacctggagcgtgaatcatccttttgtccagccttttcactgtctgtaggctaccatccattccacctgctagccttctaagtcatcagttcagctgtggtagtacttcagtgcttgtgttcaagtaaccctcattttacttaataacgtccctgaagcataagtgtagtgttgttggcaatttgaatatgctaaagagtcattgtcaagtgccttaagtgaaaaggtgaaagttctcaacttaataaggaaaggaaaacatcgtatgctgaggttgctaagatctgtcacaagaaggaatcttctatcaatgagattgtgaagaaggaaaaagaaatttgtgctagttttgctgttgcatctgaaactgcaaaagttacaatcattcatctcacttcatctgatcacgtaggtattctatcatttcacatcctcacaaaaatgaagagtccagtgcaataagatattttgagaccacattcacataagttttattacagtgtattgttataattgttctattttattatttttattaatctcttattctgcctaaagtttataaagtttataagttaaactttatcataggtgagtatgtataggaataaacatagtatatataggattcagtactatctgcagttttaagcatctactggcggtcttggagcatatcccctgtggataaggagggaccactgtttactgtctgtcttttaagtttattcagttctgtttttagaagttagtaagtgtagggttttaatttgacaattattatcagcacattgaaaaatattactgcactgttttctggcttccagaattgctgtcagaatatcagctgtcagcctgggcaacattgtgagaccttgtctctacaaaaataaaaataaaaaaaaatagttagctgggtgtgtggtacatgcctgtagttccagctcctctggaggctgaggcagaaggatcacttgagcccaggagattgaggatacagtgagctatgattgtgccattgcacactccagcctggatgatagagtgagactctgtctatctatctatctatctatctgtctgtctgtgtatctatctattatttatatatgtatctatatatatattttaaacatatattaaaaataaagtctgtattcttaaactaaaagctggcatatgtgcttgctaacttcctggatctcttactttgaattttaccatctatagcttatttatagtcttcatttcataacatttttcaagtaaaattttatttgactttgttttgtttctcatttagagtttcttctgtctcattagaagataaagtttctagcttatcaataacaattttaaaaatcaatctttaaggtcctttttaaagctcttgttaagattctttaagttgttttctaatttctgtcatgattgtatcattctatttctttgatttagaggttgcttggctatataaattgactttatgaaaattcttgcaacacataattttagggaagaaaaatgtcacaaattagaagaagtggctattggaaaaagacatccactgagatttaagagtcaaatttggggtctattaatcttgacagaataattagagtgctgtcatttttcaagcagatagaaaaatgaatactctgtaggacatacaggacatacagaatctcctgagaattatgattatttctaattcacaaattactgtatgcatattatttaaaaatagaaactcttttggtaaatatgtttgtaattaagacttctaacagccattcagcattgctgtttcaatatatgactaggctgaatattaaccttcttgcaaccttttacgtgagtaagtttgaggcactgaattctaactaatatgagaagaatcttggtacttagggaatagtgaagtgctgacatctttgtaatctaacttctgaaccttttcatgaaatttaaatgttattacaatgttatcatcccaaaacgctaatttgcataatctttaaaagactgcattttcatacattaggccttcatgggcatctaataaatgacagttagtgacacgttacttagcatttatcagaaagaaaatgtttttcctcagaagaaaaaaatgctttttcaaaatgctgttcttcctttctaaatttgttagtgtattcttactcatgactagagcttatgtttaaattagcatttttttttgcagctggcctaggtaatcattgaaaattgggagttaaatgagttattattttatagaaggataagtaaattgtcatttagtatttctagaagcaatggtggtttctggtaatggagaaattgagaattagtgcatagcaaatgaaataaattggtatttttctaaaagctgaagcgttaacgtattagatatgtgcacatatctatgcatatgcccatacatgtctacaagtcttttggagctggcacatgttaatccaggtctcagatggtagtcaatcctgtcaaacaacttgcatagtttgccttggcaaaattccagtatttgatgctttcagatttgctacttgaagcttagtttgtattttgcctccattttgtttcatggaaaacagtatgtgatgtgagatttggtggcatgatattcctgttttgttacttttcttcttccgatatttctactaaataaacaaatgggaaatgagtacctcataattgaattcattcttccaaaagagaagaagtaattgaaaccactgggttgccttgatattttgcagaaagtaaacctttcttggacaactgagattgtctatttattgtgattgggactcataggcttttgagaggtaaacctgggtgaactttcttaatcagtcaaaaaaaatatgtatatatatatagatatatgtatatatatatgtgtgtgattgatggggtgagagtgatgaaaacatgtaaaaggcagaggcagttactgcatttagtgctcatagctcagcaggaagttgctgatatgaactcgttgtattcatattcgcttcgtgttagtgggcagtgctggcagggttctcaaagcccctgactcctactggatggcatcactctttttctaccttagctgagcaggcactgaccaaatgctgaaacatgtgactgcctatgagtttgcatagtttgtgagctagggcagggactgtgcttaatgtatcttttatgtttttgcataatgtcttacagtgctccacacatggtatacgcctgtttttgtattggtagcttgatcattatgactgtctggcaaattacactgaatgctgtacaaggaatcatattgtttccatctggtagagtaagacaaagactgtagaagtacagtcttttgtagaaggcttgcatttggtttatagattgtacttatattttggcagaagttttcttaaagtggggagaatgcttctcaggtcaggaaaacttgaataatgtaagtattcccaaatagaatgtcgatgttcgaagccattataaaatgaagcatagtgattaccctggtttataccagaggtactccattatttcccatttattaaccttggtgaaacacacacttccctttctgcttttattcctcagtcaccaagaaaaattgctaaacaaaaatagaaaataattcaagtctgcctgcctgtgtgagtttgctatttgtaagccctggaagggtgtggtaagcagtaatcatctcctcctccccaccatcatgctaaccaaagtgactttcctcaaggcttctgatttaatagaatagcagaagaatattagaatgagtagagtactgttaaactaatcagcttgttgtcagagtgaatggtaaacattgcaccaaactaggttctgaatgtaaactttattttacagagttttattctaacattaactttaaaatgagattcagtgatagttattgttttgctgtgactatccaactgtatttgagttttccattaaatattttatacaggttaaatagattagaaatcttggacctatgtcattattaataaatgggcacattgcaataaaatatacgttatcaactggccaacagaatgatatcaacaagaagaataaaaacacatggatgtagcatttgacaatccttttttttttttctcggctcactgcaacctctgcctccaggcttcaagtgattctcctgcctcagcctcccgagtagctgggattacaggcacccaccaccatgcccggttaatttttatatttttagtagagacggggtttcaccatattggccaggctggtctcaaactgctgacctcaggtgacctgcctgcctcagcctcccaaagtgttgggattataggcatgagccgccacacccagctgacaatcttttttcaataggtggttttgattgatgaaaaagtttgggtatgaaatcactacaactcccacagagtgatataaggaaggtgttagaaagtaatgacagtagtgtgtaacaaatgactgccctttaacacattctgaatttcttttagtcttttaggtttcttgccacaagtttttttttttttcttggcaaactctgctttcttaatagtgttttaggcggttattttgcttttaaattccagtggagttcagtgctctttaattttcattattgccctgtgggaaatactgcgtatatatttatgtgtatgtatagaggcttgtatgtatatatgtatataggggagattctggttaaggactgttacaacttagggtaataaataaagttaatttcataataaagcatatgactgtgtatttcctcttggccaatagtttaaatgttcatattgtaaaaagagagctgtcctattttttcccaatgcaaatcagaataatgttataaacatgaagtaaaaaaattttgaattgatatttaaatactggaaaaaaaatctatacacagcaagcagctttaaccagtggatttctagggattagtatatttctcaagaggctgaggcgttgtgcctttggtctcagtcttaatgtgcttgagacatgcaataattctacagaaatgcaatgctccagagtgtcttgtttcttaattataaaagctgttctaattattccattttaagtgctaacttatttaagttttaaaggctgagtaactcagctaaaatttatttaattgagatggaatagggactgttgaatatttagttgtcactaataaaatatagtatataataaaggaaagcccactacaatctcatttgtcttgataataaaaagttaacatttttgaagttctttcaggtcctaagttattatatggtatttctcaattctttgtattcaaaatgtaatatggaaataatgaaatattaatgtcttaaagttcattggattgtttaattagttatcaaaatattcatgaatttgatagaaagtgtttctgttcattggcattatttttaatattctattttccttataactatttttttaatgattatcaccatgggcatcttatcattcatcaaattttatcaggtattactatattctagctccgatttgataaacatatgttccataggaactattaagttatagattgtagtaccatgtgcaatatccataataaagaaatacaaggagaattttagaattaaaatagaggacatctcactcaccttagggagtcaaggaagtcgtcttggtggatgtcccacttgggctgaattttgaataacagttttttagtgctggcttgatgaagcctgaatgtgtgaaagtgaagacagaatgatgggctgggttgtgttgtttgaggccaagagttcagcaaactgcaataatcatttggtcttcattcagttctccactttcattatacagaataagtcagacgtaagaaagctggcaatggaagtcagtactggaacttcttatatacacaagctcagcaaactaaagaatatgctgacaaccataacaaataactaaatgagtgatgaacgaactttagaaacaaagaaaaagaaacagaggatatgttcaatcattttttccccacagatattaactgagcactttgtatgcatttagcatgttgctagaagctgaggagtcatcagtgaatgcaataaatatgatccttgcccatataggcctcattctagcaggtgaagcacattttaataaataatacacattttaataagtaattgcacaaataagtgtataattacaagttgtggtaaatgctaggtagaaaaagtaaaggagttagagaggatagaggagttttatataaatagagttagggatcaagctaacatgtctgtgggaggaatgttatgctgagacataaaagaagagataaaaatagcaatggaagagcaaggagtagggcatttttggtagagagaggagcatttgcgaagatcctgagaaagaacagagcttggagagttcaaaacactgaaagaaacatcatgagaatgaaataaagcagatgagggaacaagtgatgtaagatgaagcttggaggggtaggtggaaaggaactcaggagagtcaagaaacagaagagtaaattggaataaagatgtgaggagccaactctttcaaggtctatatggaagtagtgctgttcagtaagaactcaggatttttccttcttggatgcagcaaggaagatggataggtgaggtagaagtgatgagggcattccatgctaaaagtataggttagaataaagacaaggattttcctgagaaaaatgaaggaatctagtttggaataagagggggtaagagaagcaaggcagtatggataatctgttgaaaggtaatgataacgaagcagaaagtatgaatcttttcaaagataatgataatgaagcagaaagtggtgaaatgttctagaggactcagtaatggggcatcgttttcacccaagggtgaattgatgaatattccatactgaacacaccatgctgagcacatagcagatactcaatagctttcagaatcgttgacctcctcgggacatgaggcaaaatgtctcctgaacagaggatagcccatagttctagtcaaaaagaacaaatattagcaaaatatgaatattagtctcatcataaaggtatgtacacttctgaagcagctgtgttgtctgggatatacaccctggggttcatcactgcgcgccaggaaaatttaggtcctggacacacacaaggagtttaggaacgaaggtttttaataggaagaaaagaagagaaagaaaaaatagctctttctgtagagaaaggggtctccaagcaaaaaggaccagtgggcggtggatgcgctgaattttatagtcaggtttgaggaggcagtgtctgatttacatagggctcacagattggttggattaggcatgacatttacatagcgtgcaaggaaggctggtgtcaatatattgaccctgcctgggcaatgtagtgagaacctgtctcaaaaaatgagaactactaggctcaagcagttatcctgtctcagcctcccaagtatttgggattacagccacatgccacagtgcacgactctaaaaaatgtattttacatgatcacatgtaacctgaaaatacgcatatctgccgggcgtggtggctcatgcctgttatcccagcactttgggaggccaagctgggtggatcgtgaggtcaagagattgagaccatcctggccaacatggtgaaacccgtctctactaaaaatacaaaaattagctgggtgtggtagcgtgtacctgtagtctcagctactcgagaggctgaggcaggagaatcacttgaacccaggaggcagaggttgcagtgaaccgagattttgccactgcactccagcctggtgacagagcaagactccctctaaaagaaaaaaaaatatatatatatatatatataaggaatttaaaaatatataatacattattactaactgtggtcaccatgcagtgcagtagatcattaaaacttactcctccagtctaatgaaactttgtaacctttgatcaacatttccctttcccccattctttctccccattgctccatattctggtacccacctttgtactctctgcttctgtgagattggcttctttagattcctcatgtgagtgagatcatgtggtatttgcctttctgtgcctggctcatttcactgagcaaagtactctagttccatctatgttgtcccaaaggatggaatttttctctttttaaaggctatatagtatttcagtgtaaacataccacattttctttattcattcatttgttgatgaatagttagattgctttcatatcttggctatttttgaataatgctgaaataaacatgggagtgcagatatctctttgacatgttgatttcatttcctttggaaatatatccagaagtgggattgctggatcatatgataatttttatatcttttaggaaactccatactgtttcccaaaatggttgtactgattgacattcccaccaacactctacacaaaggttgcctttcctccatatcttcaccaatatttatcacttgtcttttttgtaatagtcattctaacaggcaggaggtgatatctcattgtggttttaatttgtatttctttgatgattagagatgttgagcattattttcatatatattttggtcatttgtatttcttcttctgagaaatgcctgttcagatcctttgcccatttttaaaacagttttctttctgttgaattgtgggagttccctatatattttgaatattagccccttatcagatggacggtttgcaaatattttctcccaatctaggttgtatcttcactctgttaactgtttcctttgttgtgcagaggaaacaatttttagtttgatgcaatcctgtttttctgtttttgctttcattgcctgtgcttttggaatgctatccaataaatcatttcccagactggtgtcatggagcatttcccttgttttcttctacttatagtttcaagttttatgttagatttctttattcttttgagtaaatttttgaatatgttgtgagataaaagttcaatttcatttttctgcttgtgaatatcccattttcccaccaccatttattaaagagactgtacttatttccaattttggcacctgtgtgtcataatttactataaatacttagatttctttctgggttttctgtcctgttcattggttgacgtgtctgttttatgccatccagtaccatgctgttttgattataaaagagttttaggattttcttttttagatcagtgtgtaatgcctccaggttttttgtttgtttgtttgttttgctcaagattgctttggttgttatgggtcttttcttgttccatatttgacccccactccacttttaaatttaaaaaagaatctctcacttattatcagttattgctgaagccagtgaaattcatattattatctgttttgcatcactgtttgaatgctgcatatcaatcccctggtgaactttgagcatcttttttcaactttcttcagttaatatcattcagattcatgaaggcacatctttcttcagcagttcataaattagcagcatacattttaggggagagccttcatctaaaagtaactctttatcttaagaataaatcctgtttgtatctgtctctcaagctattggtgcctttataagttatcttatgtggaagagaatgtaggggaaggaaaatttgttttctcacccatttctaggttcatgactgaggcccctataggaaaagacagatgaatgagaaaaaatcatacaaatgtacttaatataaaagttttatgtgacataggacacttcataggaaaattaagatgcaaaaaaacagagagacctgtgtatttttatgctaagtttgattaagaagttgataattatagataaatatttttggacaaagggagtatgatctaatggaattgaactgggggacaggggtcaaacaaggccttcttgttcatattcttctctgtgtcttcagagataagaatgtttctttcctccaagcataggaagaacacttctggggagaaagtcagagagtgacatcctcgattttatagcctgcttcaggggacaagagccaagggaaggtgagaatggccttcctgcttctgaagttttctcaaatgtcaagatgacataattagagattctgaaccccattaagagctcatcccaagacaaaaggaatgagacaaacatatccttctacagatccttaatcgtctaaagggagggttagtcctgaacacttggtaatttggatttgtctttcaaacggtacttcaatggaatttatctgggttcacagttccaaactttaaattatggtataaatggatacaatagtgtatccataatattgtaaatggattcaatggattccataagtttaagtatatataaacagcatatttaaacttaaggaaactagttaattgctcattttatcaaatacgttaatactatcatattaaccttagttttcatcaagtggtaaaatatctttaaagttaaagtaccagagaggatcacctcaattgaaacatgttcattgcagcattatccacaatagccaggatacagagacaatctaggtatttatcggtaaagaaactgtggtgtgtatacacaatagaatattattcagcctttttaaaaaaggagattctgctctatgccacaacatggatggtcctggagtatattttgctaaatgaaacaagccagacacagaaaggaaaatactacatgaactcacttatatgtggaatctaaaaaaaaaaaaaaaaggaaaatgaaatatatagagaggataaaacagtggttgccagagttggggtaggggaggaaatagatttaggtcaaaggatgcaacatagggtacattaatgatagtgtattgtatttacgatttttgctaaatgaatagattatagctgttcttgccatgggaggggaaatggttaactatgtgagatgatgggtgtgttaatttgttctacaacagtaacagttttactgtatatataggtgtatatattatatatacatatataatatataaaaaatatagtaaaatacatatataatataacatgttatataccttcaatatatacaatttatttaaaaactcatttatgatttcagttagaatttttaaaaacattatgcttcagagtatttattgcttttaaccctcacaaaattatgcatcattctcatgtttccaatattcacctgggtttgtctaagtatttgaggaaaagtaaaagtttttaagaactttattattctcaaatttcagtgaaattagaatgtaaaatcttagatgtgaatacttttacatgatgtttattaaatatagtatgcttcaaggcaaaaaaatatgacattgaagaccaatatttaatagccaattttttcttttcttttttctttttcttgaagtgagcagaatatgcataatgataggtatgatgaaattttatttagtggtattcggaagtattcgactttaacaagtatgtgctgttctgttgtgaataaaaatttgggaaataaaaactagaaactttactctgcacatattaggagtataaaagtagattatgtttttagaaatggatgagaatagccatataccccaacatcaagatctatggtctacaaagctaaaagatgtaaaagaaatgtggaggttaatacaataagagcaccctcccccatttataaaggtcagacatgcctatggtgtacattgctatctgtaaagattggaaaacctcagatgttgcatcttaaaatatgtacattttctgacatttgggtagaacaatataatttcttataaatgaacttgattcctgacattcagttgaatgttaatttaattttggtgctagtatagcaaagtcttccacatgtcatcgtagttgagttatcctaggagttttgatgactgggaataaagagggcctcccttgaaggctgggcagtgatggagacgtaagataaattcatagcagtaacaaatctagaaagaaaagccctagagcataacccacagcaaatcctgaaactctcttcctttaaggaatttcctggtggccttagggaggatattaatggaactctttaggcttaaccttgttaagggactgttatgcagcccttgttgttttctactttaaagtcaagaattttaagcagattagaatgaagaatagtgcagtgcagcataaagttagtattatactgttaataacattcatctgaattattaatttctgccagcagttgcttttaatataatcaggattaactgtagaaatacggattgttttcccctttttgcttttttatctgaagaataatttattgtaattaagaatacattataaaaacaaaaaggaatcgcagctataaaaatgtgttatatcaatgactgattatattaacattctatagctgtctaatttcttaggctaaaaaaaaaatcaaaggaaattgtttcattcaaattgttgagctttttgccatctttagaaccagtcagctagaggagagtgtttgtgacgattaccaagaatggttaaaaccaaaaggtgttggtttgcttgctctctcttctggtgagacagccatttgaaatagcattcaggcagcgtggcctggacgctgaagcagagcttggcagatggtaccgcaggatggagaaactgctggcagatggcatggactatttgagcaacaaagagacttttggctaccaatgctaagagttggaaagaaagaagacgacaacttctccagtgctgccagcttgtatacagaaaacgttttggcagaatggagactggtaaaagatattcaattgttaactgcaaggaaagagaagagttgttgttattaagtttcctaagtgtgctccctctggtgtgattggaacgtagtttcatatggaagagccctttagagatcatctaaaccaactatgctgactgaatatttggacacattcagtctgtttttactactgaaaagatatctctttgaagcattatttataaaaagtttaatccatgtttgtttttgataagttaaaaaaaaatctttattgaagaccttatttcccaggcttcatatgtgcagattagcagtggttcttgtttagcattgggctaaaataatgtacagtgaagtcaggtttggctaatatgacacaaaaatgtagagttttccctgcaaatgctatacataattgaatcactgaattacttagggggttatagtcattaccacacatctccaatttgttttctggaatctctgaagccacttattacaaatagacatttagttcctaatgatttcattgggggctgctacaatttttcatttgtagctttttcacctattgctacctaatacctttctctctctctctctctctctctctctctctctctctctctctctctctctcgtacctcttatttgatattgtgtttccagaattaattaatttagatgactttcacgtagtaacttttatccacaagtaatactttaagcagaaatatataacttggtttttctaaaataattaatttaacatatcaagaatggtattaagaaaaatatttggggatttttaaatgaaatttaaagtggaaatgtattacttgaggtagaaaaaccaattctatacatattcttaatagttaaatctcctagctcactgaagtttaaatttttggtatctcaattattcagaaaactgctgagattttggatgtaattgaaaatgctactgaattgagatcaaaagggataagtaagttatattcagaatagtgtcactggagatgcctctgagccaccaaaattaccatcataatgattatttaacttttgagaagtactcttggcttttggactcttaccttacataattttctgtcagtctttatgatccagtttttctcagtctgtagaagactagtagcatctgactggaattagagggctgcaagagggaagcatgcagataaaacggcacagagacaggttcagataagaaggatcccataaaaattactcaattaccaaaatgaaatgatggcttcaaggcttcagtggggaaaaactcatttcagttgattcagttaagacatttaaaagaagacatttctcaaaaaaaaaaaaaaaaaaaaaaaaaaagaaatggctgaaagttttgtcacttaaagggcaaatattaattttttagaaaattcatttatttagaaactttcactccatgtttatattaggtaaagagggtctaaatcatgtatgactgtttttaccaatgaccaattttcataagtggaaaattatgtttcaaatctttgcttagaggaatatgcctttttagtctacgtatgatatccactcccagcgatacagctctttttccttgtcctcattttggcaatgaagctggtcttgctggaagtgcagtggaaacctctgggtcacacaagccaggcagccctcactgtgacttcgtcttatgcaagtcacatcactttacctccctggaccttcgttatctcacctggaaaataagggagtggcttttaatgtccttctttcattaatggctgaagcttttcctgtgattccagggcataatttattaaaaggaggaaaaattgatattgattagcatatatgaatagatgtttgattatcaagcacttgatacccgattccacatttaccactggactcctttgccttttagtactaggttcctcctctgtaaaacgtgagggttgatttaggtagatggaatatataaggtttatactacatcaaagactgaatgggttttagttaaattcatgattctctttcttttttgttctgtccccaagaacctctcactaggacactcacatctgttcttgtcaccagagcctcactttttccaggacatcccttttcccctctactgttgcagaactttcccctcagtttagtttaaaccaggttcttgtcacacgaccaggaaagattaggcttgagacacatagaggggtgaggaacagaacttattgggcaaatagtaaaacaaaaaaataacactcagcaaagtgagagagagtcctgctagcaggtttctcaccttacagattgaatcccagttcaccacccaggaactgaagaagccacaggctcctcccaactgcaaatggcgcaaacctccggaggctccaccccgtcctcccagtgtgcaggtgggcattgttcagagaaccagtcgggaaagggcgggctccatccgggaccagcagtctgttttttcagccttcaggctgttttaggcttgaagatggaatttcgctggggacccttggctgtctcctgtctctatcaatacctcttgcctcctctcccactgtgataaagtctttgcactgtgggatgagacacatgaggccttattcattgttgcatctccaccttccagtctgatgcttgttgaatgaattaatgcagatacctcttgtatacctgactcccagtgcctcatcctccactggagcgccatccttgcatcacctttcttactctggtgaggagtcgtactctcagcccctgtggtttgagacccccacaaccacttctggtatgaagacagacagacacccctcattctcattgtcagacactaggcattaggaatcggaatttcagctcttttcccatagaagcaatatttaaaattgtcacagctttggtattttaatataaatacagtgtgagttagaacttcggttgcctggctaaggaatctaaccattatttacaacacagtgttgtttctttggaaatttctattctgggttccaagtgactgacttgcaaataaactttggtaagacagtccatttgtagtttgcgaatggcctttaggccatatagatagaaaagcatattgggataagcatggatctcaatgtgcatgaaatttgcagtgcctcaaagacagatctttagtgtatgacaaaagacagagagtattcccaaataagtctttgacttttcccacagacaccgattttcatgttaagaaaaaccttttcagaacacatctacaagagcaaggtacagttgaattttatgaaaattgaatttgaacaagggctttatgattgcaaactttgtcaatccccatggtttataattccaaaaaaaagtttaagtgtatcactttcatttaagctgtcatctgtgttttgattttccatgggggtgttcctttcatcttgatagcgcttcactggggagattgtttgattgccaatagactgtttcctattctatctttatactttcccttttctgtgtcttaaagtcaccatcgtcatttgcctggagcacgacagcatactcctaagccgttcctgtacttctgtccttgccctgccccgtgccagatttgcatatggaagtcaaagggagctttacaatgggacccatttttttccatgataaaaccatccagtcacaataaattgacttagattaagatgtaaacttcttacctgggacttgaaaagccccaaatgatctggccctactatcttctctaattcagcatgaagcacaacctccttttgactcagcatgtcccagctaaactgacttttttttattgcttgaccacccaacatcctttcttgctagaactaatgcaatggctgtttcttctgtttgtttgactctcagaatctttcttagaattaaagtgtccacgcaaagtccccctattcaaagagtgcttctctgaccaaattatctaatatagtctaatattaaacatcactttcctctttctccaatataacaatgttttgttatcctcctggcattcgttactatctgaaccaattttatttatgggcttaaggtctatctcccacttttgaatgtaaactttgagacagaggacattgtctgattttcttaccaccctatacctggtgcttagaggagtgtctggcactttacagaaactcacatgtgtaagtgagtgctttgatagattactggcctctgtgcattagataccaataacactcttctgatgtgacaataaaaagtaccacaagacatcatccctggttgagaaatatgatatacagcaagaacaaaacaatcccatcaaagagtgggctaaggacatttgaatagacagttcttaaaagaagacatacagatggccaagaaacatatggaaaaatgctcaacatcactaattatcagggaaatgcaaatcaaaaccacgatatgatatcacaccacctcactcatgcaagaacggccataataaaaaaaaatagatgttggcatagatgtggtaaaaagagaacacttttacactgttggggaaaatgtgaactagtacaaccactatggaaaactgtggaaatttcttaaagaactaaaagtagatctaccatttgatccagaaatcccactcctgggcatctacccagaggaaaagaagtcattatacaaaaaagatacttgcacacacatttatagcagcacaatttgcaatcaggaaaatatggagccagtccaaatgacttccatatgcaaatgcccatcaatcaacaaatggataaagcaaatgtggcatatatataccatggaatactactcagctataaaaaggaatgaaataatggcattcacagccatctgaatggaattggagaccattattctaagtgaagtaactcaggagtggaaaaccaaacatcgtatgttctcactcagaagtgggagctaagctgtgaggacacaaaagcctaagaatgatacaatggacttcggggactcgggggaaagggtgggaggcaggtgagggataaaagactacaccttgggtacagtgtacactgctcaggtgatgggtatactaaaatctcagaaattaccaccaaagaacttatttatgtaaccaaacaccacctgttccccaaaaacctattgaaagaaaaagaaatagtgatatagaagaagagtaaatcacagtattagtattttagagtggaaagagtaaaaatgatgcaaggaatccattttcaccatttataagctacatggacctgtgctcttgttgcttaatctttgaaccttggttatgagttattgtaaggattacatgaagaccttgctttcaggacagatcctgcctgtggccagagctagcctcccaatccacctgcttcccattcatcctcattgtgtaccttcactgagggcttgtaccagagcattgtcatgtcctgtgtaacactgggttctttgagatgctcagtatttctagaattttgctatattgttttatttcactgtttttgattggtcattactcatatccagtggagaaagaatgaatctcaagatgtggcatggtagaatgctaacagacaaataggtccagggagctcaaaatccatttccaccatttattatcaataactctgggactttttgttctggttacttattctctgtgagcttttgttgtgagttattgtgagagttaaaagatataaatgaaacactaaaatagggattggtacatagttagtacttaatatatgtgagctgtcttctctcccgtttcttaaatttctcaagccatgtttacatacacaaacaagtatatttatccatacatatctgggtaatcattcaataatttattcattaaaaaaaggtattgacctcctacttattaggtgccagccctgttctggattctggagttggaacaacaacaaaaaaatacagtcaaaagcagtcattaacagtgatgattgtagattatgttctctgatgagttgtgtatgtgattaaaagatatatatgtgtatatatacatatatatgtgtatatatatgtttatgtatgtatatgtgtgtgtgtgtatatatatatttaaatcaccctattctatgaacagtaaattcaggggcgtaatcgtttgaaataatgtattataaaatattgtcataatctcagcactttgggaggctgaggcgggtgtatcacctgaggtcaggagtttgagaccagcctggccaacatggtgaaaccccgtctctactaaaaatacaaaaattagctgagcatggtggtgggcacctgtaatcccaactactcaggaggctgaagcaggagaatctcctgaaaccaggatgcagaggttgcaatgagccaagatcacaccactgcagtccagcctgggcaatgatagtgaatgagactctgtcgcaaaaaataaataaataaaataaaataaaattgtccttatcaaaacagtgctttcctaccacttggtaaagcatttgttgattttttttttcaggaatacaaatgcaaaatattgaaagcctgaacttttgacctaattagcttttgagtttttagccctaacaaatctgagtgatttaggcataaaacaaaacaaaacaaagcagaaaacagcttttcagcttgataattctttctggtttgttatacctctcaacaccttcaattctcaaattagtgctcaaggtctgcgttggtggctacatatatttctgcattgttgtgtcttccagtctgagaatatctgggttggaatgaatttcctctcagggaaatgggtgaaaataactttttgcaaaacatgactgcatcatccccgagcaccattacaacatgcttaatgggctgtatatagtatttttattatcttataacttcagctcccttaacttgtttgaaggtctttaaaatgcacctttgagcattgttccatgtgctttgtgtcccttgaataaatattatacccctattgactttttaattttgaaatttgataacagtagtgaaagagaaatccctgaccattttatgtgttttgccacttcatttcatatagcttctttctctttccggcgatgtatttagcagacatttctctgttttgaatgggtgttatttggttgttaaaaaaataataataataactaaatcccatcgctgcctgttaatctttaactgttctttaactgttgatatgagccaaatgggaagtgtttgaaatattgaaactgactaacctacaccttctactgtaaaaagtatgggagaggaagcagtgtcttgggctggcaaggaatccttatggactagatctcagagattgatggagcagggtctgagggactgtgagtgttccctgagagaaacatcctaggtgccatcctgcttagggcattgaacattgtgaaagatatctgtatatctcacttctggggtggtgaagggtctatgtgaatgacttcatacaggtctctacaaagtaagtcatggccagtctgggctctataaatagatagggactgtgcttaactgtcagtgaatctgagatattttgatgcctgttatttgttattgaggatttattatgagccaaagatagtgtgctgtacttttaaatctttattttatttaaccttcaccacaattccactaggttaatattagtgccattatctttattttataaattaaggactgattcataaagcttatataatttacatatgttcccagtacccataagtagtggaactatagtagaaggatgttgtacataatatatgaggtttaaaaattatccacacccatgccttagttgtagaattttaaaactagaaaaattttagaaattatccagtcttcctccactatcaccagtatttcagatgaggaagaccgtgaaacccggagaatttgagtttccttttaaataccctgatcaagctctgctactgtaacaacttcatgggaggaactctacttttagtgaattacacatcaatatcactttttactgtcgttgtcataaatactttagatttagataggtcacgaatgtagtatatttaagttcaaaacttagagtttcttaatctgttgagctggggaggattgcatgaggcaggattgagtgggactagttaagttgagacgatctgtctggactctgcatttgtggtggagatcccatgcaatggcaattaggtagaaagagcatgcaactttggtgactgacaatttgtacttaaaagccaacaacagggaatcaggtgttatacttatccgtccaactacctctgaaatacatgaagttacatgtatttaaaaggtaaaatgagatattccctgtatctgacctgtgtctaatacaactttgtaggctgtttgaggttgatgtattttttccttttaaaggtttttgttgctatcaattatctactttatacagatcagatgtgatttgtgaaagcaaggaggtattatatgtatgatttttatggggctttgtagccctattagggatgggtctttttggtcttcttggttcatttcacagtttctcaaacttatgtgtggaatccacttgaagaacatgttaaaagattcacatttagaaattctggagtggggcccaggactgttctttcgctcctccttgcctagcagcccaggggattttgatacgagtgattcataatcaaactttgacaagcatagagttacaagtaggattgtgcttctgatctttctaagatgcctctgatgatctttcatgtaaaaaagaaatatttagcttattagaccactgacaatttctgggttttgccaaatctaaaattagagcctgaagattgtatttgtttatctttaccgagattatatttaggaatacctaggaacctaaggaaacaaaatatttcaatgacttctttgatgcagtatgaggttttccttttaatgtagacagtttatttttgttggctgtgattctttttatgcagtcttgttacattgggctgagacatggaggtaatgaatatttttcttatctaggatcaaagaatactgaaaacaggaaaaaaaaatgtgggtattcagtctcatctctacccttaactttttgatattcctgccttgctctcctcaagtgttttggaattgttttaaagatatgtgtctggtgtttttaatgttttgtttataattaaatgtcagaatatccttgttttcacaatggctgcaggtgagtgatatccagtcaattaccagttttctgttacctcagccactggtcagcatagtgttttctgatagggctgtacctactgtgagaacaggttgcagaggacactgattcctcctttctaccctcttccagacctgcctatgcatactagtgaaacaggtatttgttttctctggataacaccctcttcgccctccatttctctgtctctctctttcttgcccttttccaaggcccccaatataagcattttggatggggtggtagagaaagtccccttagattgagaagccagtaaacttaagtatgctgtcaggcttcaagccaaataaagtgctgagcatgacaattaattggataactaccagaatacctcttactgtaactataattcagaatatccctagctgaagttaaaaaaatgatgttaattaatttgaaagttgctaagagtccctatcaaatgcctgtgctctgtttgcatgctaggttttggcattgtgagcaagaggagacaccgatagtgaagctctatccttctgctagggatttaatactcttgacaagccaggaaataggtggtcatgtctctatctcaaagatggaggagaatgaaatgctcggggtaagcgtttcaagccagagctgtcctggttgattaaggtcatctgatcactttgctaagtaaaataggaagatgaggacacatgttgaagagtttgcaagaagagcaaataattaaatattttcttttaagctctgtgaaattaacttggaagttttgttgcatttcagttgaataaaaataatacacaaaaatgagctggttttttaaagtgaagaaagaggtgcacataatgtttcctttgtgtcttttgaatattttatttggaaactagttaaatttgcttaaatacccatttgtttttggtttcagggattttgatgtttgttttgagatcctcagcaacaaattatatttagagaaatgtgggattgcctattattaagacattttaaattgtttgaaaatatttttaaaacataataaaagatttatgctttttaattttgtatcatcaaatccaaactgcaactccttatgttttaatatataatcatacatacatatatcatatattgggacattaaagtttagggaaatgcagtttgcagtaatgactttagatgttcttcctggctctctttaattttaggcccaaagttattttcctagctgtattcacattaattgtttagtattttactgcatatttttgtgtttttacattacagagatatttgtagactgttcatgaattgtaattctctttttaaataacccccttttggggactttgtgtgaatttccctttgatttattatagactataaacaactcaacagactctattgtttgaataaaaaatactaatcatgtcatatttctgcatcatatcctgatctatccttcaattttaactttagaagtagcttcctctttgttttcctgagctcaaggcagaattcagaacacttagaacaatgtatgagacagaataacattttcaatggggggaaaaaagttcaattctaatcccttctcacgttatgttttgtattttttaaacttgaagtgctagaaaagtaaataataatgatatgaatgatttttttccttagaaaatcaactgtcaattaactaatgaatattctttttaatcagtgttaattgacaaatttcctgcacttacaaactcactgcttgcataatagtttcattttgactcttcctgatttcccttttatgtgttggtagtcctgttgggtgtaattctgcattattttctaaattccctcatctggagctagatggagctatgagatcttttgtaaatgtatacaaggccagtggctcttcttcatctacttgtggcattaagtagattaaaacccaattttaaagctttcttgtccctttattcttaaagacagcatggaagagaaagtctggatatctaaaacacagtcattaaaatggacagtcacacagttctttaattatcatttactactgagcaactcaaaaaacaaaaacccaaactcccaaaatcaaaacaaagaaaaacacccggctacatatatacctattcttaacactattgactcaaaactacattaaatgtgttttcattaaaaatataattatttttgttttgttttccaaaagattataattctctcagaaatccacacaatacagaaaatgatgggaaaagcatatggcaattgttttaggacttatctgccaaattttatacatacacattttatagatagatacatggatagatagttatatatataacatacatgtaatatatatgtatgcatataattatataaaaatgtagaaaatatttcacaaggaaggattaaaagttttgcttaaaaggttttggataaaatgtcatcttcagtttccctgtatatagggacatttagatgatctcgtcactgtatcttatccatgcctacagagcattttgggaggaaaggtattcattttttgtgtttgtttagttttttgctcagctttttattgagctagctatgcggttttcttgacttgttattcagtgtgtttaagtcctaagagatgtgcccagactgctgtcatactgtttaatatctgttaggacagaagttgttaaaggtcatctacctactttgagaatctaattgtaataaattcttctgtgtgtttctctaattggattaactttagctctatgctgttcacatatttgggtaattatatgaataattttcatttacctaatttggcagatactacataaaccaaatacttatttgaactctacaccatcttgctttttaagttacttgtaggctttactcttgagtcttttattgtgaattgtatccttttaaactttaatgtccctctatattctgtccttatttgcttctcaaatctagagaggagtaaacagtattttaaacaatttctaaagaagtaagaggtagggaggtggttcttgatttggctttaataagcacttcacttgaagaaagggcattttactaatctagctattaggtaagtaaaaagataaagataattataatgtaatgattataaaataactagtagataattaacagatacatagatagaggtgttacatgtgaaagacctgagcagtgaagctctgcataagaaggacagacactaaagcgtatatcctttacaggtagaatcttgttcaggatctgctttttcttgctttacacacaatttgactaggcttcattctcagtcttttaccctaaagaggacgtgaatgccattcagtcctcacaacagtaatatatggcgaaagctgtttttcctatcatagcaggcaaggcaactatagctgagtccaagccccaggtctgaaagtgggagatttagactcggttgtctgattctcaagccagtgatttccccagccattcattattcatttgtcccccagacacttcatcacccatccgcaggactttcctaagcacgtattttgtgccagacactcttttaagttgctaaccatttaatggtatgtgagactgatgaggtctgtgcatccatagaatacaaatgcttttgagggtaggcaaacagtacatgagtttgaaaaacaaaacaacatgaaattacaatgtggtaataaagaaacaggatgatgtgtgagtagctagaaacagccctgggtaggttgatcagggaatgtctgtctgcagaagttacacctgagtccacgtaatgattctagctgcaaataagaaaacaaaaatatagtaggcatctggcagtgagagaagaggcaggctaatagtaaacaagaagggcagataggaataaaacaaaactaatggccatgtgtggtggctcacacctgtaatcccagcactttgggaggctgaggggagcggatcacttgaggtcaggagttcgggaccagcctggttaatatggtgaaaccccatctctactaaaaatacaaaaataagctgggcatggtggcgggtacctgtaatcccagctacttgggaggctgaggcaggagaattgcttaaacctgggaggcagaggttgcagtgagcccagattgcaccatcgtactcccgcctgagcgatgatcaaaaaactctgtctcaaaacaacaaccaccaccacaacaaaacaaaacaaaacaaaaaacaaaactaagtgtgggagctctaggtttaggaacaatgaatggccccttttagcacacatgtctctcatgacagccctgtattacatcagggtacattaattgatgcttatgatgattaaaataatttatacaaaaagatgcgtgaattctgttttaaaaagtaagcactcctgaacaattttaggaaaagtactaaatttgaaataagttttggtgcttaaaatgggtaaagaaccagtagtaaaacattcacctcaaaagacaattacaatattggggatgacagagaagagagaagggaggcctaactgtaacatttatatttcttagtttttaaaagatatccagtacatatggatatacaaggtagggtaaaattttttgttatttttttttaaaaatcgaggtataattgaccaacaaaaggcacaggttttacatgaacagcttgatgggttttaacaaatgtagtcacatgtgtcaccaccactccaacagagacgtagctgtttttcattatttcactaagttgccatgtgcctctttccaattagttcttccccacccctgaggcaaacactgctctgatttctataatatcaccctagcttggttctacaagtgcatataaaaggaatcatagttgctattttgtgggacttgggttctgtcattcaataatttttgtgaaattcatccatattgttgcaggcatcagtggtttgctccttttttattgctgaatagtattccactgcatgaatatatctcagtttattcgttctcttctttagctattcctgtggtcaagagatgataccttgtgtttttaatttatatctcccttatcattcatgatttgatctttttatgctttttaaagtttaatcaaggttttcaacaattttactaaaatataacttacataccaagaagttttcccattttaagtatacaattcagtggtttctggtatatttacagagtggtacaaccatcaccctaatcttaggacattttaatcacctcagaaacaagccttttactcattggcagtcactctccattcccaatctatataattttaacagtcttataattttgtatattctttatcaaagtcctagtaaacagctctctcggctttatatctgtacaccttaagcatagtgatggtgtgttgccttctagttttcaattcctttgtggagcatcttgtgaaaatctttagagggagtcaattagaacagtactctcaaacttgaatgtgctttcaggtctccttgataaaatgcagattctgattaggtgggtctggggtgggtctgagattctgtatttccaaccaattccgacatcatgcccacactgccagcctggagaccactttgagcagtgtggtaagagactttggttggcctgccttgaaagagaaacggtgtcacaaagactgtatgttgtaactcttttatctgacaatttatgtgcacatgaagtttttgttctcagagcagttcttaatctgttttgagtttttacaagttcgttacttctctttgtaggtatgtaaaaaggaaatggactttgagagttttaaaggtaggattaagaaggcggccctaaaaatcttacagtatgtcattggtttgttgataactcactgaagagcctgctgaagaataaataagaaacatctgtacagggtgaatctttcgggttctcactggggacctgctgactctgagtaggctttcgtcaaagcctctttgcagggtcttgcctcagtttctggatccactccttcactggcttctccgaaagcctttttaggacctggatttgaagagggaattgtactcctgtttgcagaccatggcagtggagccagttgtaagctattggcctgagtttcggaaacagagtggtgtatccatccttgtaacagtcagggagtggattatcaatggaaacggaagtaaaaaggacatactgtattcagtactcacattgaaaacattaattttggatttaatctttgcctcataaaatgcaataatccaaaagctcatttccagaaccctctttccaaatataatagcttcaactgaatcaacgcttggtaaacgtgatgtatctctagtttaaatgcaaatattttcttaaagttggctagaaaggacatttttgtagagcaaatcaaatttttccactgttcatcatgtaattggagatatgcttctatagacaaaactgtcgttggattgagttgaaggattttgattttatgcaaaaaatttagaagtgacagacaccccatgctactctaagccttagcagatgcctaggcctaacaagtaagatgcgaagaagactgtacatcttgatttttttgtttttcattcttttaacatgttggaactctgcctctactcagggagttgctccatcacgttcatatagaaccctcttttgaggccaagtaaccccaggcactcctaatccagcttccttgttttccctcatgtccaatttttattgggttttaagttgtattaaaggtatattttaccagtaggggcctctgctttatattgtctgacgtcttgactgaaaagcccttaattaggaggtataagttatgtaaatcaaagcgctccactgtagcaatttcatataaccattttatttaaactgaagtacagtggacccttaacctgtgtttgaactgtgcaggtccacgtacacatgtattcttttcaaccaaatgtggattgaaaatacagtactctagatccctgaggaatcgccacacactctagatccctgaggaatcttcctcaatggcacatatgcaccatggaatactatgcagccataaaaaatgatgagttcatgtcctttgtagggacgtggatgaagctggaaaccatcattctcagcaaactgtcgcaaggacagaaaaccgaacaccgcatgttctcactcataggtgggaactgaacaatgagaacacttggacacaggaaggaaggggaacatcacacaccagggcctgttgtggggtgggggtagaggtgagggatagcattaggagatatacctaatgtaaatgatgagttaatgggtgcagcacaccaacatggcacatgtatacatatgtaacaaacctgcacgttgtgcacatataccctagaacttaaagtataataaaaaaattaaaaaaaagaaaatacagtactcagtgagatggaaactcacatagaaggagggctgacttttcccatatgtgagttatgtgtgcctgactgccagactagcgtatgtgcagtttttgataactataaggtcctggaaccaatgcctatactgagagaagactgtatatattaataattcttactgtccctctactcttactgtccctctaccaaagaatttcaccaaagatgccaggattcacaaaggctgaatataccatgactttctgaattgaaacaggaaaacactggtaattttttcaagtactggaggggcatcaaattaagatttatttagtgatggtaatttcagtaagtttgcagacaggagaactgtgtgtttctacttcagtctagccaaatactgtgtgtcagtttggcaataccagttaggagccctacattgttgttcatttcagagagaataattctggctacagcaatttaactatggtatgtatgttcttagaactgagtaactaacttcctcagactgaacctattaaattagtttcaatttcctgccaaaatttatagacaggttgtaaatgaaaaagctgcctctgcccttcattatcactatgtatcatagtttttaaaataaaaatgttatttacttgcatctactgtcagatattaaactacagaggcatccatcagcagttttgttggcactgtaaagaaaaaagtcatgtaacagcacacctggctttagtgttatagcatagagttagtgttgcaaggtgactttgatatgtcagaaaagctaattatgtgccatcaaaggactgaagaaattgccttttttaatgaaaagtattttataggaggtgacaatgatcttaagcaaagcagtaaaaccgggtgtataattatataaattctttaaattcttattagacttagctaattgacatgttactgttcaataacacagaaaaaaattgttaaacataaaaaccagagcaatgattttgaactgtagagataaagtctaatcttaaatggattcttttgccatttttccttccaaatacagtcacaatttttccttgacattatttatggtaatgcgtgtttttattttgtattaaaaaaagagtatagcaaattttaataagaatgaactgttagtaacatatatatgccccttcaaataaaaatgcaattttcttagctaatggtgataaagtgcccgagtctattttcagttttcttgatacgtatagatgtaagtgtgtttatgtgtgtcacacatatatataaatttaatttttatttctttgaggagccatattgagggggaatgtgaagtgggtcctgctgtttggtatatcaggattaagagcagaactttttattgttagctctgacagaatgtatgtgattattagtgatgtctttttttagaaaattgtaaattataggaatgctacacaggaagaaagaaatgaagcatacagtagttatgtaggtttacaagattgacaattttttttttccttcacagaaagttcagtacttaaagcagaaagctgtaattgttggttgctgtagatgcccttagctatttggaatgtggaaagatgtatgctataaatgttttactcctataattgtcatcccttcagaatggttcaattatagctattttgtaggaaaggtgcatgaagaaacaatttctggcagcattctgtaatgaccattcaagtttttaaaaaattgcaaatgtaaaataaacaaacccatttttgttactggacagggagcacagttcccaaagcctcctgtttcacatctcagatgacaggtcaagcaggggccgtgacaggcaacccacaaagtgtagttggttttggtgcttggggtaagaacgtctcaggacatgctcaaggctatttggatttatgaaactgaaatgtcttgatttaaagtgaatctttaaggtatcaactgagccaggtcatagagctctggactgtgaggaaggagttgggttcattaatcctcatgctaacccatgtgtgttgacactaatcaactaacctcacctctctgagcatcttacaatgacatggtcagctctaagactgcttagattatatggcaatgctacactcctggaggaaaccaatgtgaaaatggataatctgtaaattttcttgggaaccaaatgcctgtatgggttgtgggggtatagtgcaagattctgaaataactcctgattgttcttaggtatatgccctttgtaaagctattaaaggttgttaattaccagccttaaaagattggggaattgaatgtttggttggaggcggtttggcctgtattcttacttttggctagccaaattgtgtacttacatctgacagcttaattctgaaattaggtttgcaaagcccggatatcagtgggcttattctttttgccagtgctggattgagtatccaacagaagtcaagtgccagagaccagtcagattgaaatagactctaactgatgattagtagagtttcagtgggaaagtcagagttctattcattttgattgttttattaagtgtgaaatagctaagcatccttttttattgatcagacataatgtaactgttctaaaggattgtttctttgatatacctggattgtgcttcctaaagggaaaaagactggatccatgattttattttccagactaccaactcctgatacatgaaaattgctctataaaataatctctttctcttagttgtttgtgatttaatatagtttagcatgttggaattaccaattgttccctatctctgtctttgactaattgccagaagtttcatttaatagtatatgatacctactattatgtgttatataggtatatcatacatatatagagagagagcatgcatatatgtacatgcagtttgaaatgcagcagagtggtcgagcgcggtggctcatgcctgtaatcccagcactttgggaggccgaggtgggcggatcacgaggtcaggagatcgagaccatcctggccaacatgttgtaaccccatctctactaaaatacaaagaattagccaggcatggtgatgtgcacctgtagtctcacctacttggaaggctgaggcggggaatggcttgaacctgggaggcagtgattgcagtgagctgagatcatgccactgcactccagcctggtgacagagcgagactccatctcaaaaaaaaaaaaaaaaaaaaaaaaatacagcagagtatgcagaagccctgttatctccaagaagtatccagctgatgtggggctgcacacaaatgacttttgcatggacaggatatctggtctaactactctaaaaaattgcataaccctatagggagccagagctaactaatgcagtaattacctaggagtagagccaacatcctgcaattatattagaacaaacgtgctacagtgtttctgtttatatatgtctcttggcatcttgaattaatattttatcatatttcattaagaaaaaatcagagatcagagaagtcatggaaacaagatcactagaattacctgttgtgtagggttagaaaatttctatgaaacttctcccatcttgacaaaatcatttaacactactgaaaacaattgatgtttacctcatagttaagtagaggcaagcatttccttgaggtctgtgcgttagaaaaccatgagcgtattagatattatctttagctactcagttttttcttttgttttcaaagtatgccaatattgttaatatgtactttttatgtggttgaccagtctgtatgtgtgtgtatctatgtctatgtaaaatgccattttcaacagtttaattatattacttaaatccctttcggtggggggtgctgaatacagagtatatcaacaaagtcaagatctacacgttgataaatcttaattgaaagctctttcttcagcagattgctgtgtattttatacattatatgttgacaacgtaacatttaaatttttgcttaataagaaaacaatgagggagagttaagctttttttttttcttttttccttttagccctgaaggactcaccagtgttattttgattgtctgggaaaattagttgttttgagttatagatctcgttctgaaaaagaagaattgctgaacttggtagatggttgccaaggggcatgctgaagccaactgagaaagggcttctttgaaaggcaaatttctgatggattccaggccaggctaatgaaggaaactctgaagctctatgtgtcttggagtagtgggaaaggagtaacagatttttcagagaaagattttgcaacccagagtcaggagtgctgctgctgtgtgttgtgcatctgctatcaaggactgcctagtcgcctctttttctatctgagagctgcacaggagtgcttttgcactgtccctgaatcgtgagtgttctgggagaggcaaagctagttccaagaatcagcattaccttgtggctttcacttttagagggtctggagatagctgacacccttgactgaagcatcactaagacacatcctggcgtcaggcagcacagtcgccttcttacacatgtatgcttccttttttcctgtagcaagggatagaacaagatctcacctgaactggagcacaaagctataaactgacttttgctacctttggaatacaatcactggagttgattttaatttctaaactggatataacaagaaaagcaattttctaaattccccatatttaaaaatctgtaccatttctctgtttcccagaagtacaaatccattgagaaacctttgttgctgggcaatatttgaggcctattgcatgcagagttattatcatttagtgttaaattctttaaatattttttctagattacctcttttggaggataataatcagataatccttctataatcctcctaaaatttagcctaatattgggtaatctacaaatgccaatagactgctttaccactgaattgatttcttttatggcaagtgtctgactgcaaaagctttatttgtatattgcctcttttatttacctcccctccttcatccttcacaatgaattgcttaatgtattggtaatcagactccttgacaaaacatgcactttgaaagctgcaggctggttctatgggctacaaacaaagagtcctactattaggatcttttcaatgtctttaccttgatttagaaccttggtactcagagtatagcatgtggacagcagggcatcacctgcaagcttattagaaatacaaaatcttgcccttcctcctcatcactgatttagatggcttttcggagaggtcaggtgattatgaatctctaataaaggttttaaactactgcaatagaacctcagagggttaacctacaataccatcaaataccattcagaatgagcttggcagtcctggtggaatttggggattattctattcctactctgcattgctttacttggaaaaaggggactggatttttctatgaaaagaatgagcttcccgtgctcctgtaaagacaccttgtagtctatgtctagaaagcattccttaattttcttcaatctgtttggaatatcatataaataaaaatttgtatgttttctttgtaactctggaaatgctagagaaaataagttttcaaatggttgttgaatcaccatggttgtcataattacttacccaataaatagtggaaatcatcatcgacaccatccttttattttccttttcctcatcgttttctcctcatcactatcctaacagttagtctctgtcattgtgttaatattttatttttcaaagtactgttgagacctaaattgttgctgattgtttcatttttgatcagttatgtgttctgtattcagatgcattaactatattttctttttttattttatgtgtatgtatatatatattatatatatataatatatatatatataaaatatatatatatatatatatatttttttttttgagacagagtctcactctgtctctgaggctagagtgcagtggcccaatctcgctcgctgcaacctctgcctcccgggttcaagcaattctcctgcctcagcctcacaaatagctgggactacaggtgtccgccaccacgcccagctaatttttatttttagtagagacagggtttcaccatattggccaggctggtctcgaactcctaaccttgtgatccgcccaccttggcctcccaaagtgctgggattacacacatgagccaccgcacctggcctatatatattttttgagacggagttttgctctgtcacccaggctggagtgcagtggtgcaagctcggctcactgcaacctccacctctcggttcaagcaattctctgcctcagcctcccaagtcactgggattacaggtgcgtgccaccatgcccagctaattttttgtgtttttagtagagacggggttttactatcttggtcaggctgatcttgaactcctgacctggtgatccacccgccttggcctcccaaagtgttgggattacaggtgtgagccaccgcacctggccactctattttctttatgggaataaatacaagataatagctaaatatttcatctttttctaggattaaagtgaggcttcttcaccttagggagtagcagaaagatgatatctgagagcccacataaacctagaaaaccattgtaaatgatattgtcgccagtgagagaagagccaatggggtgaaaatattaatagattatgtctacaaatttgaaatgttaccattgaaataaatgaatcaggctcacttgactaagaaaaaaggaaaagctttataatttgaatgctttcaaatagaatagtgtgtttataatcaatagcatgttttctttttaaaatttcctatattttatttgaagtcatcatgaaatgtaaatggaatagaaaatttccttttggaaatagcagaatgttctctttttttcaacttttgagttctgaggtacgtgtacaggatgtgcaggtttgttacataggtaaatgtgtgccctgttggtttgctgcacagatcaacccatcacccagatattaggcccagcatccattggctattctctctgatgctctccctccccctggccccagcaacaggccccagtgtgtgttgttcccctctatgcatccatgtgttctcatcattcagctcccacttgtaagtgagaacatgtgatgtttggttttctgttcctgcatcaatttcttaggttgctagccacctagtttgctgaggataacggcttgtggtccatccatgtccctacagaggacattatctcattcctttttatggctgcatagtattccatggtatatatgtaccatattttctttatccagtctattgatgagcatttgagttgattccatgtctttgctattttgaatggtgctgcaataagcatacaaatgcatgtgtctttataacagaattatttataatcctttgggtatatacccagtaatgggattgctgggtcaaatgatatttctgcctctagctctttgaagaatcgccacactgtcttccacaatggttgaactaatttacactcccatcaatggcgtaaaaacattccttttgctctgcaaccttgccagcatctgttgtttcttgactttttaataatcaccattctgactggcatgagatggtatctcattgtggtttttatttgcatttctgtaatgatcagtgatgttgagcttttttcatctatttgttggcctcatgtatatcttcttttgaaaagtgtctattcatgtcctttgcccactttttaatggggttgtttttttcttgtaaatttgtttaagttcctcgtagactctggatatgagatctttgtcagatggataggttgcaaaaatgttttcccattctgtaggttgtctgttcattagcagagtgttctttataaaaataagacaaattgtatgtcattttttaagagagaactaatattaaataccatttattctaatcatggcacatgttttgcttcttcttcatgaaactcctgtgaggcagattgtgttatttatattttaaagataagaagatagactcattgataaatggaaactttattcaagatctgtgcttattatacttagatattgactgttaaaaaggacatatagattggaaacaatttgttgagcctgattagttattatacagaatatattttaatgtgtttaggtatctagttgggggcctatatgtccagtttcaaagttaaatggtgataaccctgaatatttgtgaactctagttttatatcctcagtagagcttcacatattttatagttgctcaagaaacatgtgtggaatacatgctgaatgagccacacactcctccaaccgcctgagaagggggaagagcttctcagcacaatggtcaccacaaggtgggccacttctcccacttttctttttctaagtggcatcagcatgtatttggtcacctgcagagaatagctgaattgcaaactcagtttcccatcgttattttctgttcacaattttggggcttaatgatctttcagactatttgaacatgttcaattttgtttacaaaacccacaaagcatttttcaagctgagtcaactatcaaagaagaaaagactcggtcatctagtggatcttctctgggtggattggttccatctaccgaatgggatatgaggaggcaaaccttaccctcccatttctccataaaccagagtcgaaaattaggttgtgtgtttccagtctatttttatgagttcccatcataagtcacaccatccatcatagcataagcatttgaccctcattatgagacatcaagaaagctgtcaccattgccctagcaccagtgtctccagtaaatattggaaatgttaggagatctcatttagtaaattcctgagtgttgcctgccagcgcattgggtcttagtgttttatgaattattctttagtctatgtacttttatcacacttgacagttatcataaatggtctttaggctgaatactagtttttaacaaaggaaaatactcaacattattaagaaggacctgcctggatctgctatagggatgcagaatatagaaattaaaaatatttgagatcgatgtctgtgcaacatatgaaatcatgtaaacagatacaatcaataatttctcttcagttctaacagagccccataaaaacgatttggttcagtttgggctacctgggatggctaaaaaataaaaatgttttctgtagacttagaaccaatctggagatgaggacacttaaaagttcttgtcttctgagggattgtcagacaggtggtgtgtttaacatcagggtgtcatacaaaggcattttcttagatgggctttagcctaatgaccatgactgcctaacagtcactactggtatctggcaggcaattgaggtatttttcaaaggcccacagggtatgtatcattatactgagtgttttatgcagaaaaccctttgaggcatttttttaaatcagttttttttaatcagcttttagttccatctgttcaagaataggtaaactgaatctctttggttcctttgttttttatttagggaagttatctgttcaattgagatgaatggtaatgggattatattactgtaattcatttattaaaggagtattagaatccatagtagtatgtttccatctcagaacccacaaattaccaattaaacacaatcttccaaaacaatgtgattattttcatttaagcctattttggaagctgagtcacttgccacctgcatatatctttgtttaaaaagcattagtggaatattactgaagccgaagccattacttggttgtgatttacacagggaaatggtgatagctgttcatccagactgcagcccagtcactttcgagatagcctgtctgcatgttggctagttgtagcaagttttaaaagcaaaacactcaaattataccacgttgaaaacatgaagaggtgtttttattttttaaaaagaacgaagagatggcaaactaacctataaattaaaagaagcccaaactgctgtagatgaggatgctgctttctttgatttaacagtattaacagagcactattctatatgcagcgccatttcataccctttgggtattttagcaatttgaaatcacatcccttccctcaagcagaatgcaaggtaactggagacataaaatgagcacacatgtaaaaccaaatagcgatacaaggcaaccctaccagaggcatacgaccagacagtgcatggtgcaatgccagaagttgacactgtcattgggtgctgtggatttatggcaaagggctcactatggatttgagaagccagaaaagtccttagagaggaggtgaaatttgagctgattcttgaggaatgtatgagaactgttaagaccccagcattccaactgggagggatcattggtgaagtgtcaagatgtccatggcaggggtgcaggagagaggtgagcagcaggagaataatgagggggctgagatcagaagagtggaagtagaatggcaggcaaggcacaagcaccagttttgcagggaggagagaagggtagaggtattgaaaaacctatgcttttctagaaatctatgtggaaatagctactaaacatttgtggatgtgtattgagatttatcaacaataaggctgaggataccaggcttgaagtgttcccaacagagaatattgggtggcaagtgacagtgatgcagagtaagatatgcagtagaccaagatctggcagagaagacaagagagcaaacagaggagaaagggagagagggagggaactgtgttgcacaagccaaaggaacagatgaggccttgaagttgacatcaaatgggacataaatgtgttagaaggtgtgaagagtgactcatccctataatcctggtactttgggaggccaagccaggcagatctcttgagctcaggaatttgagaccagtcttggcaacatggtgaaaccccatctgtacaaaaatacaataattagatggatgtggttgtgtgcttctgtagttccagctactcgggaggctcaggtgggaggatcatttgaacctgggaggtcaaggctgctagtaaccaagattgtgccactgtactccagcctgggcaacagaatgagaccctgtctcaaaaaaaaaaaaaaaaaaaatgtatggagggaccaagatgaggaggcctgagaaaagttcattttcatgacagtagaaatctcttgagaatccaataaaatggtaagaaaaacaaacaaaagataggataggagagactaactaggtattttatgaaacataaggctggtaaattgtatataagctaaagaattatagatgaaacttttgataatagactgtttatccctagataaccaaggccagatgaggaatattatgtgcagtgccagggtgagataagtagagagataagtagaggtgctattgctggactcccagagctcaatgccttatgcttctggtgttgttctctcattgtggggaaactgagtaagccgtgcgtctttttcattttgcctcccagttactctagattggttttctagatccattaactcttaagggtcattccagtccagctctgagcacatcaaatctattgcttctcatcctttacaccaataagcttgactccttctaaaggtcttctctgctcttcatgatctcgattcttcctgcattcctaagaatgaaagacacaaatagcttttatagagaatgccctgtgatagataaagcagttgtctctctactatatataaaagggatgctgatatttgccatcttcctcaatgagcaggaccagttacatttgcagggcccaatgcaaaatggaatgtggacccattattctcaatttattaagaatgaagccaacaacaacagaacaataaaccaaacaaagtagggggtcctctttgtgcattacccatgaagccagccctggctccagaactgttcaagtccagctagatggcagtgccattctgccattataagaagcagcatgatctaaaggaatattacagatgtttaaacaaaaaattgaatatgtgctgagtaaaattcatttatgatgttaaatgatttccaacagtcagcaggcatggctgtgtatacctctgatagtcattcacagtgtcaaactacttaggcttactttttacatccagttcaccactgaaccttcaactgattcaaggctggtgaagagaaaactgaagatgttaggactcttccagagtaacatacggaaagtttcttttccgtgaaataacaaactggttttctaatagctgtattctttccaactggaagcattctaatcagttacccagaattgctgattctaaatccatctgaattatataatgtgtttctccttctatagaaagaggtatacagtgtttttttctggaaagttaattttacttttggcatatgttctctgggactatcggttttattgcaactggatgcagaatttaccatgtctgctttgccttctccgccttctccgcatgccagcaggagcactcaccacactgcaatccatctggcccctggctggcagtctaggcacagtgtcaatgctgtggtggccctagtgtgtacaggaaggtatgctttggttcagaactgcatacatagtaggcattttataaatacttactgaatgaataaatagaagatgacaaggcatggaacagcataatggtcttgggaatgcttgtgttttcctaatatatccagaaggagaaaataattttcagcccctagtcaagaagtttcatttgcctccacattcaagggtgggagtatctcagttgatgaaatatatgcttctgaccaaaacatgtatacattgaatatatattaaatttattgggtaattatttaaaggaacagtatgttaatggattttccttgttttgggtaccatcattgatttccacctccccccaccacatccccttatagtctttgtctgaggatttcactataaatgaaattagctgaagaaaaccaggagaaaaccaggacacatgcacaacggtaagtgtcacaaagtgacaactgagctagatgtacacatggcctaaggcctgctagccacagggaggcagggatgtcccctcttgctcagcctcccatcctgtgttccctcactcatttttattaagtgatagcacgtttcactgcagctactacagcatctttgctgtctggagggtattgttttggatgcggatgttgtttaggatttaaaacaactgtgacattgatccttttcaacaggcaagagataatatctcttgccatcatccactgcctccatgaggatattctaggaatctgtatctaattacctgtgcagctaattaccacttccatgttaagcagcagcagtaatctctttttcctttcaagtccattttatggcatcaaactgtattatattctcttttcaatggctgctgacaaaattacaacagcaccacccaggacccgatatggaatctgcctgcccgtgattcaactgcacgctgtgtgttttctcttaagtccttttcttttttttttttttttaaccttgtgctattaaatacctatacatcggaatcatctccccatagctccatttgtttgattagcattacgatactgtgacaagacactatatcagtagtaatcgatctgattagcatggagatgatatgaacacagattgtattgatgtttaatagtgaaggcatccaggtgctgtaaacattatagatgtttttgtatgctgcgtgcaaggtctctgtattgaagacggcaaccgcagcagattttagagctcgatgatttattttatgccaagtgccacagtgggtcttgcatagtgtatggcattcctttgctttatcttgcacaaaatgttttaatcagtgttcaaaataatgcaaatattttcactggagagattctaatattgctttattaagagatgcttgcaatactgcagtaaaaagcttactgcagtctcattgaaaaccagccacattcttctctgaactcttgtctcttcccttactcttgtcaccattatacctggagagctaccatttgccagctaatattcagccccagatgttccccctggacaatttttctgaatttgcctatcctttggctctcagtagttaggagtattttcccctgggcagttctagagctttgtgctcctgttctggtacccctggctctgtgtttatgcatccatgcctctttactttgtaattaggatgccccgaaggtagtcattgaaaattaccatgtctttgtacatggcaaccagtggaatgcttagcattgattattcatttatttatttaacacatatgtattgagtgcttcatgacgcttatattctgctgagagggagagagacaatataacattataacacaggtaatgataagtagatagggggagccagaggggacaaggtgaaatggagaatactgtcttatttgtagagaagaggaagagcttacattgctatgaaggtgcaatcaaggtggggagagagcaatgagtgtgaaagccatagtctggagtgtgcttaggctcttccagcaggagcaaaggaacacctgtgcctggaggtgactgtggagagagttggaggtgaagcttgacaggtgcagtgggtggaggaagatcttattgtgggccacattgaggatgttgactttgacttggagtgaattgggcactcattagcttagaccagaggatttactttgaataatatgaaacagtctcaataactgatctattcagtatggtagccgctagtcatgtgtggctgttgaatacttgtgatgtggctaccttgaattgagatgtgctatatgtaaaacacacatggattttgaagatgtcgtatgaaaactaagaaaagtgaaatcatctgatatataattacagtaataggatcactagctgctgtactgagaaaagatataggggtggaagtgtcaaatggtttggatcagggtgatgtcagtggagatgaagagatgtggtcagattctgggtgtattgtgaaggcagcctcaaaaagattcattgatggattagatgtggggaaacaaaaggaagtctaagagtcttttctgtgcaactacaagaagggagtccttttcttgagatgagaaagactggttgaaagatctgggctggggaaagggagaatcagtaagttgttagtgtatgtgttaagttagagataacaattacaaatctagacaaaagatgatttgacagttataaaagactggagtttatagaaatggctcatatggagaaataaatgtgggtgtctcagcatggaagtggtttttgaatcataaaactggatgagaccacttagggagtgaatgtaggtctgtgacttagcccaggacattccagtatctatgtgtcagagaaaggttgggaaaatgcaagaactggcaagggaggagaaccagaggagggtggtgtctaagcacccaaatgaagaaagtatttcaagaagaagggaatgatcagctgtaagatgagtaagatgaggactctgaaaaatggtaatttgatttgacaagttggaggtcactgatcattcccaggagagctatttcattgaaatggggagtatgaaagtggaggcagtgagtggagccagtgcttttaaggtgttatgctttaaagtttaacaaagaaatgagaaagtgcttggaggagaatatagagtcagatgagggatttttatgagatgaccacaagtataactaaataaatggtttttttttgcatgatagattaataaataagcaaatgcatgtatttaaagattctaaagctgtgctgtccaaaagaaattgcatgttagccatatatgtaattttaaatattttagtagcctcattcaaatgtgaaaagatacagcacaaattaattttaatagcatagtttatttaactcagtatatccacaaacttgaatatataatggaaaagttatggaaataaggcatgttttgtctcatagtaagtcttgaaaacccatgtgtattttatgtatagcacatctcagtttggggtagccacatcacaagtgttcaacagccacatgtggctagtggctaccatactgaatagctcagttcttaagactgtgccttatgaatagaaaagagctgttgttgaaagtaaagcagaataacttttattatattattaattcaaagtatatattcataaaagtttatgcaaaatgaatgagaaattaattaaggctctgtaatttgttccatttatgtgattacataagtaaatctattttatatagaaaatatgactgtgtccctttcaaagacactaagaccttatcttaaactctattttagttaaaaaaaaaaaaagttaattgccatttcaactgtgtggtttgtagtaaaatttgaaatgggtttaatgtcatttataacatttgtaaagttttgggtgatttaaagggcattaagggtttttttgatgaattatacatgttggtattcagagattaatggtgtcctttgcaaagaatgtgtgtattctacttgaatctgttgaaattgtagtaatggaattgcatttttgcaaggctgtatgttatacagacattttctttaaacaaatagtttgaggtgaggaaaaaacagaaaaaggactataaaccagggctggaatatgttaaatctcattttttaaggaatattaacaaaacatgaaagatattatagtgacaggcatttttactttttttttttcatttcctgtcatgggcaagtcaaacatccatgccccagcttcctcattattaacaggagatatattaaatgctccttaaaatacaacacttctgtgattctctgaaatggagcttattatagtaaattgcaaatttctagtaagttataactgctgaatacaaacattttgcatctaataatgaaaatatgaaataaagaaataaacactgtaaaacccaacccccaaatgcttgaagatcactcctgggctgagttgttggtgtttcagggttggacatttaaaggggatttcatgaaaattaaatttcttgggtttgttttttcaaagttttaaaatatatgtttatagatgacatggataaaatgaactaaggtaatataaatagtgcctttcaaagagcaataaaagaatgcctttggtccataaaaggagagattatcaaaaagaataaacttgattagaagaaataaaagtagatttattttaaaagggaaaatggaatttattcctttaaaatacagaagcactaacttaaaaatgtttggactatagtaatagattttttgaaaagtagagaattaaggagaaagacctaccaaaaaaaaccccataattcaagtgtacatggagcaatgtgaagggaaggatgtgcaaatgtgcatttatgttgggaaaaatcaaggagcctgtttaaaaatagaacctacttagagacaaaaactagattaggaggcattaggttatgttagaaaagtagtttattttccttctacaagctgtatatggtttttgaatcatttttaaaaggctaatttgaaatgtgttttgcaattttaaaccaaaagctttttatgcaactttaagaaaaggatacttatcctatttttataaccatgaaatatctataactttgcattacctagccctttaaaactcagaatataatttagataatttacaaaactgatgttataacccagccaaagctagtgtttttcagttatcaggtatttaaccgatatatatctatgagatttcttaaatttatattaatttattctatgaacatttatactatcacatatttttgtaataacaagctaagaaaattattattgttgcattaaattgtttactgaacatttattgttttatgcaaataaatgttttcaaacttagtgagctcccccgccaaaaaaagaaccaatactaactgtattgtgctttatctttaggatatattatcctccttattcagattccatgtacatatgattccttatccctatttacactcacttttcctgagaactttttgactataggaactgaaagagtatgtgcatgaaagcaagcagttggaaaggacttaaaaatacttaaaagaaatagtttttagagttagatgggggtctacctgaaagcagtattgactcttattttttgtaaacaatatctgaaaaggtagacaggatataaacaaaggatagtactattgatttagctgtatagtaaatactccctttcaataaaatctgagcataaataattttctgtgacttttcttcaaccgtaagcactttggttttggaatgtacaggttctctactcagacttcccttaaaccaaagttttctgctgtgggacctctcacactgtattctctgtacttgttctgtgaaatgggattctgcaaatgctagctattattattcatcactctacttagaataattaacaaatgagataactagaggttaggttttataaaggaggatgaattagatgtcagcaaagtaaggggctttttgcattgaatcaataatgaaagtaaataaaggtaagaggaagttggtcttggcctccatgtcatgcttctgtttctgggtattatctagaggcgctgtgctgcatattgatgatgtgaagctcaagggctctggagttaagctacctgggcttgactggctgagctacctctgcccgtggtggcacctcggacatgtttatcccatccatctaaacttttattacatatatatgaaatggaggtaacgttttgaatctaccatactgtagagattgatttgagaggacaaattgaaaaggtgtatatgagtccctttattcagttcctggaacattgtaagagcttaataaatgttagcaattaaaatcatcatcagtattgctttttattatcagtacaagtactccttgtaagagagactaatgacaagactctacagtcttatcatttagaaagggagtggacaatatctatttagctaggtccagtacactaaataaaggctatctaatgctttaaccattgttaacttccttattctgagtctctaagaccaaggcagaatgtcattgtttggaggtcacagaataagaaagcctttgaacttttgtctaaaagtaaaaattgcctggtatgcatatgatcttgaacacataaaaatgattatattagtagtaaattgcatctgtacagcagagcggggttaaaaagattttagcaagtgaacaataataaaaggaaattaattgtgtgctattcttattgacttgtgtacaataataccatagatattcttattttaagtgtttttcccttatgttgttcatggaaatatttttaacaaattaatttataaggtcttcacaaaattatttataatttagctattaaatccctggtttctataagggcttagacatatcagaatattttgatttgtgagggactggtatacttgtgtctttattttataagcagtttctcatttagaccttagtaaaattgccctgaatcaatgttttagaggactaagagttggtaaaaagtcgcataaattgtgtgtagctcagtgtgtaggccgtaataaatatagaactattaaacctgtaggtactgtttttttttttttttttgagaatttaaggggattggaaaggtttactgaaaggagagaaagagcaacaatggactgtctcccaaaactctgattattttttttcttaaaccttttcatttggagataattgtagaattgcgtatggttataagtaacataggaagatcctgtgtactctttatccagttgcctctaattgtaacttataaaactgtgcaacagtgtcccaaccaggatattgacagtgatacagtcaagatacagaacagttttgtcaccacaaagattccttgttaaaattctcatgtttgatggttaagttacctcaaagggattaacttaatactgagattagttcaaagaaacaagccacaaagcaagcaagggaacattgatcattgctttctgcctcttaatcggaatgttgtggtagtcaatcaagcagcaactgtgagcagagaacaaaagactattaataaacctttaaagtaaaaaaaaaaaaaccctaaaatacctgataggccttggttgagtcaacaaacagaaggtttctgtagttaataaaggactaaatgaaaaacttcaatgaaaatcactgaccagtttggaataatgaaaagctctgaaggtggtagtaatgattggtgcacatgttataaatgtacttcacaccaatacactgtatactttaaaatggttgaaatggtaaattttatgtatattttaccataataaaaaaaaaacataaatgaacaaacaacaatgacaataaaaaccatggaccatttctttttttttatttttaatttttgtggttacataggtatatatatttatggggtacatgttatattttgatacatatgtacaaggtaaatggagtatccatcccttgtagcatttatttttttatgttacatacaatccaatagtagttattttaaaatgtataataaattattgttgattatagtcctcctgttgtgctatcaaatactagatctcattcattctatgtacttatatttttgtacctattaaccatccacacttcccccatccacctctagttttattccattgtggtcagggaagatatttaatacaatttcaattttttttgaattcttaaagacttgttttgtggcctaacatatgatctattcctgagaatgatccatgtgctgaggaaaagagtgtgtattgtgcagacattgggtgaaacgttctgtaaatatctattaggtacatttggtctgtagtgaagattaactccagtatttctttgttgatgttctctctggatgatctgtctcaagctgaaagtggggttttcaagtcagtagctattattgtaatgggggctctctctctctttgtatctaataatatttgctttatatttctgggtgctttgtgttggatgcatatatatttacaattgttatgttctcttgccgaattgacctctttatcattatataatgacctttgtctctttttatggtttttgtcttgaaatctatttcaagtctgatataagtatagctactcctgctcatttttgtcttccataggcatgaactatctttttccatccctttattttcagtttttgtgtgtctttacaggtgaagtctgcttcttgtaggcaacggaatattaggttttttttttttaatctatgtcttttgattggagaatttagcccatttacattcagtgttatcattgataaataaagacttaatcttgccattttgttatttgttttttagttgccttttggtcttctcttctcccttccctcccttccctcccttccctcccctccttccctcctctccttccctccctccctccctccctcccttccttccttccttccttcctgtcttccttcctgtcttccttccttgctgtcttcctttcagtgtaggtggttttctctgctgcgctgttttaatttcttgctttatattgttcgtgagtctgttgtatgttttctgatttgaggttgccatgaggcttgcaaataatctctaataacccattattttaaactgatgacagcttaccactgattgcgtaagcatacaagcaaggaaaaaaaactaaaaaaactctacactttaactttgtcccttcattattaatattttgttgtttctatttgtatcttactgttatgtcttgaaaagttgttgttattatttttaataggttcatcttttagtttttctacttaagatacaggtaggtcacacaacataattacagtaatataatattctgtgtttttcagtgtattaccagtgcattttataccttcagataattttttattactcatcaacatccttctctttcagcttgaagaactccctttagtgtttcttgtaggacagggtctgctgttgatgaaattcctcagtttttgtctagggaagtatttcttcttgattgaaggataattttgctggatatactatcctttgataaaagttttttttttttctttttcttcagcagttaaaacatgtcttgccactctctcccgacctatcaggtttccactgagaagtctactgccagacctattggacttcgtttgtgtattatttcctttcacttgatgcttttgggatcccctctttatccttgacctttgggagtttgattgttaaatgcctttaggtagtcttatttgggctaaatccgcctggtgtttcataaccttcttatgcttgaatattgttgtctttctttaggtttgggaaattctctgttggtttcactttgaataaattttctatccctatctctctctttacatcctctttaaggccaataactcttagatttgcccttttgagggtattttctagatcctgtaggtgtacttcattgttctttattcatttttcttttgtcttctgactgtgtattttcaaatagcctgtcttcaagctcactaattatttctctgcttgatcagttctgctcttaggagacaccgacacagtcttcagtatgtcagttgcatttttctactccacaatttctgcttaattcttttaaattatttcaatctctttgttaaatttatctgacaggtttttgaattccttctctgtgttatcttgaatttcattgagtttcctcaaaacagctattttgatatctgtctgaaaggtcataaatcttttaaaaggtctctccgggatttgtctttggtgccttacttgtttgttttgtgaggtcatattttcctggaccttctttatgctcgtggatgtttgtcattgtctgggcattgatggcttaggtatttattgtagtctttgcagtctgcttgtttgtacttgcccttcttcagaaggctttccaggtatttgaagggacttagatgttgtaatctaagtttttggtcactgcagccacatctgcattacctaaaagtaacactgtgacttttgcagacttttacaggtaccatcttggaggtcttggataagatctggaagagttctgtggattaccaggcagggactctttctcttcccttattttctcccaaacaattggagtctttctgtctctgctgagcttcctggagctggggggaggggtgacacaaggacccttgtggccatcattactgggattactgggactgcgctgggtcttgcccaagacctgtgataaccactgcctagctagtgcctatgtttgctcaaggccctgagactgcagtcatcaggtggcagccagccaggcttgtgtccttcccttcagggcagtgatttccccttggtcccaggtggatccagagaaccagtcaggagccagggcctggagtcagaaaccttagaaatctacctggggctctattctatggcagctgcactggtactgaagccacaagacaaagtcctttcctctcttccttctctttccaaaggtaaagtcgtctctccctgaggccaccactgcctgaggcctgtactacctggctactgctggtgttcattcaagacccaagggctcttcagtcagcttatggtaaatgctaccaggcctgggactctccctttagggcagagggctcccctctggtatggagccggtccagaaatgccatccaagtgccaaggcctggaatcagggaaccctagaatctacttggtgctctaccacactgtggcagagcttgtatctaaggtgcaagacaaagtcccctttgctattccctctccttgtctcaagcagaaggagtctcttgctgtagccatcacagctgggaatgtgctgggtcacacctgaagccagcatgtctctgagtctcactcaagggccacagtgagaacggcctgggtactgctgctgattattcagatcccaagggctctttagtcagcaggtgatgaatccttccaggactgggtttttcccttcaaggcaggtggtttcccttctggctcagggtgtgcctggaaatgttgtttagaagctatgccctggagtgggggtctcaggagtctgcctagtgccctattctactgtggttgagctggtatcccagttgcaagacaatgtcctctctactcttcccctcctctcctcaagcagtagggaggaacctcccggagctgcactgcctggggttggtggggtggtggtgcaagtactcccttgctgcctggctgcatggaccgtttcttgtccttcaacttcaattcagaagctgtattttagataataacttttctttcaaaattatcagttaatgttttacatagaaaaggctgttttcttttaaggagctgttggaaatttaaggtttgcttcaagtggttctggaaattaattggtctttgttctctactcacgattttaggggttaaagttgagactcgagattaaaatatgggttataagcatgagtgtgatcgcttctgaatagctagacgtttttaagttgtataaagaatgagtttcagccaggcgcggtggctcaggcctgttatcccagcactttgggaggccgaagcgggcggatcacgaggtcaggagatcgagaccatcctggctaacacggtgagaccccgtctctgctaaaaatacaaaacattagccgggcgtggtggcgggcgcctgcagtcccagctgctcgggaggctgaggcaggagaatggcgtgaacccgggaggcggagcttgcagtgagccgagatcgcgccactgcactccagcctgggcgacagagcaagactctgtctcaaaaaaaaaaaaaaaaaaaaaaaagaatgagtttctgtttgttcctagagttatctcctaagcatttctttaaaggaaatgtcctattttttttctttctcttttagaaactttaatgagttcatttcatcccttcctagtatatttggacaaaatgaagttatcttgccagcaatggctcctgaattctatgtcctcttcttcagtgcatctagttttatgggtacgactggtcagtgaattgctggtcactgcctaaatgtcctggaaatggtaggtggtgatgacacaaagaacatgccaagatatcctgtggctgtagcaagagtttcagagagaaaactcaaggagtgaactgtgtttgggttgttgaggtaattgagtgagaggaaaagatttacatttctatcatacaagccagagaagccattttcccatgtaggcctttatggtacttctagttttaagtgggtacttacattttaaaatgagaaaggttgccattctcttagcttaccttgtagggcagaaaacatactaggattatgagagatggaatagaattttgaatttcaaaccaattaggaacagcttgaataaaatagaactttcttatgactcagagtgaaagaccatgcaagggctaacatttgacatttcagcagcaagcttttagagacattgtgttatgtatttgaatttcttcttctctgtggggagtaaggccttaggacatgccatttaattacatgtttaatgtgttttgttttatattaccacaaattggctaaaaccattataatgtgctaaaacttatccatctcttcaaaatctaaccatgttgtttatattgataacttcttgatattatgaatcccacaagccaagaatacttacatgttgcaagagaaaccttcctaatttgttcacaaattttctgttttttaatttcctgaaaaatttcctcattctctttttatcgatctggaataaaatgaagaattaatatgattgagactatcttcatctcttcctctctaccttttcattaaaaggcaatcattgcagtgtccttttatatgtaaattttatttttgcctctaactatcatttagctttgtagaagctaaagctttaaaatggcaaatagaggaaatttacagagatgtattttcagtttctatagaaccttcttaaaattagatgaccaacctctactcaatgctgagattattcattatgctgtcaatgtataattatctgtcggtctactatttgtaatttctctgtgctgagatatcccgtttgctattgaatgctacttgaaagaaaattattgatctataccacacataagagttttgaaatcttcccatcagagtatattgcacctttagcataaaaaaggctctgatttattttactttatttttttgcaaatagctgctttatagttctttaagttcaattcaatattactctttgttaaactttaaaaaagtcttcattactttcctttgttaaaccatttctgcattcttcagataatccaggatggtttcagtaattaaaataatttagcttcatcactgttcaacataatcactgttaagcatgttaattcagatactgatccttaacatttttgactgttatgatggaggcctggccacagacgtaccttgtgcatgtttttaaaaaacctaacctgttaataatctactccaggttctaccagtaacccaggggatatttgttttcttttgtggcttcttccaaggaatcatatcaaattcctttggaaaacttgtattatttgcatccatcgtctacccttctattttataccccctaaatatttatatctactatgtacctacaaaaattaaaaatgaaaaaaattaaaatttaattttaaacatcttgtagttgagaagcaagtcgtccaatatcagattatacttatatatacattatagttatggcaatgcctttaatttcaatgcttttttttttagaaattctgaactatccatgaaagattttgttttttataattttccattaagagtgggatgttaaatatgttctctactttttattttaaaaaggacatcactacatgtcgtgatagtttatgtttcatgtgcatttatgttcttcacctttatgttattcagaatttatttttggtccacatatgtgatgttaaaatcttaagatttttaaagtttacaatatgtagaatgtaggtgtgttactgaatcactgttgtactgcatttgacagcttatgtatttctaataaaattaaagacttgggaaggaagcatagaggatcaagaagagactaggctttggaataagataaatttgggattgaatcctggcttattttctttttctgagctctgggaaaaatcacaaactctaaattgctggattgttctaagaattaacagagataacatggagagatccctaatatatagcagtacttaagtgtttcccctacctccttcaaggtcaactaagtgaaagaaaaggtaaatatcagaaagaggcatcttggagcagtgccccgggatgtgatgttatcagcaggagttaccaaactgtgtagcagaatggaccacttggtggtgtttgggacctggcatggtgggagaggagaggagaaccagagagcagggcttcagaccaccccttccctggtctccagtggtatagtgtgctgtctctcatttttctttaaatgtgttaaataaattgtggtttattctgataattctttgaaagaaaaatggctttatcatttaaagggaagatagtcaagtggccaaatataaatatactctggatcactaaatgtaaccggttttaaaactttgtgtaggatgtattaatacttaaaaaaatgatgagtttttccctcttgagtttttccctctggaatgaccttcaaaagagactcaaatctctgctgtaggtgagggactgaccaagtgggtgggcacagtggcaaaatattggtagacaaagtgaacagaggaagagtgggggttaaattagattttactaggcagctgccctctccttcctacttaatgtgctcaagaggaatgaagccaacataccacttaaaagggttagtcgggggaaaatgactcttgaggaccagtagcaaaccagttagaaaccagtggtttctaacacctgaaaacattcctagaaatgaaaagcagttaagtcagtggaaagagaaaggagagtaacacgtctaagactaagatgttcttggggttaatctaggaagttgaaaatccggatttggaaggcaaagggaacaggacaacaagggtagttgtagccattactttattttgggctagagtaatttttgctaaataatggcttattaaagggttcctgatggtagtttgtgattgatgtagtgccaactcttatttctcatctggactgggtagctggttaaataatttttctgtgacttaagtaattatttagaagtcatggtaactatttgtcaaaaagtaaaatgaacccagctctctctgtatgagattctggagtaggtgtctccttcagaatgcaacccatttagactcagacttttcttgctttgaaataccataataactctgtcatcacataaacagtgaaaattgtagttagaatgctaaagcccattttccccctttgttttctcttttcattggtgtgtgtgtgtgtatgtataaatgaatgaatatgggaagagagaattctcctcccgtgccagttatatatatgggcagtagaccttattattaactagagaacacatggtgtttggactgttattgttaatcatttcttttgctcagtgtggtatccaagctataattttgatgccttcccttatgttggtaatttagcaaccattgttctgtttgataaccacagcttgacagatatattagcagcctaactaatatttgtaaaaagagtgagttcaaaatttgtttttacatttagcctgacttccagccatggagaaaactttctttgtaatgtggtcaccaggttgtgtttttttcaggcttaattttatgttaaacattttacattggattatttcatctgcgtggttttgtacaccatttgaattgggatgcttatggtgatatcttggagaatgtatgctatttgcagataatgaagattgctgggaaattttagcatttttgtggagaattgggtgtattaaaaagtagaagcaaagatgctgatttttaagtggaaaacatgaaagcttttttttttcttttcagactgagtcttgctctgtcgcccaggctggagttcagtggcacgatctcggctcactgtaacctccacctcccgggttgtagcaattctcctgcctcagcctcccaagtagctgggattacaggtgcccaccaccacacccggctcttttttcatatttttagtaaagacggggtttcaccgtgttatccaggatggtcttgatcttctgaccttgttatccacccacctcggcctcccaaagtgctgggattaccatgaaagcttttatttagcaactgggaaagtacctgtggaggacaatgactagggctgtgacagatgatgtgaatccatagggccatgcttctaggtcttgtctttgaaagttgtaaattttagtacaccttcatttacatttctatttgaatgtaaattatattatgtgataaaattcctctggaggaaaattcccaatgcagctaatttctctggagccccctgctactaatgcagaataaattattcttttcagggaatttcactgtgtcactctgggtggtaatgcaaggcacattgggggctcagccaaagccttagtttcatggaattcggagtttgatcagtgtttggtcataaaattgtgtctctttatagatattataagactttcttgacatgttacttcatgggcttgtttctataaagagtggtttttttgtcttgttttgttttgtttttgacacagagtctcactctgtcacccaggctagagtacagtgttgcaatcttggctcactgcaacctccgcctcccagggtcaagcaattcccctgcctccaactcctgagtagctgggactacaggtgtgtggtagcacgcccagctgatttttgtattttttgtagagataagctttcattatgttggccaggctggtctcaaactcctggcctcaagtgacctgcctgcctcagcctcccaaagtgctggaattgcgggcatgagccaccgcacccagcctaaagagtgttttttaagttcccttctaactatttttaacacccattggattcactacaaattacattgttaccagcctctctatcataataatgaattttctaagccccttggtgctatcctataccaaatgggtgtaaactgatataatatcttctatctttgaacttgtaatataagagaataatgataatgaaggaaatagtaagataatccaaaaatatgaacacacgttaataattcttaataattgaatcataaaaattttcagctaaaaggaaatctaaatatacttaaatataattatcacatatcgaagatgaaattgaatcccatataaatgagttgtccaaattcatgcaaaaaggaagtggaagaaattgaacccaaataccacatttatttcttgaccattgtttttgtcatcaggcttagtgaaatgttagcaatatctttaaaactcttctaccaactgggaatatttttttaagtggtatctggagttgcacattgggggaaatcactactatacttttctttgtatgaaaacaagtgacttagcatttgcttaatgctctacaaaaaacaaaagtctatgagatacaaaagaatacacgagactgaaatggagcgtcgaaatggaaataatgttgtactggagcctagactctgttgggcttactgtcatccttgcataattttagaatcctctgtgaaccaagtgaattagtagtatctaaaaagaattgatgcccagtagtagatactaaagacccaaaaagattaaccagaataacgtttatgtaaaaagaagagatgtttactttttctgtagttctgttagattacttgaccaaggggtttccataaatatagtgaatttgacttgggtaaaatgtattaaaaataaataacaaatagctttcatgagaccttaaggcccatataaaggcataagtctcagtgataaaaacattgagtggtttcatactatcaatagtgtccttcagcagaattgctttttattgtttgtaactcagccaaaagggaagttattaccaggagtttagggatcttaagcatctgcaggagggttcagaggttatgcagtaaggaaccatgcagatcatcaaccttaaaaaaataaggccatcgtcatacacttttgtcaagatattaaatttgtacaaatatttgggaaagtaatttggctataaaattgaaaatgcacataatgttacagaaattacatggttaggtaggcatccattctgtggaaatgaaagacaaaatttaaaaacagatgcacacacacatacagatgtttattgcagcatcatttgttaatggttcaaaaaaaggcaacataaatgcccattcatatcatgcatataaattattggtaatatatgctacatatttactattcatccttgtcaaaaaatatttgtgcattaattttggaagatggccatcataaatatagataaatataaagttcaatgttaataagtacagattctgaagctggattacttggatttgtgtgaaagttttcctacttcttagctctgtgaacctaaaagtgttctacttgtcttgaatttggtgttctcacttgtaaaatgaagataatcatagtacctaccagtaagcttatataatcagttgttaatactgattaacagggttggcatggggtcattgatgagtggagcacagagtttcggaaggaagtctcacttagtttgtataaatggtaggaatatgggtgattgacttttgaaatcatcatttttgttgcacagtatttcagtgcatgaatctgccataattaatacaatatttcctttattgctatgcttagattttttcgaactatttttctcatggaagagaaaggaagtcattccaaatagaagattcagcataaataatgtgtagagtcagggatgatcatgagctctttcattgctggagatgatgtatgacaggattgtgtgtataagctgtttagatgattagatgatgagtaaagaagagtattggtggacctccaatattgagcttagaagatgttccgagtaaaatgtctttggaaggaagcagagaattgaaagatatgattggacaaaggaaatgtgtaatagtgatccaggatgaagagaaagcagttggcaaataagtaagaggttagaaagagaagcaagtttcctaggatttgaaaatttcataaaagaggtttagaattttgattctcttccttgtgtaatgaatgggtagctgggctaagaccttaaaaaaacctagaccttatatatttgttttaaagaacagactgttttttgtaggggaggagaattatctagagaagcaaagtttgggaagcagaaagttgaaaggtaagaaatttgtaataaccaaggtaaaagatatattttgattctgtactttcaagctaagggaaatggtggtataggtgaagcaaaagcaattaaatattggcaggtttcaaagaaaatctgaaaaaagaataaaaagtttggatgagccagaaatgaccctacaatgtttggcttctgagagacaaattaatgtcttgcctattcctgtaaataagattactgttttttttgtttgtttgttttttgttttgaggatggagtctccctctgtagcctaggctggagtgcagcggcgtgatctcggctcactgcaagctccgcctctcccgggttcacgccattctcctgcctcagcctcatgagtagctgggactacaggcgtgcaccactacgcctggctaattttttgtatttttcagtagagactgggtttcactttgttagccaggatggtctcgatctcctgaccctgtgatccacccaccttggcctcccaaagtgctgggattacaggcatgagacaccgcgcccggccaagattaatataatcttcttccccttacgctgagtatgccataaaatgggcacagaactaataatttgatattaaatgaaagtgactattttaatattattacattgctcataaattaccactttattttatgatgtttgtgttaacacccttttttcctcatgtgtctgtgaacttttctagcaccaagcacatacaaatgcccaataatccctgaataaatgaaggaaaaaattaacaagcaagtgcacaaacgagacagcatgtgagagacagctgtttccagttgtgctagagcagggagagcaagttgatgtgcaggtgattccagattaagaaggaagcttaaataattcaatacgataatgctgtgtgagtgcttagtgcttgggagcagccattatcatcatcaacgtacttggccttaagatcatcagtggtgttcacctgactaacaaattgtatagaaaacactagttgctggaaaccaggataccacttgtatttttagtttatatatcattttcagagacagaagctcatcaaacatcttcaataatatgaaaaattttctattgtaaatttccaaggagttctccatttcataaaggtagagcattaaccagaaattttcatccagacacagaaaccttcatttcagtctgcaacagtgttgttctatgatgtgcttaatggcgtttccatccttggtacttgtatcttagggcatatgtgactgtttgccagggtcaacagaaggtcacagttgagaacagggcatctgcccatagcaacaattcatttgcagatttaggtcaacaaaatagaacatttcatgtaacggtggctatgttaactggcttgaaagtggttattatttcccagtgtatgcatatatgaaaacaatgttgtatactttaaatatatacaacttttgtttgtcaaatatacttcataaagctggaaaaaatgaaactaaaaaaaacaaaaagtaatatgtgaaatatacttaaataatgtttcaattatgcaggtataaagtttaagaaatatttaaacaaacatgttattagctgtaatggaaaatttgcatgagtttgtaggttaaaatgtcaaagtgcaagtacagttttggatcataaaaggccattttagaagtgctccaagcttctgaatagtattcatttgggttattcatttaattttctgcctggaagggacatgtagggtattttgatatacatattttagaaacatatgataattaaagcaaatttcatagattaacatgcagcctaaactgcatgaaaatgcgtaagtgatgctaattcctgatatattttggggtaaaattactgaagacttttaatcacatgtttttatatctttggatcttccctacattgctttcaagaagtaactcaacagaataaagtacacagctgaccttaaatttgcatttgttatcatgtcatattaaatatttacagatcatttatatgtgtgtcttgattctcatagtgattttatgtgctccaagaagatatctcttttagcataaacatatactttactaacagtttcatcaaattttaaaagtgcgaagtatacagattttaaatgcatttcaagcagatttcttttaaagaaatatgctcattaagaacaattgagaattgatcttgtagcatgcccacagtgtgtttgcctgtcgatattgagtattggaaaggttatcagattgttaagcaacaaaggaaaataaattttgaaagtttcattgggaaatagctaaaaacataagactgtataaaaaaattaagaggtattagtaagaaatgtgtggattcttccttctcttaacattactgtagatcctgttttatttcagctgtttgttcccttatccttacatttatcaggattcttctgtgttcaactggctaatctgaatactaaccataacaaatagatgtttggaagcattaaagtgatgactttcaaaggggttattatcatttatcatgaaaatgaattcagcccactgatggtaatttagcctacagataaaatgaacgtcatatgtttataaaatgaattttcaaatgtttaactttctcaaaataatatttcctaaagatgcgatattgcatttaatatgttcacaggagacactttacctcactaatccccaaattctatgtttaaccattgtagaaaggtggtagtttatagactggttcccacaaatattcaatggacagaatttcacaagcttttatggaaatattctgttgtatccctcaaatgtatagattgtctgcattatagcttgatggtgattctgggctccagaatcagattctctgggtttgaatcctggccccaccaattaagtgctgtgtgatattgcttcagtttcctcaattgatgacagtgctgaccttatatgacttttgagacgattgtgagataatgcgtgcaaaagtgcttagaaccacagttctcatggttcccaaatgagctgtagtaccgctagcactacaggaaactcagagggacactgcacaatattttaaacttctgtgaaacactacatagacttctgtctcatggtagtttggtttcagtattagattatacttcattccttttgatgtcatatctttgcaaagctgagttttcatcagttgctatgacaaaaagcaataccttgtaaaaatcatcatggaaaaagaaatgaagctgtttgtgtctagtttaagaagttttgcagtgccccaatagacacatattggtaatttgtgattatttaagaattaactaaaaatatacattttgttcaatgtatgtgtattattttctcaaatggttactaagttgttaagacagaaataattaaattgcttagacctgtctacttaacggacagaactgttaggtgttttgtttggtctaaaggcaccgtgaaaacattaccaagacactgaaggcactactggaaagtttggaaatgtctgtgctggcttagcttttgcgtgtgtgccctcagtaagggtcagttgtttctgttgatggtagtgatgagacagctaagtaaaaagggctccctaacagaacctccaactggcctgcacgctgggaggagtgcacaatggggcggagccttgggaagttcacaccatttgcagaggggaggagccgggcctctcctgatccgggatggtacctgggattcagtctgtgagatgagggtctgttaacaagaacctctcttgctttgatgagttgttttttttccttttcacccaataaattccatttttctcacccttcaatgtgtctgcaagcctaatctttcctggtcatgtgacaaggaccccgtttttagctgaactaaagagaaagtcctacaacaataatagttaggaagtcaaagccattttcttaagcttaactcaaattcctctgatcatcattttaacccttttcttcttgtctaatgacagtgagggggaaagagagaaagaatggaaggagggaagaaaataagtaaatctgctgatggaaattgggatgtgtgactggaagggcagaaatgaaagcaatctccaatgaagggagtagaggagctgtttcctgtgaaaaacaggtgagtgatgtatcatgtaggaattgttcgaaaaccagtaagaaacctcctgtggaccccagccctcaatccagcctgaagagtaggaaacatgtcctggtggtgaagaggttaggagcagctgtacagagagagggaaagaaaagaaataaagggaggtttgagggcagacagtggggcagggaatgaatttccagcaggactgtggagtggcccacgcggtggtgcctggagcaggggaccacatgtgctcaggtagagaagcctccaagctccagatccccagctgcccagatgctcgtggccctgcccacagccaaggaggtctgtgaagggagtcattgggctgggttttaatcctcagaacgcgagccagatgcttaaccagagagattcccaccttcgcaccccactttcctcacctatttaggacttcctggtggatcggcggggaggaggacagagaaaattgttccgctgttaatctgcacccttactgtacctctaagaggatggtctggggaaacacttgtcacatctggaaaacatttccttaatggaaagagagaacattgttagctattcatgtgtgaacatacagctttttacctcccttctctgagccatttttttcctccatgttaaattatagcactttcttcttgtcaaagggcctgcgctatacttaataaactatctaattaataaaatttaattttaattttagaaaagtcccctccctagagaagccttctcccaaaatgaagctgtatttcattttaaatttatgattaattttcattattcctttggtaataattctaatgctgaaatttgttatgcatcgtttaaggagatttttgaattaaagatatttgaatagtcattattttgccatataaatttagttttatgtatatatactaaaatatataacattttcagagttatatgtgacaaaatacctctaaaatttagttgttaagtatattaaaactactttcaccatggaaaaaacctacaagtaaacataaagatattttagtgagcttaactttctcagaaatcacaagttctgagtcacatatctgaaacgatgctaacaatatttagggcttccacaaaactccatcttgagagatttttgtcaagtctttggctaattaatactcgaggcaccctgttcactaggtttttctgtggtttcattgtcactgatgcatattaatgacatcagacaaataaagtgtctttcgtaattgcttgtctcaaagcattgtaaaaatcaaatatggaataattaaaaattcatttacggtttgtggctgtgaatttgactgctggaaggttgagtcgaaggcccatgagtgtccttgataagtctgtacagttgattcccagtccagtagctgccccagtcatattatatagatggcttcagtcaagggagagtgggatgttttgaaatacagcgtgataactgtgcatgttagcacaaatagccattgaaaagaactgttagaataactgttgacaggaaagacggttggctgtttattttccaagataaaaaattagggtcaggtggtattatctatgtacttttcattattcatgcaaaaccaaacaccttcagcagtaagaatattttgtttgtgaaacagaaaacattatttcactgactgggccacttttgttaaaaatatctaatagatacatggttgttttgaactttataggtcaattttagatttaattacctattaaattcccaatcatgtatagcattttgtgttgtattaacaaaatagtagattctctgaaattgtttaatgttttaaaattgtcttggttaactcaagaatggataaagtaatataagaacagtccaatttatatggtagcatattgaattttaaattctatagagatttattaaaatttacattttttacatgagtgcaattacattttaagtgataaataatccagaagagtgtattttataaggaaaataaatgagaaaatattttcattgtctaaagatgtagtttttttttatgataaaaaagattcactgtagggaaactgtaattagaactaatttatccatttgttcatggagttcccttaatgagcaagaatgccacatactcttaattatctgtaaattttgaccatttacataaataatcctttttaaatatgagtaggacttatgatactaagccactcttgagcttttacaatatgaattaaatttcagattcttcatttgtctgacatgtgtttattgagtaccagtaaactttaaagtatttttctagatacagtggatgcatagaacaatgaatgaaatggataaaaatccctgttctcttggttttaacattttagtgaaggcagcccaccttaaaaacaaggaaatatgtaaatatgtagtgtaaatatatagcatgttgcatagggtcataagtgatataaagaaatatggagtagagagggaagttagagccagaggaggacaatttaaaataatcatcagggaagattctaagaagaccatagtcaaagcctgggagctaatgaggagttggtgggtgggtggatcagatagggccttgtaggctattctaagaaatttggctttcattctctagtagaagcagctatggaaggatctgtagctgaggaatgacaaggtcttgtggcactgggaggttgtgcagggtagaagctaggagccagtgaagaaacgttagatgtaattgagggaaaacagaatagtggcttctattttgggtattcaggatggattgatttatttcatgtgaggagtgagaggaccagaactaacaataggaccaatttttttatcctgggcaactagaggtatgagttgatttgctgagctggggaattctatgggagttgcaggtttggtgaatgctatcaggagtttcgtttgggacatcttgagaatgagtctaaaatttgaaatagagatctggactgagatgtaaatttgggagttccatttctttgtaatttaggaatagaatactaatgttttataatttttatttctaatttggatcagaagagttttaactgacagtgtagccaacgacaagtattttccttttattcagagcatttcatttgttgttcaaataaaaactaattgttttaggatctgaaaggctattggggttattgttataaattatttctggctactgattaatacaaagtattatttttctttaattgtaaactgacaatagtaatagtaaaagtgattgtatttttattttaatctgattaaatattagaatttgcagtttggaatagtgacaggttttttcttagattagttcacaaaagcttgcattattggttatagtaattaaagtttacaaaattaagaaaagctttagagtactttgtagcctgatatattcttattaagttttgatgggcattctgacatgaggagacagtttttatggaatgaagttaaaccaagaagagataaatgcttacttaaatttgcagaagaaaatgtaaaatatataccttcaaatttctcctttgaggacattcttaatgtaagatgaaagctgttggattttaaacattacaaacaggcaacttgttttttccacattataatgcttgatagtgttctttcctaagggagaaatttctttgctagacttgctttgaaacttcacattgaaaatgctttttttggccgggcgcagtggctcacgcctgtaatcccagcactttgggaggccgaggcgggcggatcacgaggtcaggagatcgagaccatcccggctaaaacggtgaaaccccgtctctactaaaaatacaaaaaattaaccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaagaaaatgctttttttacttgctttttgctgaggtgtaaaatttgcaaaggttatagaaaaataatagttttaagatactcgatgtgcagtttgttctttttgagggatttggtgatttttctgtttccagttgatgtggttatttgtcccagtctgagtaatgtttagccattgcccatgttctatctagtcccaagtacttgatagttcgtctgtgtttctggtgattttttttttttctggctctgtgatccttgtgaatcaccatccttggtcccattatacccagtcttcatttaaaactaacactcaatacatcttcaccccaccctgacttttttccacattttatgaaaaattttaaatatatagaaaagttgaaataagtatgcagtgaagacccatctacttaacacctagatttggcaaataacattgaactttatttgctttattaagtatctatttctctgtttctgtaaccatctttcaaggcgtcttatttttttatgcatttccaagtaattgcagacatccatacacttccctcctaagtactttagcatgcatatcattagcaagagtttcatattatttaaagatctttataaagtaaaatttacatatgatgaaatgcacaaatctcaagaacttttgatgagttttgacaatgtatgtatctgtgtcatgtaaactcctatcaagatatgaaacactgcaaccacttccgaaaatcaccttttcccagtcaatccctgaccctcaaacctcccaacagcaaccactgttttgattgttttctaccataaattggttttgccttgtgtagaacttcatgtaagtgaaattatatggtatgtattcatttgtataaggcttctttgttcagcatgtttttgagattcaccgtttagtatatttgtagttagctcctttctaatgctgggtgatattccattgtatggaatattccaaaagttatttatccttcctcctgataatggacatctgggatttttccagttttgatttattaatgaaatcaatatgaccttctccttttaaaatatgactcttctttcatctaataagtaatcctcttccccttcaaaacagtcttattatcacccattcttgtttaaggcaagccatacgttgtagcttatttctagaaacactgtgtatataagaggcttttctcggagacttgaaatgaaaggttttagaaacatttctgtgcatctccgagttctctttagctgtctgttccagacagtcactttttttttttctaaaagtcttccatttagacagacacatgaatttctcttgcagagtctgccctttacatcttatttattcctatagtcatgttaatttggagacaatagaaaaatttttcctctttcatgcataatggatggaaatgtgtgtaaagaacaattacggtgttccaggtaattctgtatctattgcccccttcagttgagagtatggcaaaacaaaaagtcttaaggttcaacaaagccttcaccttgaggctgtggcccatcagggtatgtttgctcttttggggttagtaaatgtatacactttcgagcattgagcttgatgttacctgtggcagtcactttttgtagagagaggctctgcatgtatttgctaaccacttggtatcagaagattccaatcggatttttgtatttcccctcagagttttcaagaagcaaaccaccaagggcattatgatgtgtccttttgtctaaacaccttttggagcgaaatctgagtacacaaccatggccttatgccctggagttttacagctctacgtttgaggctaggaaagaagatctcaattgagggtagtgtaatatattctctttgaaaaaattcccttcaaatacctttgtgctcacaccaaagaattattgtatttgattaaatgtaaggccaagcattcaatttttgcattttcttttctcttgcttgtgttttcagctaatattgcagagcattttatttactcaaccagattgacaagattataactgggagctgtgtgtggaagcctctaatttttcataagtaaatgaattaatttatcatcgctgttgtgttttattgctgtctctgtgcgagactgccctgctcctttcttcccccttttgccttctaaacattggatccatgtcatcgtgtttgacaggtttctgattcccctgtcagatgcaatttggtgctaatcacatttcctttgctcagtgtcaatgatacaagccatgcataatattcctatatgtccactcactcacttgcagtgcagctggaatatcttgggcattaatctgagagaatgctgcattgaaatgcaaaaatgatgcttgagcactaagataatgtggtcaggcagatgtgcaatagataagtgaggctaaagtggtgatcttttcctaagctttgatgaattttatttcatttctgaatatctctttacaaacctgagactatgtaatcagtgctggttcattagaccttccgcatttttaatagaattcattcattgtccatgtgtgaagaaataagaattatttttcccattaaaaagaaagttataggtggttatttttaatgttgaagagtatccctgtctagatcatacactctatcaaatgcatgaaagtagctaacaatctagagaaatctgttaataataagccagtttctaatctagatgaggtcacaaacaatagaccttatgttagatcattttagacaaatataatcaaagtatagtgggaggatttggattgatttggaatgagggtgattgtttattttttgaagtctagttaagatgttttgacaattagagtagggtggaagaagcactcaaaaaagaaaggaataaaagcaaaattagagacaggagagggtggtgtttatcagtgaaatagcagttatccattttggtggtaaataggactagaaaagcatttcaggagcatgtgagagaggtccttattttatagacaagagggaatctttttctgttattgttggagcaagcctgtgtcatgattatatttgaattttagaaagaaaagtttcatggtagtgtggaaaagaattagagaagaaacagaaagagatatcaaataggggactattgcaataagtcagataagaggtgagggcccaaagtaggagggtggcagtggaagtacaaaaggtgtgacagatgcaaaagttattacaaactaaaatctgcagagttgtacaactgttgggatgttgcaggctgggggtgtggcatggtaaggagggaagaaagaaccaaaatgcttagcaagtttctgcatggaacagggtactgtggattctgatgccttttaagtgagaagaccagcagaagtatgagtggggtgagatcatgaatttagtttgcattatgctgaatttgagcttcccatgggatatctaaatggcaaagaacactggttaggatgtggggagattcaacggccattttcgtttatgcaataaataatagaaatcatgggaatggttgctgttattttcagggagagaatataaagcaaaaagagaagcaaataagcagtgaaaccttggaagtaaggctaaaatgaagggaaaagttgtaccaaagtgaactgagaaaagactgaaataagcaattgtacagaaaagggaaggattgtggaagctggtggtagaaggtagtcaacactatcacatatggtagaggaagacttaggtagtactattgaatgaataaatgtaagaaatttttttttcttggtattatttatacagtgtttaacaagttccaggcaggttcaggggagtagtagaacgaaaagtcatattgcatttggttgaggagcaaatcagtgttgtcacattggaagctgctcattgttcacaactctttgaaagaaattggtggtaagggaagtaggaagaccattgggattgtagcttaaaggaaacgtgactacaaaaaaaatacagtttttttttttccttttaaaataggacataccttctcaaaggagttgagatatcacccccaaggggaaccaaggaagttgattctttgggaacaaaaatatcttaaatattacaatgtttgtgtctctccaaatctcctcctacctgacaaaaatcgtagtatttaattgatcttgtttggtttttatttgggtatcacacaggcagcattgactgagttcataaacgatataacataccttttatgatatgagatcagtgttccaaaactatggtgcatatacagcttagttgtaggactccatttattgctagatctcagagttgaaacctgagaagtggcctatgtctgtctgcctcttagctacctctgactgctttgtgtttatgtgtgactcagattttgaaagttagattagtttatattttattaattgtaaaaattattcaacccattattaattatatcaagtgctgagacgagaaagtattgacaatatctgaatgattatccagtagccagttaagtgaaaaattactttcttgtattcatatcaaccaaaggttaaaggtaaatttactgaaaataaatttaaaaaaataatttaattgttcagttgttttgcttttgctgggaaataattttgaaggactgaaaaatttgattatattgtcattattatgtatttttgtatatttatttgtatattaaatttgatacagcacaacttatgtaaaataaattgcattaatagctttttaatttttaattagattttaacttaaaaatatattcagtcagccttaaccctatacttattctttttatgtattatataaagcctagatatatgtgcagtacatcagcaaatatacaatatattaaaatttcatatggaggtggcaattaggaaggcaatgtcttaaaaaggctctggagattgggtggaagaaaaaagattgagaaatactgggatagagcaatcttaattattgttcctatttcaattaaataattttttacctgtgagagtcactaaacaatatgacaccactgatgctaacttttagaaaaaagcaagaaggtagcctacttttgacacaggtgcctatagaggatatacttttattgataatttttatacacagaggtgattgtgattcacaaaaaattatagtcaatttcagttgcagtatgttaaattggaagtcaaattttagtgatccgaattgaatttcaacataatctagaatttgtaggacactaaggacatgttacaactgtgttatttgccttagtgatatagtatttgatgcatgatatttcaggaaatattttattaaactcagattctgtaaaagctgtaaaatgaaggactaaaaccactgatggtgaaataggatcttgagcaaatcagatcttatgagtcttgttttgaaacagttaaagggtgtaagatgtgtgctttgactgtgcaaccaaaacagtgcaatcccaataaacattaatctgcagggaattttcaaaaaggagaaaggttacccaaggataacatagaactaaaacatcatggctttcactgggagaagatactttcttcttcatgctgttagaatgttaagagaatgaaatcttcccattcatttggtaatgggacattgattataacattggtagctgcttgtagcttaattcgatctgaatctttgtaaaatttcaaactagtattaaaggggcattaattttacagattttttctttttaaataaggaaaagttacaagcatatgtacagcaataccatgtattaaaaatatatgaagatatcaattagttactactaaaattgttaaaaagtcatctgtgaatagtcttttgcaagatttggctccctctcaaatatcttctgaaaatctttgtgaaaaattattattcaacagtatcagtccctactgcttgtacaattctgtaatagaaatgctgaatattagaaaatgaaaacaaaaagcctctcccagcttttggggagctttaaatttaatgtaaaagttggaaggtacacacatctaaaactgttcacaaactgaaataagtgaaaatgcaatgcaagtgatatatgtaagtgccgaattggattcacagtaatggaatgatcagcgaggctaataaaagacaactctgcaaaaactgtatattgagcaggattttcaataaagagaacagtgtaaattgaaagagaagaagaaattctgccaactgtaacatatgtacctgagctatacacacacgcaatctgatatatatgcatatacatgtatacatatgcatatatgatatacatatatatcaggtatataaatatatgtgtatatacaggtatctatgtatataagatatatatgtgtatctctctgtccctgtctcaggcacaggtaaaagaaaacccatagctgatgcagatgtgggaagggtaatcaattatctctgagtaataggtagaaaaccctgggaagaaataagcatggaaaagtgtagttacttactgtgtctaagccttggcagctagatagcttgagactcaaggaggaattttatctttcctatgatgatggtggctatgaagagaaataaatcaatttttattgttttactgaatgcattgtttaactttgtagctgggattgagacaatgccaccctccatcaccaccaagcatcccaccctctttgatgagtagtagtcaggttttgaccttgtaattgagctccttgagtccatgtgacgaaaactgactaccctaaacaagaggaaatatattggaaaaaaacaagggcttataaaataaatagggtgatgattgagaatttaaaaatgaacaggaattacggcaagatgaggaaacgagtcaaaactgtttttcagaaggaataagctagtcaggatatagttctgcaagcagacatcagacttttctcatccttgggtcatttcagtgagattcacacctccaagagacattattgactaagcttaagcctcattcttacccctactgatatggtttggctctgtgtccccacccaaatctcatctcaaattgtaatccccacatgtcaagggaggaacccagtggatggtcattagatcatgggggcattttcccctgtgctgttttttgtgataatgagtgaattctcatgagatctgatggttttataaggggctcttctacctttgctcctcactcctttctttcctgcctccatattccccttgccttctgccgtgattgtaagtttcctgaggcctccccagccatgtggaactgtgagtcaattaaacctctttcctttataaattacccagtcttgggtagcacctttataagagtgtgagaacgaactaacacacctacattttaccactccagagatatatgcgtatctagcaactttggctttggtagtgagcactaggcacctggatttgtcacccaggcaagaccacacacaaagtaatcccccagagaaaatcacagggctgttaggaatggggaatggatggtgcttggacaaataaatgttgagaaatgtccactctgttatctcttgatcttgagtggtggataggagcagtttatcttaaagtccttgacatctgtagcagctaattatcatttcttcaaattctcattatattttcaagcaacttcttttctcctaaagaagttcctaggtgaaattgttctctgaggaaaatagcacacccctcatcactaagaatagaacctgagtgttactaattaagtcccaattctaattatgttaatgaaactgcaaggggactacacagctagaagccccagcgcagtactatgccatgccatgcagctgtggatctcctcacaacatgtgagttcgatccgtgacagcattttacccttattatttctctcggaagcaaactaggtcttcatagcagttttgaagtttcctcagttaatattctgttttctttggaccattgacctcttaaattctggtacagtataccagaacccaaggatacactctagcaatttctaaatattcaattgtatagcatactcttcaagccagttttgaaattataagaatggcaaatacaaatacatttgccattttttgatattaaatattagtcctatgttaaaatatgtaaactgtgacatctaaacatacatgacaaaagatatatatgtgtcacctaacagctaagctaacacaaatgatttttatcactggaagaggagcaagtaattccaatagtatgtttgggattataggcagaattatgatacccccccaaaaagaaatccaaagatgggattagaaaaagagtttgagtttttaattagtattttagcaaggaatgcatagccctctttaggactaaagaataatacatttttggtgatactaaaaaaatactgaagatgtaataggactaatgcaatggactgaatacttaggtctgccctccgcattgccaaattcctatgttgaaatcctaactcctaaggtgttagtattaagaggtagggcctgggggaggtgattaagtcatgagggcaaagccctcatgaataggattagtgcccttataaaaggcaccccagagagatctccttctccttccaccatgcaagggtgcagcgagaagtcaaccatctatgaaccagaaagcaggccctcaccagacaccaaacctgctggcacctttatctcagacttcccagcctttagaagtgtgagaaataaatttatgttgttcctatgctacctggtttatggtactttgttatagcagcccaaatgaactgagataacaataacataattctgttttggaaaatgtactactttggctgctttggattataattataacgttaaactcatgtagtaatggtttgaattgatacaggaatccattctattagagaggagttataggcacaagatatttcaagaaggaattttgaaaacgagtcatgactttttctgtagcccattacttgtgctccttaataagacctggtagtctattggaagctatgtggttgaagtattagcagagcatttagatagatagctacgtaggtaggtaggtaggtacgtaggtaggtaggtaggtaggtagatagatagatagagattgatagataatatatgtatactttgtaatttaagcttgtatctagaagaaaaagcatctatcaattattactacaaaaagatgctgtttaataaataattgcaaaattgagtgatttaaaacagtaagcatttttcattgcccatgagtccacatgttagctgagcagttctggttttggctgggtttactcatgtatctttgggtagttttaggtcaattaggcagctctgctgatctaggccgtgtcctctcatgtgtttggaaattgataggctattgcctggtttcatatgaccttggctgggacaattggactctccttcataggatcttttatcctccagcaggctagaccttgttctcatagtagtgggagagttccaaaggagcaagtagacacatgcagggtctctagaggcctcggtttagaatggcacaatatcaattctatcacttctgttgggtaaaataagtcaaagttagcctagattcagggagtggaaaaatacactctgcttttgatgaaaggagtttcaaaattccattgcaaagggaaagactacaaggacgataattggggccattttaaacatcaatttaacacaaaagacatataaacgtgtatgcctaaaactctgaaatactatcacaatgtgacttggtgcttaaacaagtggagttctaaatcatttgcagggcaataaagaaaacattgctcctggataggacagtcatcaaagacgtcttggtcaatctcatttaagtgccatagttgggtgaagatctcagtgcagaagggagaaaaaaacagaactttaccttcccttgctgtaggtgagctttgggcatgctgatttagcattctcctctgcttctttcatacttctttctgagaacatgcctttaacttttgaatctctctcctgccttaataataacaatagttggagtggaatggctgagattgtagctgaccaactgacaaaatggagcaggtgagggtcatgctagccttccacccatggacagtatcttagatgaaaatactccactttggaattgcaaattgacctgcatggtctctgccctggttgccctttttagagtggaaatatttaacttgtttttccaatatctgcaaatggttctaactcactaaaccactaccatcctggttaatagctattgcatgcagttggttttcttaaccagaatactttttttttttccatttcagcattccagaacttaaccaaaagtattttcaatatgattacatggacttcttcccaatatgcttctcaaaagaatttgctgttaataaaaggtcactatgtatatcataggtaagcatgctgtttttggatgcagctatgctagtgttcactgctagttgaataatctgccagtggacacacgcttcactgacattgaatgttaaggattctcagtaatctaaacgtcaaacccgccaatattagtaacttgaagaatggatcaagacagcttatttgttgttatttcacatttataaaacgtcttaacattactatcttatacttaaatacagtttgtaaattgataacaaaatgagttaaaaattactgggaaagtccttttaagtaccaaaatgaaataaatattcttccatgcttaaatttttatgaggaatttttatttccagcaactgtaaggctgggcagcaatgtttgaagaagtttcaataaatgtaaattgaataatttttttttttggttttatagattgtcaggtgatcaaccaagtgagaagcttttataaatgtgttggttcttctctgagacatgagtgtttgggagaaagtcctcccttaccccctgccaagaatcctggtaaaacagaaaatgaaaaaaaaaaagtgttgttttagaatttcatttaaaaaagatgctactatttagaccactccagacaatttaagtcttcctgaatccaactgtatttctattccgtaacagtttgcaggaagatactaacctttaatttagttgataatattgagaccacctttgagatgaaaatctgggtgtatttttacttgtatctatttacttgtagtctaagtaagacatgtttttcctctttgccaagcccaactattttattatttttttaataataattctgtatcttcttgattctctgggacttctgttcaaagaagtacttttttgtcttttatgttttcaattcctctctctatgtagtccattctctctgtacttgcaaacatgtttaatttttttattcttaaaaaaccctgtgttcatttacattctatgttttttttttccttttcattttctatctaacattttggagtacagtggtcccctcagtattcccaggggactgattccaggaccttctgcagataccaaaatctgtgaatgcgcaaatccctgatacaaaatgatgtagtatttgcatataacctaagcacatcatctctaggttactcataatacctaatacaatgtaaatactatgtgaagagttgtaatactctattgtttaaaatttttattatttttattatttttacttttggtctgcaattggttgaattgatgcagaatccatagatacggagggctgactatattttgtactcactaacaccaatttcgttaccatctactagttccttaagtcaataaccctaacttcagacctgttacttactggctctgtgtctggttaaatgtccttgactgccctaaaacttcatttttaacataatcagtccccatattctgcaacttgttttggggctattagagccctcaaaccatttactatattcatctttttctgaagctctgtcttccagtgcaaaactatctggtgctccttcttgcttgttcagacagttctttcttcactggctgcctgcagttgtctttattcctctcttagatcaatagcttgtcttacgtctggtttccctattactgcagaacttatctaaaaaccacgatgaacacttgagtatatggtttatctcttcaactaaattataagatctctcagggcacagatgataatacaggcttttgcctttctgtttaaacaagaaagtaagacaagttctctaggctgatgtcacagtctttgactgaaagcagttccatttattggctggatgccgatagaaggaatggcttaggtttaatatagaaaaaaaaatgaatcaaccttgaaagatcttcaaggacgtttgtggcatcaaattcagtattttgtagataaggagttagcactttggagtcaaattgccttacttcaaatcccacacccaacacctgtaagctatttgagctcagtcaaatttcttcaccattttaaggttcagtttccttgtttgtgaaatgggaataatcatagcatgtactattagtgtttattgaaattatccatgcaaagctcttagcatagtgcctggcatatgaaaagtactcaataaatgttagcatatcaactttcttatcaatttatgtgtattctttttggggtttggagaaggcccatttaatgatagtttattttaaaataatataccaacatgaggttttattaaaattagttgagtttggaaaactttgtaagatagccattgtccttgtaacatggggtataatttactttgaagtataaatgcttagaaattaacaattgttttttttttttctcctaaggaaaaaaatagtattggcaagctttccagcttttgacattcttttaagatctttaaaatactacagatctgattcagccttcagacctgttacttactggccctgtatctggttaattcacataaatcctctttgggctacaagttacttttacttaaatccaaactaagagtggggggcagggaagagaataccagtctaattgctaaagtttcaaaacagaagaatgaatttgcacctcaagcttggcatctctgagcatgtgaatcagtctcagatactcataatcattgctttgttttttaaagacctttgattatgagcagtatttaattacacagctgcaaaattcttaagacatttgatactagaaagagacaatctaatagacatatttaccatccctttgtctacatttgccgaattctagttgcatccttttaggtcaaaaggtaagctacacatttggtattatcttagagatcttttcatcattcatgctttcaatgggttacagtgtaatgtgatataatatttcagtatagaggattgacacaaaaattgttcatttaagcagtttttatgtgcctttaaaaatcatggctcaaagtattgttgaagcttgggctgcaagcttcttgccatagtctagattttaattccagttagtattctctacttctgattatgtttcatctgtaaaatgagcttaatgctcttatttcatttttttctttagtaaaagaaatagccccatgtaaattctcctttaaataatctgcctttaatggtctctgttcaatttatatcctaaaaatgtattttgcatatgaccaagttgcatttctccctaaagtaggtgaaatctaattcttacttgaaaaaatggtatcctttctccatatgattgttattcagtgtttattgaagtatatttgttgattcaaaatgcaaaaagggagttttttaaaggcagagaagaatagatatctaaataattttgtcaagaaagaatgtgtttttgattaacgtaataaacattctttggaagtaaatgtgtctaggaattggacagtagtattgtgtaatgttttatggtgaaaataagtatgtttatcaaagaaaaggtagattaaataaacagacaaaaccatcagtcttgaccccaaagaactgtggctaaacctggattctgcatttttacactagtcagtgacagctcattaaagggcttacacttgtttgtcaggttattggcactggtagtggtaaccccagggtaatgccactatccctttgcctagcttgtttggctggtgaagaattaattgtagagggttatgtattattcaattacccaaagtcttaaatcctgtatggcaaaattcaagactccccagactgtaacagcctctaagtgacctctgtctcaaacctcttaggaaaatgttggtgtgaagaactgattgctctaaggtgtctgtagggacagtacttgaaatagtttaaatgagtaactgttttcatcgttagaattaatagaatttgtagggccctgtgcacatcctgcatatctgcctggagtaaaattactttacaagctttagataaatgaaagctacccagaaactctcaaggaagagtagaatattagctgatgaaaattgtgtgtggatgtagggattcagagccacaattaatttacatttgattttaattgatgacactctgatagatcacagggactttaattaagaaataaaaatgtaggcagattagaatattggtaattggaaatagaggagttttaactaatgaagtgtggctttattaagtgttttgttcattttatagaaaatgttatgtagaacatattaacagttattttcacttaaaagaaacactgatatttagaggatttagattctttatttagaaatatgtgctgtgttagaaataatggttgtgactgtaaagccccaaattgcttgtaatgttgtgcatggacttctaaaccactgtgctttattgcaagctatcagagttcatcttttagggacttttggttcaaacatttaataaatggctgtacattgttaagttttccagggtagctacttggatctcttgcctctgttcagcatctcacttcaagttacttctctctttcattgtctctctaatttatttcctaaaatgataagtgtcaaaaatgacatagattgtaatttgcagtattacctttgccattgtggattactctcccttataattacagcttatacagaaacttgcttgatgcttccttgtaatcagaataatactaccttgtatttatgcagtctttctcttgtgacctcaaagcactcttgttaattgtcaccttattcctatgagcaaaggagacagttgaagaaagggaggcttaagtgtaaccaggttaaatgacttgcctagggtaaagccataatcagtgacatcgatgggaaggaagccaggtctcctgattctggaccagttttctctcttctgcatcactctgccttgacattttttacttgtgacatctgtttccatcactgtcatgctgttaattacttaatatcattttactgcaagatttgctaaagggaacagatacactctgagtgtttaaaaatatgtttaatgcagcatgagagaaacagtgacactttgtggggaggacatgtagattcattttattggattttggttgcttgatgaacactgctagtttcggggggaacactggaggtttcatgttttacctaaatggtgtttttggaacaatgcaaatgcatagaagtcactggtctggttttcagatatgcacctaataaagcaaaacatgatcaattcattgattactcaattacactcagtgacgtgtcccttgaattagcagatatgcctctttatgctcagttatagaatgtatagctaggcttttaaggctcatgcatatttaaaacctgcttattaaaatatagacactattacaacctattttccagaccttttttattattaaaatgttctatttccctttacacactaacatgtaaaactagatctcttgtctgaacattccacatcccgttcttctgaaaaaaggcagggtttagaaacaaagtgggaacggggtaagtatttattagtcagtttgataatttaggtatacttagtggaagggcaagagacttgaagggtatatccatcaaagttttcccatgatgtttggggctaatatatataactcattgatttaataatagaagaaaactgatttaattgttctgagcacagatttattgacaatgaagtataatttggtgactgatagatcttattatttctgccctcatgccctcatttagaacaccttatttgttatatgacgcttgattataacctgatacccagacttctgttagtcactgttatcccacagtttgacttttttactttttgtccatatttactatttttcattcttgttttccctactttttttttttttttttacatttctctatcctgttcacataagaacacttaagtttctcatgttagagtcttctgagaatgtgttaagaatgcaaaaaataggctgtgcgcagtggctcacgcctgtaatcccagcactttgggaggccaaggcgggcggatcacaaggtcaggagatcaagaccatcctggctaacacggtgaaaccctgtctctactaaaaatacaaaaaaaaaaaaaaaattagcctggcatggtgacgggcgcctgtagtcccagctactcgggaggctgaggcaggagaatggtgtgaacccgggaggtggagcttgcagtgagccaagatggcgccactgtactccagcctgagtgacagagcaagactccgtctcaaaaacaaataaaaaagaatgtaaaatatatatatatttatatagtacatatatagtatgtattatgtgtgtatacacacacacacaccaaattttatccttctgttcttttaaaaagtattttgtcaagtatatcatgtgtaactgatacatatttgttaaaaataagctacttccccagtcacagggcttatcattgaaaccattaggctcataataatgtgaagacttattttgaatggaacttgtcccttctctgttttgaaatatcagtattttaaataagagcattcctgttagttctgataattacaggattatagatggaaaatcagagctgatggtaggctattgtgaggctttttctttttagttcccagaaagcccacctaaaaacaaatttccaattatttaatattaattgagtatacattgtgtactaggttctgggaaggccctaagtgtctataaacatgtacagaatgtaagattttgttcaaaattttctttgaagatggttatagatagtcagtttcagtggtctgtttcccagtgtgctgtaggagagcacttttgggctgttcagcctgaaatcccagaacacagttttactccgcagccaggaagagaaccctgtgcttcatgccactgctccagctttctcacccagtgcacggcatgggccacgtgctgtgtggtcggggagtcatcagcggaaactttggtgacttctctgcctactggtagcaatagcatttgagtaagaaggattcttcagttttttttcatccatggtttgaaaacagtacattacttataaataaattgacaaaggtaaaatattgttgatcaatctattaacatgccggcttatcatctttctcccttctcatgcactttggactgtctccctacagcatttttttccctcttgctttttaaaaattacagttaccaacaactcataggatggcaagtactgcttattttaatcctcataataatcccattgaaaaataatattattgtcctacttttacagatgatggagcatagctgtagaggttttagaaatgttccaaattgtacaagagatcatgtagaaccaggatttgaactgaggattctctgagttcacagtcaatctcttaaccactgtcatatcctcatattcttgttttaatatgagtttagtgaatacaaatctgtctaatgttaaccatgattaactgacaagatgaggtcttatcagaaaggtacataaattaaaatagtgaatctttaaaactgccatatgggcatgaaaccgatgcagcaactggtgtaaaaacacacatagaatttgatatataagaaagatggactatgtaccagtaaaaataattttaaaatgtgtattatatacttgtaataggcattgtgataatataatactgaaatgtgaaaacagttaaaggtattgagtaatattatccccatttgatagacaaagaagtgaatagacacacagtgcttgagtaacttgtacaaggtcacatgaacaagagctctttggggggtcccaattattcttaattgtctactggaaccattgacctcggatgatgccaggaccagggtagagagaaagactgagacttgcttgcctaagtcctcattgaaggtactttaacttttgcagtttactttttttcctccctttggatgacttgcacatgcatcttcttcccaactctttttaattttatgaacaggacgttttcagcactgttgcccctctgacacccattcagcttggtctggggatccttgactggtacttgactgtagttccttggatttcttttgcagaaagactgcaaatgtgcgtttcccttctcttgtttgttagtttaacaaccatttaactcttgatcatggttgctggtgtgtgacattatgttgtgtgttgcggtactccaggatcgagtagcttcatatgctctataagctcttcagtggcattgcccaagatgttattatcaaaaaattatgtgtgcatatttcttgattcttgaaatataacatcattctcacttcctgactatgtattactgattagtatgtgtcagcgccactacagaactgctgtgggatcaacaaattgtttcttcttcgctcattatgcatatggctcctctcttgatgttagcagctgtaacagtgtatgcccttcttttatctttgcttcttcgtttgcatgatactctaggcaattttataaattttaaatcctgggtacccaagtaaatatgtaataaatgctaattctccttcataattagaaactatgaacagttttagttttaacaggattgtcttcggggaaatctgtcctactgaaaggcagtttgattggaaaactcagggttatagtcaaaatcgtaaagagcagagaacttcttggaatagagagcagtgacacgccagtggctgagtcctaggtgtgccctcaggttttataactgctgttatcactgccatctgccagagggagatgaaaaccatgcctactacttcttggagtcttgtccatttttgtctggctggatgtccagatttttaatacaatttctcattggaaatattaaagggggaaaaaagtcattgtgacaaaacagtaatgtatcaagtggctttccacttcaactaaactaaaatccacagtccttcctctaccctcctgtgggccactgagttctggcccctgcatagcttacgcactgtattacagccacaatggctttctaaatgttctttcaacaagccaaagcctttgtaagccctaaagcctcagcacatgctgttccctctgcgtggaattccacccgtagggttcttccacttttctgactcccagtcatcttttagctctcagcttaaatatcaccaattcagagaggcccttcttgactaattttcccaattcttcggtctcattgatcactcttataacttcttacacctttcctttcaacacttaaaaaattctatatttgtacatttatctcatacttttcttattcactagactagggcttctcaaccatggaagtgcattaaaatcatttagggaaattttaaaacataccattcctcaatatcaccctagacaaattgaagcacaggttggagcctcatcatcagtgtttttaaacattcttcagatgattctgttgtgcagctagggttgaggaccactgggctagatcataagccacagaaaggcagagatgatgtctgctgaccagtgtatacccgtagcccagtgtagtgccttggagaccaaagagctcagtacatatatctggatgaataagtgaactcacagagagtaaatatggatgcccttgactatctcaatgatttgtgatacccagaaaaatacaaaacatcacagctccaggactattccatatttatatggctggatggcatcaaatgtacgaaacattaatgatatctttttatactcattaggaaaatgagtattatctgacatggtactcctgaaaacatgtcagttacttgtgaaatcacaagtgcatttttttttctatttcttactcttttcttcaagttaactactgtagcaatatattaccctcattttgataaaaacttaaaatatgcaagatccataacgtattaacgctccaaccaaattagttatcacccccacctcaccataaacaattttttaaagactgtttttaatacctcacataaaagatattaagtgccagaattttttgtctattaacccaaatataataaaaaatgggttatatatttccaaggggaggtgacattgtcctttagaggaattgttgtgctatagagtagatcactagaaggcaagtggtagaatttaggacaatgtgttacagaaggctttttattcatgtctgtgcttcaataaatcaaggaataacagagaaatgaagacattatgctgtaaaaacaaatgccgtgttctattttggtatttagaaaattaactttttgtggtatgtacatttcaggaatcaatattttttaacacgatttcttttttgcttattccaaaagctgctgaaatctgaggcaaagtatatcaaattcaacaaagaggggtattataaacacagtattatccatatctataatttaagtgagttttataaacagggccttgtagctttttgcaaataactgataaaatatttctttagggaaaccctaccacctatcccaaatgtataatagtcaaaaatgtttcctatttattatcacaccattatttctcaatcagaatgcttttctcaagccattggccccaaatgtacttaaattaccattatacctgaggtttactgatatctcctgataagagcatacctgctattttactgtagaaacaaattggtaagttgaaatattgtactttgtttctgagagaagaaagataagcattgctttcacaatgatccttttggaaaaatattcataagagagcttaccggactctggagagcttactaggctctgtggatatttttaattcataccatagtgtctttagaagttaacgtaggaagattaatgctcttggagaagagttcaaagtgtttagtgccttttccaggttagtcaccatgccagttgttggacaaagaactctggctcctcttccgacatgttatttcatgttcatctaaaatacagtcccttgtttcttccctgaaaaatgtgataacatcctaggaagaggtggtgatctgagagttaaagggataaatcagaaagtagtgacaattctctgggagcgaactggagtctccagcctccagcattgacaggtaagtgactgtgcagaaggacaggttgtttcattatgttaatgaagtaacttgagagttttttttttttttctcagttgtttatctagaagttctgtgtctggggttgatttcactgttcatgtacatgaatatcattacaaaaaaaattgtagaaaggcaattctaagatatgcagggaaattagtactattattagcaggtactgcttgggagttctgggaacagttcactagctgtaaatataaagaggtgggacaatttgaaggctagctctgttgtcgcagtggttttgagtgcagcttgaaaattagagcttaggtctgagttgctaagaactgctagttgacattccaatgacaccatcatcatgtattctaggagtacccctgctctattttcaagccatggtactcaatgttgcaggagtaccactgtcaataagatagtgtccttagcctaaggagcttgttatttattaggaataaagattaaaaaaatacagtacaagaaaaaagtaagagttataaaagatgtactacaaagaaattcatcatctcaaagatagttgatggagtagcagatattcagtgttgtatgttctattcaattaacgtgggagagttaaaaaactaacatcctagtaattgataaaccttggtgtttgttatatatataaatttcatatgtgtgaatgcaaaatattttttaaaaactttgtttctattgctaaccatagattaaatcactcttcttaccagtctgtccaacatggccaaactccgtctctactaaaaatacaaaaattagcagggcgtggtggcacgtgcccatagtcccggctattcaggaggctgagggaggagaatcgctggagcccggaaggcggaggttgcagtgagccaagatcccaccactgcactccagcctgggcgacagagcgagactctgtctaaagaagaaaaaggaaagttctaacaccttaaggatggcaattaatgccctgataacataattaacaacctggctatgagtggcataaaaaagttaattcacaaatactggaattttgttttgttttctcctcttagacttcctagcaggattagatttattactgctgcacctttcccatgaaaatcaggttttctaaatgggaaagttaaactcattataaattcctcaaggtaatgttggagttctttgtgctgtagggtttccaatgtgggtcttttaacctttgcttccatttgaaggaaattttccagacagatatattcttacttcaatggcatttttagatgctgtacatgatgagcaaagacagtgcagagtgttgaagaaataatttgtgtttccttgaaaactgaatttcattggttttttttagagttctcattattgcaacattctgagtgtgtgtgtatatatatatatttaaattatatctttgtgcatgttctaaatgtcaaatataaccactagaatatttggtctaaaagggagaacagaacttgaacttagtcattcctaaattcatatctttaagctggttttatatcattttgattccagaaatattcacttgtttagattttttaatgttcctttcaggtaatgttcaatatgtgcaaaaatctgagtagctaatcagtaattactactttgtaaaattgaactaagttgggtttttcaacatgtaaatcagccttctttaggatatagtaatcaaagcagttctatgatgcttgttacaaaccaattgctaaaatgaataactaagactaaaggccttttttcttgttggttaaagttaaaactgactagctctggaaatgtaacttttactttccctgtttttatagtaacgcttcattaagatgtcaagtcaaaatatttttttctttctctttctgttttgatatttcatctgagaaccaatatttcaaaaatgtagtgatttagtataaattccttagttccagtcagataaataaaccttaccagattctgtgaactgatttattgataggactctgagggaccacaagcatttttgagaatgtttgaaacatttctgaattctgaattttattgaagttttatcccaagagagaagtagagtgagaggaaaacctctttccacaaatttggacatcgtaacaaagctttaactttctttttttaaaggtcatacaggtatttaaaaaaaaaaaagacaagtagttatacaaacactttggtcaccagtgaactgataataggagcaatcttttgtgtagcaaattttctatgttgtgtagtaatgcaattcaagactggtataaatatttgaaataggaaatccctaaacttattttcatacagtgattttgactttttttgcaatcaagtttatatctctttctgttaaagaaaaaaattaagaaatactttttgtgaaaaaaggaacaacagaaactggggcttacttgaggagggagaggaacagaaaaaacatctactgtgtactaggcttagcacctggatgatgaactaatctgtacaacagacccctatgacacaaatttacctccagaaccaggctgcacatgtccccctgaaaaataaaaattaaaaaagaaaagacaagaaagactttgtgtaaaaagacaagaaagactttgtgtaaatacacctctttttaaaattacccctgacttaagaaagaagtttttcacattcttaatgtgtgtatgtgtgtgtgtgtatgtgtatgcatatatatatatgtgtgtgtatatatatataatatgttaattttcatagatccaaacagtttctctctgcttttctcaaacctaattattttctctcctaaaaggacggtgactggaaagatcgcataggtcacgaggatcttcctatgacctatgatgagaaagaggttagaggtagactggctgctggaaaagagaagccaagatcccagcaatgagccctttcctctgcttctcatggagttcttactggtccccaggttaacctagggagttgatacagtgccctttcccaagcagaacatctggtttactgccccttgcccagtggttatatgtgtgccaggtttgaggatcctgcaaattgctcgtaatggaggtaaatggcttgtgccatgagaaaccaaactgtgattactagggaagatttcttaagttacccagtttggaatttattttgttttattgtattggattccatattaatagaggtgcttggaggaccagttaaggagcataagaaaggctggttttggcaagcagaggacaaatccatcctctcttccttgagggaaagttcgcctctccattgccatccctacattgcctttcctatctgccatgtgcaaattagggagactgaggcaacaaagttatatataacactagaaaactgagatttcagaggggaaacaaagttaaagcccaaagagtaaaatactaaagggaaatttaaaataaatgctagcaataagttagtaaaagtagaaaaggggactaaacattcaaaattacatcacctcagggaaactaagttaagaacaactcaaatgatttacaaaccaagatttaaaaaggaagaagaagagaaatagtgagacaagagaagataatctgaacactccagaaagaatgaaagaaactggtggcacaaattcaaaatgaagtaccacttaaacaagaaacagcagtgaaaccaactaacctttaatacattagtcttgtaaagaaatgtgcatggggaaaaggagaaagcaggacacatttttaaagtggtcctctgaaatgaggcagcttccacagctggaggctccttggagacctataaggcagagagagagagctgagctgtagagggtaggagatgactctctggggcctcctgtcaatggcttctgtcccccagctcccgctaggatacctgaaagggcaaggagatgtgccctttggtaaatagcaatccatcaagctgcaagctggtagcttcccctggctggctttccacaggcatgaaagcttctgtggccatctccatttctttgtgaaagtcctgtctgaggaaagggatcccattcagcctggtgttcttcaggcatgtggtcaaggcaaggcgcctggctaatcagcccatcagctaatcaactattttataattttatattttaatgcagctatttaatccaatgttgatattttataatcagttacttttaacttaaaaatagtgagttttctaaattttagaaaagctttattttgaaaaggtttgctattttggttgccgacggagtgattttgttctaattgtacctgacctcacctgattaagactacccacttgccctcactctttcttcctccaccatggccttctccctttctttttctctccagcttacctcacagggcctacgttagagtaacacttccattgcccacaaatttgggggagtgagagaaaaaattgcacaaagtgcatttgtcagataactcaaattccaagtgcccaaactgtattttaatcttttgttgggaatatcctgggatggggacaatgagggagatctgtacattacataccatttttgcatagtgtgtctgtttacatcagaaaaagatttaaggtagtgttacagtaccatcgggttcatatgctcactgtgcagcaacagaccaatacactgagtcagcagagtttgcagcagagaaggagcttgataatggcaaggccatcgagcaaggagacaggaagaatcttcaaaccttaactttgttttcctgaggggctctgggttcctaaggggatcatggagggtgatggactagaaaattggggtcattgattggttcaggtccgggagatgaaatcaccaggatatagaaactgcatacttgtataagtcagatccttgctgggcccttcagaccagctagctcgggtagttttattgctatgcagaacctgaaggagaagctcctcaaagggaaagcttctcatctcacagtgtcttagatcttatctatagaacagaaaaggaacacagtcttgtgaaaagggctatgttattctggagtgataagcagcaactagctacaaggaagtgagccaaagggcaagtgggcttagtgaatgcttctgattgcgctgcaagcctagttgaatgttttcttcccttaactgattttataaaattttattggggatggcttcagtggccttcttcatagggttattaggatggaaggtctaacaaacacaagcacaaattataggtcataaaacccagtacaaatattgggaaaaatatccctgggcaagacattcaaggtcctttgctttctgtctctaacctttcagtttagccttaattcctgtatttcttttcctgttaacctccagagacctacactcaaaacacatcctgctagttggttggctttttgcaaatagtgaatttgcaatttcgtgctcccatgcgtttgtgtgtgttgtttcttctgccttgaaggacttctcaatcccattgtccagtgaaatcacactaattaggaccagcttaaatgtcatcttcccctctataccttgcttaacagcttccctgcaaatatagaatgcatctttcctcttgcttttctggcctggtattttgctccttcgactatttcatcacatgttacaatatttatattgacttgcatattcatctgcccttcctgttcctgaattgataggttcttgaaatgaggagttgtatgctcagttcttaacacagtgcttggcctgttacaagtactgaagacgtgtctcttggctgtaggaattgaagtacttcatctagtttctcatccagcattactaaacacattttaatccttcctcatttattgaggcacagtcaaggctgggatacatagttctatatctgcttttaattttgctctgtttccttttagctctgctttttctgttttaaatatatgaagtcttccctttctttccattttttctgttaaatcaactctagcctgcagattccatcattgaccatcttacaacctctatgtaattgtagggaacaccgaggagatttattttgcttctaggtcttggactttgttctaatgcttggatgttgccagttgcttgacctctgcgtaaagaggatgtactgtcagggttctccagagaaactgaaccactaggcttgtgcatgtgtacatagataaataataaggaattggctcacatgattagggaaatggagaagacctaagatctgtagccaggaaattagagacctcgaagagctgacatatgattccagtcctggtcagatagcctgagtaccaggagatctgacattgtaaagtccagtgcagaagccagcaacctgaagacccaagaggagctcatgttccagtccctatccgaaggctggaaagaaaaaaacaaacaacaccaaaatgttcagctcatgcagtcaggcagcagagacagattctttcttactcagtctttttatttctagtcaggccttcagtgggttggatgaggcccacccactttgggaagggcagtctgctttactcagcctactgactcaaatgttaatctcatccagaaacaccctcctagtacacccagaaataaggtttaactgaatatctgggcaccctgtggctcagtcaaattaacgcgtaacattaaccatgacagagggagtgctctgcatatgtattttgctagtgatgccaaacagttgacttaagaagggaattatgtctatagagagtatcatttattttacaaatgataatgaatttacagtctttttgagaatttcagagtctagtctcattttgtcaatgacattttattcatggagtaagtgtagagtgaaaagaactctacatattctagttaaacatagggcaggagtccaggagtctcatattaaataattttaggagctaagaaagttagtaaataagtaaagtatgttgggtgtatgccaagccagaatagtgggaactacagtacataggacaactctagaactattttcaaggtatcccttcccttccctcccctcccctccctcccctccctcccctccctctcttagcctttggctaaagtattttccttgtttacttattaactagccacatgtctctagaaattcactgactttttccaggccttagttgttttatttaaatagatggcttatctacagtctgaagattctttccatgcattttacctgcaagataagtttgagaggttatgaaataacacctttgttgatttaaagagatctaccgtgagttctaaaggaaagtgacatgtcatcttctaaagcaacttaatttgcttcccagtaatgacatgatgaataggtctattgtttgcaaaattcaagagcagaaatatcataatcataattttgcaccaaaaactactttgtatactcatgtgcttcatgatgtaatgtgaccagattttttcataattaagtatcaggtctctacaggtgttgccaagtctgtatcttgctatgtttgcacatactttgctttctaaagacttaggaatacttcctgttgtaaggtaggatgacttccaatacatatgtgttggtatgtgttgatttttcttgtttaaaggcttttcatagggtcctggagccttcaaactataaattaatgtgagacagcctctgaggatttatggagtcattttccctttggctaaagccttccatggtcacagaccactagatttaaaaaggcagccagacctgtccaaagaccaacataaattttcagaggcagagaaaatggtggctgcttattaaattagtgagaatatagtatttggcagctacaaataaataatgttttctccccataagctagaagcaagacattgaagctgtgtgattttggacctacatttgtcaagtttagctacatcagttgagaataatttgcatgttacatggagcacttacttgagacttccgtttagatttgactagataaatgggttcacctttgccaaaaagctcccagttctgaccacatttaaaacatttttccccagcacacagagaccgaacatgagcattaaaacaaaaaaaggaacctattgttccagcagactcttctccagttccccagtatttatcttacagggttttctaagtgcaatatcaggtgttcaccattggttgtccgcactcactttctattttccctcttgattcagagaaattatttgtcttagtccaataaaaatagggctttttcttttggtgattcactatatgaaaccattttcaccgacttccagggtttggggaagaaaacatgtttatccttgacagataatggtatttttccatgtctcacaggacccttcccaagtcttttttttcctatacaaacaaaataaattataggactagagactttatgaactaaagttgatgaactgtactggttttctagagtactttctgagaaaatgctgtgtagaatttccagtcatgaaacttgcatgaaaggataccacagaatggcaggcatctttacttcctcatactcagagatgtttttatgagataaaactattgaaaacagattacatttggagatatatttccatagcagactattctgtgtttctatggaaatgggacttatttctcttaaccccaatatcaatatcgcatgggtagaaactctaggtacaaaatgtaggatggatattatgttctaattggtatctttttttctcctctttcagttaaaccagtatctttgtctttgtcttcctttctttttctctttctttctttcttcttttttttgagacagggtctctctctgtcatccaggctagagtccagtggcacaaacacagcttactgcagccttgacctcctaggctcaagtgatcctcctgcctcagcctcccaagtagctgggaccacaggagcataccaccacacctggctaatttttttttaaatttcctgtagagatggggtcttaccatgttgcccaggctagtctcaaactcctgggctcaagccgccctcccacctcagcctcctgaagtgctgggattacaagcataagccacagtactcagcctttgttttccttttaatttttcatgtgatagttatcatctgacattagtggtatgcctactaatagcattttttaatttaaaactacattttataaatttgttgaaaatttatacacattctgctggaaaatttttgagatgttagtttatttaaattttataaattaagtctatcttattagtcaaatgttcagtcacctattggcctgggctgggagttgcttggtctcttaaagttgactttgattatttctaattagaacatagtatgataaatttattcattagatgcccacttattaagcactctctagatacaagatactgtccaagatacaaattaagttgggtcttaaaggatgaataagacttttgatcaataatgatagtgatgattacaataatagctagcattaaatgagcaattccttcatgtccaagccctatgcaaagtcatatctcatgttatacaacaacttgagaggtaggcacagaataatgtgaagatgctgatgttttactgatggcttctagtcctggctttatcacttactggtcatgtaaacctaacctgcccccctccccattttgaatatattgataggaacttcctcctggcactggtaggagaaataaatgagataatacagtctgatactatgtgctttgaatatggtaaacattcagtaaatgttagctgctatacttttctttattgtatagatgaaattgaagctcagagaagctaaataacttccctacatttaaaaagtggtgtgagcccagatttggactgagtcagtgtgactgcagagtctaggttctcaaccttgaaggattctaagaaagagtaccagtagatgcgagggcgtgcggggtgggaggaggccagtgctgaaaacacagctgagtgcatgcagggaaaggaggctgcattcagttccaggccatttgtgggggccttgggagaccttggaaagaaactgagatgttatcctggaaatcaatggaaaataacttgtttttcagttctttcgtatttaaatgaaacaagacatctctgcatttacctttgacttaaactgtcttctaaggtagtactatattttcagtcaagaaatatgaactagacattcaaatgggagactcctcaaagatttgggagattgcagaagatatctcataggcgctaaatactgaaaccctgtttttctttgtttgttttttaaaccacaatctggaatccaagcatacaactctgtcttctcactgctctggaattttttgattcaagcattctgatttcaactagcaaggttccactgggactataaggtgtataaaacctactaaggggactagagattttatatcctctagccagcctatcttctccttgctgggcaattgagggaagaagtcaaaccagagattgcttaggaaatgtgaaaccagaataagcatggagagtcatataattcaagcagggccaacttgctatgcacatgacctaagggttccatgcttataagaggcccatgcttggtttaatcctctactgtcatcatcttgaagtccttaacatttttagaacaaggtctagacattttcattatacactgggccccagaagttatgtactcagtcctagattcatgaatttgatgatattacgccatgatttttcatatgtctgtcaactatttcatagtatgtagatctctgttactgggacttcaggtttgttccttaatccagtggatcccttcaactgaacagtacctaaaatcgtcctgccagcaaatacacctctgacaccattctcctaactgtattaccatctgttatctcattgaaacaccacttctgtagcctgtttatctggtcatttaaatattgttctgggtgcatatttttaagttcactttgtgtatttataattagaacattacttttttaatagatgaactctctgagagaacccatgtttcctgattctttgagaagtgtttcatatgttacctacatgtaaataaaataagtattaagtttgaaatttacatgagagtgggattgtcagagccaactggatgatagaacagaaccaaaaccattttggtaggatagagaaatgtggttagaaagcaagcagtcatcagggtgataaaccagctgaatcctggcaaatatgctgttcaagaaatgatgaaaagaggactttggtgagagtcaaagacgcatgctcacagacacatttttatttttaacctgtcactgtcactggtcagatcctttctagagtttttaatccttggtaatttgaagaacaaggagatagtttacaggaatgcaacaaagatgattgatgactggatagtgggggattgtggaagaaaagctaaaatacataaaatgttattttttctggggaataaaaaaagtaactaatggaagcttagagtctttaagcacatgaaagtttttaaaatgagttttgtgagtagatttaccccgtgctagtaatggacatattatatgaaatttcaacataaagaattttcagaaaataatgatagacacttggattatgcagtcatcgaaatattaaaattttatttgtgcatatttttattgtaatagcttttatccatctgtatttgtttagaatatgaatgtgtgatttaaaaaccaaaggcccatcaatcaaaacacttcccacctgctctctcttaagggactatcaaagtagtaaattaaatgaaaccaacattgttttactacttgcccatcataaaatattactggttccaggtgagtgcctatttacaagagacctttgaagatttaataggggttttaagtgaatggaataccatgtaatgaaaaattttacatcataaacaaaattgaaaggtaaactggcaaaaaataaatttgcaaaaataaaagacaacttcagtatacttaaaataaaaagtacttatacatgttaataagaaacactaaaaacaaagtgaaaaagaagggcaaagagtatgaacagacactttactgaagaagtaaaaatagctcataaaaatattgtcaatatcacggtcaggcgcggtggctcacgcctgtaatcccagcacttcaggaggccgaggcaggcggatcatgaggtcaggagatggagaccatcctggctaacatggtgaaacccacctctactaaaaatacaaaaaattagccgggtgtggtggtgggcgcttgtagtcccagctactcaagaggctgatgcaggagaatggcgtgaacccaggaggtggagcttgcagtgagctgagatcttgctactgcactccagcctgggcgacagtgcgagactcagtctcaaaaaaaaaaaaaaggtatatatatatatgtgtgtatatatgtatatatgtatatatacgtatatatatagagagagagggagagagagagacagagtcaatgtcactagtaataattgaagtttaaacagcatataattttataggcaaaattagtaattattagaaataacacttagcattgggactatgcagagacaacctacactttcgtatgtctggaatgggagaatgctacaacatttacaagatggctgaatataatgtgaaatgttattcaaccatatgaattttctttatttgtctttatggattacaattagggaaagttgctcataagaaaaatagtaattgaaaatatcagaaacaaaattgtgtgttatgcattgtgaattgacatatatatgttaacatacacacacacagagagagagagagagagagagagagagagagagagagagagagagaaggctggagggaaagcaccagagtttaattcttttgaagttttgttcacttttttctctctgtaacacacaaacacactacagacacaatttgctggagggatctgggggagttatatcatcatatcttgcccctacacttttctttttgaacttggaaactataaacaccaaaagtggtaaagtacaaaagtggccattaggtctgggagtattagattgaggactggctttggaaacccagtattgccaatggtcacagcaacctagatttttgggtccagtcctaatttcaaaacttgtgttccgttatttgccgtaataattatgctcaacgtatttcactttttgatttagaaacaagtcatagttttatgtgcttatattttaggtgcttttggaaggccttttgtgctaaatttataaatctaaaactaactcgcaaagactgtctatgattagagacaagacccagaaagtcaactgttcccagaaaagaggtgccacaccacttatgacagtgaggagggagcgaggaccccagccttcttgtcttcgggccccagttagcgaggcatcattctatgttggtttaatacacccacaatcataattacaaatcttgacatttagatgctcccaaagtcagcacccatcccagcagggttagccatattatcactagttaaggagatatagagcaattagaagctaaaggaaaaggttagcacttccactcagacagaaggagttcagcagctaaacccacctgtagttgcagtgttaatttttttaaatatgggctttgaagccttgtcatccatgacaagggaggtctgagtctaaatggaatatttaagagaagtgcttcctcatcctccaatcaggctatatgctgacctttctgtagcctccaccagttgctcagctgtcatgaaatgctggagaaggtagaacatcattggacctgtcatgaggtcaatcagcgggagctcaggccaatttgctaaacgtgttcatgctaaagagtcagttccctaaccagtctggtgaaatgtagtaccaattaatcaccagctaattttcaggggattgtgaccttctccatatttgcagtccactcgctaccttacctggccttgggggatctctggcctggaatatgaggccacccccaggacatatgaagctgtcaaaacttgtgttataggctaccagggtgacaggccaggagacaggtatgcccattgcacctgctccggccagcactgacctattttagtcagaacattcagtgtggtttgcaaaccctaaagatattcatacagctcaagtatatgcaaaatccatcactttgaaatttttaatgatatagtaagatactgttttttctatcaacctatcagttctttatttgtctttagaaggtggtggctttgtcaccattctctgcagaggtttattatctgagagctgttgggttgtcttaaaagcagaaaggttccttttttttattttacaaaataggctgctctatttgtagccaagtctcataaattagaatacttgtcaaaataaatgaatagtatgtttgttatattcatgacttaaaatcacatttgattgcttactcattaatccacaaaattaagcaatacatgctggattgcagtcattagtacaaataagcagcgttcttctaacagtcagccatcgtagagaatactgtacagttgtgtttgtttcaaaactaggtctgttaatgcacaaattagttttacaatttcaaaataattcctctggaagaaaatcaaatacatatatgtagtccaccaggagacaaggttggaatcataatatactaagtagattttagatgtgtaaattgttaaatgcaattttgcattgaacctcaaggatggatggaagctattttgctgtgcataggaacgtatgtggcatgaaggtgacctttatccctaacaggatggaaaagtcaggagtagggagatggtgtccacaccaaagtgaagatacccatatggcagaggctttgttctcttgcttggatatagcagaaaatgtagatcattcatttacctaaggaattttttcccatgtgccaagaaacatacttgcagcttggaatataaagtcagttgtacttcagtttttttcatctgtaaaatgggaataacagtggatttatcataggatttcttatgagtatgaaataaaataatacatttcagcacttaatacagtgcctagcacatagtaagggctatataagtatttgataaatatttttattgatgtgacccatagttttaagtagcttactgttgacatataggtagggacaagtataccaaggaccctcgtgctatgtgacaagtgatgatacagtcatggatatagcactgtgggacactggagggcctggtgcagataattatggcagacttaaactttatttcaaaagtttgacaatgtatgatgaagaacttgaagctgggccaagaccacacccagatctgtttgctggaaagaccactttggcaatagtgttatggttaaatgtcaggaggccagattggaagtcagaagcaaacccaggcccttgccatgctctttgggcttatttaattgttggagaatgatctttgcagaaataaaccaaccttaggttccaataagttattgccttcaaggatttattgatatacctatggatggtggtggcagcattatgctttggctgagagattgccaaggagtatgtttctgagacgattctatctttgctttggctagagagaagaagttgtagggaaggagggaaaatgaaatggagctagttaaataatattgaatatggatgttacaatattgtaaatgtatgtagtgctttatactttagaaatattttccatatactattttatgtcttctagtgttggatatacttgcttcaaatagaatattctttaaaaaaagcaggtaagatgtgtgtaatttagttaagattaacttgaagaaaaactacttgtgtgtgtgtgtgtgtgtgtgtgtgtatgtgtgtccacacattttaaatatcccagcttgttttgtgtctccatttcctcccaagatagtcaaagcccttgagattggaaaaaattagtctatgtagctagtgatacattgggcaaatggcaagtgaggccacctagtagattgggatcatctttgagaatcttccagacagtttaactcaagttttttatttccacctttgcatgtgtctggttttttaaattatgcgcaattcatgggaagcaagaatgttattgacaaggcaggtatatagagtttttaaactttctgaaaatttgtgttattctgtgatgcttgaaacttctccctgcttttgttctggcttgctttttccatagttaatccctagatatctctaggagaagggcttcatggatgccacttgacctccatggcaccctttgccctaccactgctagagatggtgaagggcacagagacaagggctcctcaggcctcccctttgtgtattagatgtgagtcgtgaatgttgtttaatgaatcatgagtgattgtccctaaaagtaaataatacagcagacacaaattcaaaattctctccaacttgtcaagggataacatatcatctttgaaattttaattcaagtcagagaaaaaaatgtgattcaatataagatgggtttaatgtgtatctggcttctttaggaacatactacataatttcaaagaaataaatgtatatttggctgaaatatgggtggttatttaatagggcatatttttgttattatgggataattcaagcagatgcatctttaaaaagtgataaggataaatagggttttcagtacagttgaataagtcatgttattttcttcagaataatgcttaaagctgtaaagtttttaaaggttcctgttctgaattttcagtttggggaggaaatgaaaataggtttatctcatttactgactgtcagttgaactttatgagaatcagagctgttatgtccctgctttgaggatgctggagctgatgcttgcctctgatgaagatgctaatgtgagcctgctaatttttaaaatccggattaaatgcttttagctagctgtcaaaatcctgggaaggaagagaacgtactttgaaacctttgtttaaagtagcataaaaattagctcacatagccaattgttatttagttacaagcagatgcacacatacatttaaatgaaattctgcagtttcactcccttcccaaaggtgataatgtgattttctctacttgtgaaattgttgtaatttcacagtcttacttagatttaattgtgtttattaagatttgagacaaacgattccaattttattttataggatactgggtttttttttgtcttttaatttaacttgatagttggtaacacagaatatgtaggaaacagtaaaaaatatcaatacattgtttagttcaacagtttaacccaaagaactcaatgtggcaaataagcctttcttagtaagtagtacattagttcacttgacatgtaattaaaatagagccacatatttctcagtgtaatcactaataaaaatgccattataaatacagttgattttactctgtagcatttggatgattcttttttattttctacataggctaaagataatagcatcagattataaaaattcaggctataaaaatgacagaatgctacaggttggcaacagaataaaccacaccatgaatattgagagactctgcaataaatgtacttcatggcatttattgttaaaatatttacttgtcggcatagaagttgaaggcattggtatattgcttcaagttatggttggcaaagaccagacagcacaaaccatgtactgctaggcagaagagtgatagagtactgtattgtctaagggttgtgtgttcttgtatgatgaagaacaagaataaaggaaaaacagaaattacctattggttgtgtttgatcttggtactttttgtgttcctctgtcagtcctgtgatgaagagattaaagagaaacaacaaagtgaaagcaaaatacggataaacaagtcaagtgggactcagtctggaagccagagaaggatagctatggtaggaaaagaaattaaatttaacctttcattgtgtgccagcctctatgctcagcatttgggcatgttagggatattatcaaggaagttagtattctaccctattccttctcacccccaaaaacactcacatgttcacacacacttttactagtgatattgatcataataaccttagtgttttaggataaaaacagatctgagtcctggaagggatactgatggagtgaaattgcagagtacatggctctttttatcagatctgttattcagggtcatggatgttgtaaattatccaaagttcttttttattgtttttaaattttgctttaagttctgggatacatgtgcagaacgtgcaggtttgttacttaggtatacatgtgccatggcggtttgctatacctatcaacccatcatctaggcttttacctctgcatgcattaggtgtttgtcgtgatgctctccctcccctttcccgccactcccccgacaggccctggtgtgtgatgttcccctcactgtgtccatgtgttcccattattcagctgccacttatgagtgagaacatgcggtgtttggttttctgttcctgtgttagtttggtaaggatgatgatttccagcttcatctacatctctgcaaaggacatgaactcattcttttttatggctgcacagtattccattgtgtatatgtgccacattttctttatccagtctatcattgaagggcatttgggttgattccaagtctttgctattgtaaatagtgctgcaataaacatgcatcttcatgtgtctttatagtagaatgatttatattcctttgggtatgtacccagtaatggcattgctgggtcaaatggtatttctggttctagatccttgaggaattgccacactgtcttccacaatggtagaactaatttacactcccaccaacagtgtaaaagtgtttgtttgttgttcttgttgactttccttttctttttatctttacaaggtaaaggaatgagaaaaatatggaatgagtttctaaaataaggtttatggatatcactttttttctaggagaatcctagtttcagatgttcctttcagatcgcccctgggaacataggagtgaatgcatacagttaatgaagctagtgcctaatctttaaattgggaacaccagtcagccctggcaattaatatctacatattgaaaataattcacacataccacgttaatgtatttatttccatgtgttttcctaactcctgtttagaaggtagatatgttcctgtgaacctctttctctcaaacagggttacccaaatcatgagataaacatttcactttcctgatgccttaatcatgcaatcttttcatattgaaaagaagtacagaaagctgttagggtctaaaatgtgaaattttcacgactttgaaaataaagctggacacatcactgttgagcttatgacgtgcctcttcaggctgcatctccacttgctgtgaagttttattcacatttgtccttaagctactttaagggacacttttaaaaagctttacaatagataaatcaaagtggtgtattggcagatagctgggtgagggagtgcctgggacagactgcgaactccaccacctctccattcagcctgcatcctgcttcatccagtgaccaaatgggctgactccccgttttgaaagtgagcctgaaaaggaaagagaagatagataatctccagttttggagtatgatgtggcagaagcaatttcccccagtgttgaataaaaaaggaggaatttatcggccataatttccaaagccaaaccaacaataatgatgatgatgatacctagagcatcttaagattaaatatggatcatttatacacattcatttaattttttaaaaaaatatttgaatgtttattctaaaaacatgtgaaaaatctaggtgtcttttgttgttgtgttaggttttagtatctgtttgcctcatatttcactaatttttttcagcaaatttacattgagcacctatgatggcatattcactcttcgagccaatggggatacacaatcaataacaaactcagggttctcatggagcttacattctagtgaggtgcggagacaggcaataaaataagaagagctgtgatgctgacaggatgatacacatggtataaaataaaacaaaggcggagaatacagagagtaatgaagatgctgcaatttagtgtagccagagaaaggctggcatttgattaaagatctgaaagatcgaggaagaagccttgcaggtgcctggtggaagactgtttctggcagagagaacagcaagtgcaaagaccctgaggcaggtacaaagacaatagtgcagctggatggagtcctgagaacaaggggcgggatcagcagaacacgacgtcagaaatggaacaggagcaagtgaccttctgggccattgcagagacttaggcttttcttcaagtgaggtgggaaagtattaaaggagtctcatcagaggagacaggtgatccaattcatgctagcaaggtcagtctggctgctgtgttgcgcgcaggggaaagaggcagtgggtagaaacaagggaactagtcagggggctgttaagaaacacatggtagctgggtccaaagtggtgacactggaggtggtgagaagtggtcaaatagagtgtatgggagacagagcaagaggggagagaaagagagttgaaggattgctacaaggtgtttggcctgagcaacttagaaggatgaattgccattaattgggatgtaaagagctatggaaagagctttgaaaggtcactttttccatttttgacatgttagattaggaaatgagcctggagttatagaaggtctgggttgcaccacttaaaattttgaatttatcagccgatagagttatattaacccatgaaacagatgatatcactaaacaaatttagacatatgctcttcaacatttttagagactaaatgtggaagatgacgaagaaaaaccaaaagaaaacttgatgggggcccagagaaataagggtataccaagagactggtgccctggaatccaagtgcagaaagtactttgagaaggcagtaatcacctgtgtcctgaagtaaagccagagaagcacctttggatttaggaatctagagattatttttgaccttgataagagcagtttcagtggagttgaggggtgagagcctgactagagtggcttcattaaagaatgggaggagagatactggaaactgctgtgtagacagcactttcaaatttttgctttagaggggaggcaaaaaatggggtgggacctgtggtaagtggatcctgagaaggtcattggtttgtttgatgggagaacttctagcatattcatagactgaccttcctgtgtctatctggggattagatgcttaaatactgacagagatcttgtgggaacaggagttttgactggaagtaaagattgtgtaaacagatcattttggattatggggtctcctggaaatgccagcactgcagtaggtggcatgaggacactggcatcatagaaggagactggagggcagaccagaaggagagagaaggcagcagaggaggaatcatccaatccaacattgcctgtttgtattgtgtagggtgtgggttactgcagcccctgaggtgtcagtggaagttcttctgcatgccatacaagtttactctaagcgaaaccttaacacaaaagctttttaaatagaattccttctttcatgttcagcgcatctctgtgggaaagataactttgaatgggtttaaaggcaaggagggaaggccatttccatgcactagattctttaaaaaccagcatgcattctgttgagggactagaacagtggtttatgttaattaatgagtctctgtaacactgtcttctggggagtctgctaccgaggaatgtaggtgttcagatgactgaagtaatttagttaacaaggacctgcaacatatgatttaaaccagttatcaatgttgaaacaagcattaagtctgtgtatattgtagatgttgagatgaagactggatgcagagtctctgttcagcaagcaaccatgggagccatgacaggtcaggagctggtcctcttcttcccaggagtacagactttttcatccattcaccataactaggtgctaattgggaaacagtctaagcaattgattttaatcaaagagcttatgagatttggggagcatcaggtcttactattatcatcttcaagaaaagttacgttttgcctgtgtctccaaaaagtggaattcacattctttagggtataacacgctaatggacaaattacagacagtagacagtcttcattgtagcctctctttttacagctttctttttggaaaacagctacagtataggaaaatactttctctggattgaaaattaaaaagactagattccactaccagctaccatttagtcagtgaccttgggaaacaaaacttcggagctactctgttctaccatttgataaataggtataatattcttactgcatacactgtattcttatgtggataaaatgtatggaaaacagcaaagtatcttaagaaaaaatatttatcttacgagttatcacttttaagcttttgtattatacttctagttgatgttctattttttctcgtttttccagtatttaaggcacatgggttatactgagttaaggatatcatatgaaagaagagtaagatataacttagcttacactaaactgttcatagtaccaatataatatgccattgcctagttgattggtatgttaaatgttaaaatgaacattactaatatatgttagaattaatgaatacacaaaattgaagttattatataacagaaatagtgatgaaaatcacacatccaccacattaaaaagttgatttcattttccttttcaagatttaaagtgttaaactcattctggctggatgatgagaaagatatcgttctactgatttttttatactagaataatctttcattattattaatatatttaagtcttatctccaataagttcatcagtgctaccagttacaaatagaaaatgcatgtgctcaatttcaagaattaaaaataatgccttgggagtagcatttcttttctgtggcaagaggattgttggattttccaattaaagaagtctccatactggaaatgagtagtcagttatgaaaattatttttgaatggcgaatttgcatatccttaattgtattcatttcttttgaaagatcgaacttgaaatttatgatgttttgattggttaaccctgcatttctgttattaataatattgccaacagggttcccctatgactggggctctgagtgtctttcctgaataaatgcttgaatcataagtaggtttgttttacttaatgaatagaaaatatctaaagatgtactgctggttttcacatttacacacattgcactttttggaatgacagtagcatcctgtagctgcctcatttactcacatttggacttttctacatcagctgatgagaaacccttgaagtttctgaatgttggtgctgtctgttggccaaaagtgcagtttcagcagagccgtcgtcactgtctatacagtagtgtctgtgtgattacttgaatttttaaagataccttgcccttattttaaggaaaaaatgacttggaaatgaacaatttagagtttttatattaacagtaaaaagcatagttctcacgtaaaataagattgacatataattagattaaaagtaaggatgtcgagtcttattggacttagcattccattggacttaaaccagtcaacacagagtcagtcatgaaggaaaagaacaaaattaaaggcatgtacaaaaatgggatacctatttatgcaagatcagcacaaattgtatataagtattcacacaatgtatgtatgtatatatgtatgtagagtgtatctacagggacagatacaattaggcatcttgtaatgtgttttaggtctccgagactggaataacctccctatactatttaagtctattattcaatgcatattcaactttcatttttggaagcactctttaataaagagttaatgaagtcattttaggcattttagggaaggtggggtagtgggaaggggaagcagccatttcattcctttaagagagtgggccaaaattggttctatttttcagtaatagacaaaataaacaaatgaataaaccagtatttattatttcttgaccatggtgcttatagacataatattattgaaaaattaagagttgtggtatagtaacattaacattttaagtttgatgaggcgattttctttgcaaccaaataaagatcacgttcagctagatagtgtccgtgtggtatgcatgtcctacaaagtaattagtgttgttggatttgtttgtagctgattgctgtgtttgaagaacaagaaccactccacaagattgagagccccagtggaaaccctgcagatcggcagagcccagatgcttttgagacagaagtggccgcccaactggccgcatttaagccaattggtggggagattgaagtaaccccttctgctctaaaactaggtatgtgtaatgtttatgatattcttttcacctgactgaagatccgtcatcttgttgattaggcattgtttcttctttgtgactttcatcctgttaatattttatatcgtggtttatcttttctttaaattatttttttacatagctctttgcagccactgctgcttgggtaagtggatgcagctttttcttgaactgaaggtgaagcagaattgtatgccctcgaagtaacacgggggagtcagatgctaaatgatgaagtttgcctgtatcatatgagtataactttttaaaaaattcctgaaaaaaactcatttgggaaaagccaaggtttatcaaagaatccatgctagaaataaaggtcactttattttcttagcctcagtctttttctgcccaaactataatctcagaatctgggggaaatgttttgaagttagttttgaaattcttttctgatgatttattcagacaagacaattcatccagtaattttgcttagaaatatttttcattatatttgtagaatgagaaagtaaatattattctaaagtttcaatcagtttacaactccaagagaaataacatgtctgttttggtgatacctcctaaagataaatttagctcaatttaactgcatgaagtttttgaaaatccactaatatcttggtatttcaaacaactttttatgcctgtggaatgtttgtgcaacattttgagactacttagagcacctgttatgagggaattctcaagctagaagaacagaggcttattccactttgcaaaggtcagcttcttattctttttaaagcaaaacatatgcttaaaatggttagaatcgtacatagtactcattttcccatttgaaataaaatatatactgtaaagttaaatttacatactctaatgctgacaatccatattttgtactgatttttggaaaagcatctgtagtgccccttttaaaataaaccaaatggaaattaatgacctatggtctaagtgggttttcctgtatcttttggaaccgagctagtgaagcagtctgctggaacgtggctgctggagggctttgtggcagcttctcttcatctggagccagccttgtggcttcagcaaccttacagccccatcattcatttgcataatggatgcctttttatccattatgcaaatggtatgagaggaaaattaggcaataagggaagacgaaaggagaaaattgctcttgcttattttaatattctatttataagcaagcactgtggtcttcaaatggccgaacctcagagtacttctgtgccggagaatttgttttcacctctctcttatgagctttgtcagggaaaaaagattgttttcttcagcttttttgttggaatattgaaacaacataatatcgaatgcaagaaaaaaaagtcagccgagattccccttctttgaaagtgtggactgtctacttcttccatatgatttttgataagtcagagaaaacaatatttattacatgagtacacaccatctaaatcccttactcataataactcatttatttaagcctcgtcatacttaattagtcggcttttattatttttatcgtttaagagttgaggaataggtacagagaagtttagtaactcagcagaaatcccatagctattaggtggcagagccagaatttgaactgttgctggctgtggtgtgagaaaccattttgctgtgctgcctctgacatgcaattcctaaaacaaccaactaatataactgtcttggggtttactttgagaatatatgccaaaaccctgaaaatactaaactccttggtctacaatctcatttcacttagtaccagattaaatgatgagactagctcactgttaggtgggaaacattcccttccaaccatttggcctgaaaccttggcatcacctccagttccaccgtttccttctacctcccccactctgtcagctattcagcttccttgtccacagccaccacagcaggccagagctttgccatcaattagactattgcagaggcctcagactgacctctttctttacactgtgtgctttctccagtccctactgttgccagagctgcctttctaaatcacaaatctgattatgtaatataactcccctgcttaacgaccttcactggcttcccatcaccctgagaaccatatctaaactcgttagcaagctgatgcagatggttcctctgaatcagcaggagaaatttgggcaaggatgaatgacgtaaaaaaatcatcccttacccactttcatggttctagcagtttgagtactttgcatttctggaacttaaaaagcaaagaaaaaacatatttgtcaggtttttcagatagcgaagttaaagaaggaagcaacacagccagctttggtctccacccattctgttttcctgttgttggctccggggcaggatgtggccataggctgtgcacctccagatggagagatgtggttggcagtagaggcagtattgatggcacttctgggagtgtgacctggctgtcctgtctggtccaccctgaaagcctgcttaggtgaagaatgggaggggcggtgagaggagttttgcagcacctgtgccccagcagttcctcctaacagggtgctcatgaaatgtcagccattgaacccaggcccttcatctcccttccccagtcagctagtgtagccattggaactggttgtacttttcacagctcattcacccaacctggtacaagagaaatagggcttaattttttactggttttctcactcttaaggccactttcttaagaaaatagcaaatttaatcttcattggcttacattgcttttcttaattaagcagacacaattcaacaaatattaggaatcaagagatttttgtgattacatcacattgagcacccaaaatttatgtttttctggaatctgatatcaaaatatactcagtgttcagtataatttttatatttctttttccaacacaagataaccatcaacaatattctgttaaaaaccaacaaccaccttctccatgtaatgcatacagaggttgactcctcccattctttctttatcttccaggatgtaatacttatgcatgcatattcatattcccaggcccttcatgatctagctgcttcctctctgcccacctttattgctggccagtctttcacagtcaccttaacttgcagccactgtgaaccacttgccattccaaatttaccaccttcaaacctctgtgcctttgcagatactgttctctttagctggctcattcctttgtctctttactgtatagtgaactcatatgcaccttttaagttcaagctcaaatatgaccttcttcatgaagccttgtccaaatctttaaaacagtacagtaggcttacagtaagtattatttcttaattcttcatctaacaatcaagggttacaaagacgaacagcagaaatctactgacataaaggggttcatagtctcatgccctataagctgatggggtatatatttttaattcgtaagatgagttttaaatcaagtgggcaaccacataattccaacctcattcatctaaattatttcctatcatttattttctaatggattttctaatgtaatgctgaatgactgaaccctggggattcagccctaagtagcaaatcactttcacactttaagattctgtggctctgaaatcagccaaagcatgttaccatatagtacagagattgctggcctgagagttcatttaaatgatgagatgtggtaaccaaaatcccaggcgaaattggaaagaatcatattcacatgatctatttggacttaaaaatttatagttcgagaattttccaagtcttctctgtgaaaccccatggttcttctgagcatgtattagggtttcaatggatgcttgattctagttaataaataacatttattgagcgcttaagttctagatgctatttaaatttgttcattctccatctttggacaaataggattggttatgctagtgtggaagaaagggtgaagaagtctagaaagtagccaataaacagaatcccaatgcttatctaccccaaaacctcacctccactcaaaagatgtatgcatgcctcagaaaaacgtttgtgaaatgctgacctagaaatatgcagttccacagaattttataattagcaattgtgtaggtaatcgatattattttacaaatgagcaaataaaagttaaaattcaatgtgtactctgatgttgaataaggaactagaactggaacccacatttcttggcttctagaacagtgcttgttcagttgcatgactttttaaaaattaattgtagatttcaattatccatatattttaggtactatatgtgatagcacctcacatccttttggaattgagtagagtgtaaattaataaatagatactatgaataggtataaatcaaaagctactgagagaacaagaccaggaaatggaggtggagaaaatgtcttttaaatcctatacatttcagaaatgagtttgcttctgtcttcttatcttctcatcccgtgtgtgtgtgtgtgtgtttgtatgtgtaggaaagttccactaaaaccaatatactaatgggatccatagatgtggggttttttttaataacgtggatattttaatagactttctgattttttaagtatgtacatatagggccatctgtaaaaaagacaaattagtgaggaaaattattttgaagtttaggagggtgggagtctcccggtccttcccctgactagtccctacactgccttcatgattagtacctgaccacctactgttccataagaggctttttgtggccatagatcaaggttggcccaacccaatctttgtcccttgagagtcagtgatatggagctagttctagaccctgcagtatttgatctagctgtgtgatcaggataagtcatttaacctatctctatcagaaccaactttttccaaacaaaaaataaatcaggacaaatttgggacacattctagcaaagtaaaaattgaaaaccaaggctatccaggtcactccctgatgtgtcaccaccatatctccctgggccacagtttcctcatctataaaataagctgtcctttctccaatgggccatgatggttccttgagtgttttattaataccaagctgagtttgaatccaactccatgcctctgccaatttccctgctatggccccaattaattagtagttttttattttgtaccttttgataatttttttcagtacttcttgattgaaatttgctaatttgggttcaagctttcatgggaaaatatttatttagttaaattattttagcaatgtaatttaaatagtttttcaggataaaaagtactttaaacttggctgttaccatgcttgtgatctagattaccttgatataaagtaatctaagtttggagttgaagtggtattagctttattctcctcttgtgtgttaaactttgaagatgagctactttctatttgaaagtgattcttgtttttgagacttgaaagctgaaaggtgcctcagatgctttattgtttccatgtgtgtttgtgattcttcaaaaccgaaatggaaattatgattatgtgtttgttataatatcattattttcaaaacactgagttctctttctttgcagtggtgttcagcaaatactgtgtagctatagattcctgttgaaaattgtgaccattttctatctgattttgactaatttactgcataaaggaaacatatgggaacatttttctcaatttttaagcaaaccaaatccctttatggcgctgatcttcaggaaaacgtaaagaaaggggaagtttattcctttaattaggctgctgtgtgtaagtagctgctgtgcccataatgtgagtttaagtattggcatctgatcctagacaaacacactcacaccacacacatagcagaactaaagctcagggatgggttatgcttctgatgaagcctttgaattctgactacaaagcatataagcatgtgagggttccttgttgttggaagctctttgctgtaggctgtgaaacccagagttaaaattacccagagttaaaattgcgtagatgaattcataagttacaatttggtcattgagtttcatcctgtttgtttcctgttgaggctgattattcaaaagttagcagttatagaatagtttttctttctttttttttcctttccttccctgggagtctgttttttttttccccctccatgaaggcttaaatgaataatgttgtaattagctatggtaaccttgctagggtgtcatcaatcagtcatagccatatagtcaacaaagtgtgtgcttgctttctggtgtgactataactaaatcaggactaaggaggctatagtgtttctaacccattttgagcaccactcttttgctactgttgttttgttttaatttttttttttttttttttgtagcaatgggtcttgctatgttgctcaggctgatcatgaactcctggcctcaagcagtcctcttcctcagcctcccaaagcatgagccaccacgccttggctgttttgatttttattttagattttgttttcagagtagtgaaaaagtagctctgtggaagaatgtcacgttattcattgaatatttaaaattaatactttgtaaaagggccagtggtactagttaaagaataaagtcaatacctaaagacaagtagcccctaaaaaatattaaaaggtaattaccatatgggagtaatttttgtttgtattgagtaaaactatgagcaatattttaaatatacaattttgaatatgcctggcattacctccttttgcagatgaatatatataggcctcatagttgatcacttcctaccattttgttaaaataaaatgatgaagtttgcttgagaacatgctatagttttataaatgcattttaaatgagatattacttattaaaattatatagtgttacacttcagaaaaataaaaattaccaccatcctaacagaacttgtattttcatttttttgttttatattcagttaacttttgtattttagtcttatttcaattttctttttttttctacctgcttcagttacccttttgtctctttaattttgtgtgctatatctgatggctaagtttagcagttaaatttatactaagttggttgtactcaaataaaatagaaaattattaaaaggaatttacatgtaaccatttaaccaaaaatataagacagtacataaaaccaagctctcatttttgtcctttttccagctgtattttctaagttgattatgtgacctctaaaaaaacagagttcaccatctcccctttggcctcttaccaatgctggacccacactgagacggagtctgcagatcctctaataaacaaacggaatgaaaggtcacctttcctaccattcacttgatattagacccctgggtttttaagcctcttttgcagattgcttttaatagtaagtccagtgaagtcatgtttgcagaggcctagtccctaagtagtaaaaatattttcagcactgctgtcatattcagcttcttgtagttcccctgaccactgataaaatgatttgcagtttgtccttttaataaaggggaggaaaaaaaccaagccatgcacctctggcctcttccccatgcccccaccagtaaaaccaccatcgtcctcccttgcagccagtccccagctcgctctcttctgtttcaggcactctgaggcagccgaaacacagccacacagaattgccctctgttctctaaatacaagtactgcttttcacagcctaataaggtttaacatgtctattacaaaatgcctttaaattacttatctgtattaaaaaatttgttgaagttatgactcagattttttatttatacatattcatctttgtggccatgaaatagattacattttctcacaaatttctaatcattcctaaataaattatttatagtaaccatgctgattttcttttgcagtttgcaattcaggaatcttgttaacaatttaatatatggtaaagccctttttgtactgacaatgtaaatgtaatgtttagcctttaagattttttttttctctctgagtgtgtatgtgtgattttttaaaattttctttccacccagatgggcaggcaaaaaaaaaaaaaatccactaatttaattatttacagaagatccatcttaaggacaagtcactcagagttggacacgctttcgtgactggctcaggattttctcatttgctttatctgataaagccttatgatgaattatgccccaatatatacacatttggttatttactttttctgtatcttatttgaaattttgctaagatctttatttggcccagtgaaagtaggaaatactgaaacagcttgatctgttcattctcacaccccaaagtgataaggaaaggtgacagcctttgcttagcagtgaccataagagaagccatctctattttgcttaccccttttttgttaaatgtttaccagataaaagacaaagacctcccagatatcaccaccacaccctgtcaatttatctttgaaacaatgtattcatcatatgatacacagaaaacggtgctcattctgtttattcattggcttaatgggaaaatgttgatcgctatcagaaaataccagtaactttctaaaaatatcagaataaattctgattactaatctgtataaatatgagactgtctgccagattcttcaaacatctttacagatggaagaaatttggaactttggggggttttggtgtgtaaaattagaggaaaggaaattatgtggtacatcttattttctttattttctttttgtttatatggaagacttgactatggttatgtaatgtatgtttgtagaatacggtgtgatcggggaaaatgggtaggcttattaccttatcacaacctatttaaaatcataacacttatatttggtgttttaagataatatttactaaaataagccgtaacttcaatgtccattttgttttaaactgttggaaagaaagttgtttttatatttttttatactatttggcctaaaacatggcatagatagcaacaaactgaatggccttgtgtcatttggttctgtataattgtgatgatcaattaaacttactagtgtttttaaaacaaatagactttttaccccagagatctgaaagcatgaggaaaacttcttgttttagtcacagttcagggataatgtcctttgacctcaagactttagcttggtgttacagtgaactgcccttacggcagagttcagcatttgctcagctaacatctgctctttttagatgattggtcttaacgatacagttatgaaaatcagtatatcaagtgtcaatgccagagaaaatggtggcatgcctgtcactcccttcagttaatcaataattatttattgataacccagtagattaaaagcattgtgctaggctaccaaaggaatataaaataatacacatcacagattcattcccaagtagcttgcaatcaagttgacttaaaataaattactggatgagtctcttaacttggctaggattccaagccaagttatatatttttatcatatataacgattgttctaatattatggggtacacagttatcaaaccttatactgaagatcttacctcataataaattcagatgctcacagactcttcatgtgtaccattagtcagtatgtgatgtttcccatagcttggttaattgcttgtcttttactttggtcttcagttgatggggaggttcaaggtattcataaaattttaactttttagtctttgattcgacagtcttcattgactcactagtttggccaactttaattttatcttctattaagcaattaaaaataactaaggtctcaagtctctccatgactaccaacaatgtccgctactccccggacacgatctgcaaggacctaatgggttggtggataaatgtctatgcatccatccatccatccttctccctgaagacactccagtcagatgtactcttttaacggtaggtggttaatatagagacaagccttctacccaaatgagttcagcaggtgcactgtttagaagaatgtgttgtgcctagtctggacgtacttcttacctccttgtgttattttttcactgagtactgtgtaaattactgattggaaacccattgatgatcttttctctaaagctgtaggctgtacctcagactaatttattagcatgctattgagtggtttaagcaaatttcattttcagtccctctattctgacacaaaataccattttccagttgaatgtcaaaatagtgtaaacataattgccctatatgtaaacttatctgtgttaaggggtgaattgagaaggagcaacttggccatcttggaaaatggtctttgagaagtttggagaatgcatttagtgtctttttctcttttcagacaattcattacctttaaaaacttaaatttatttaaagtaccttccttgactgccttgttgccctgtttttaaaaaataatgtttagcatttgtttgatagttgccacaaacttgatgctgtaatattctgactttataataaggtgaagagttatgcgaggttaggcaaaattttcatctctaattcgtctcttgttaaaattaggcttttatcttagtacccaaaatattgtactttatatcttctctgatatcttgatgaagcaagtaggcaatggaatgtttccaaaagaaataaggatggagaaatacatagattatacaatcttacatatttacagcagtgtagtgtagaaattaagagcacaagccctggagcaagcctgcctgggtcaaatatggcactgcaacttacaagctgcatgattttcggcaagttacttaagccactgagtctgtttcctcacctataaaacaagggtaatattacctaattggatagtgacctaattggatagtcgcaagcagtgaatgaattcatacatatatgtacatgtaaaacacagagaatactgtctgccacataataggtggtatataaatctgctagtcactgttaatttcattattatatttattatggatcatttggaggaaaaaataaaaaaactccatgtatttaggtaattgattttttttttttttttttttttgagatggagtcttgctatgtggcccaggttggagtgcagtggtgtgatctcagctcactgcaacctccacccctggactctagcaattcttctacctcagcctcctgagtagctgggactagaggtgcgggccatcacacccagctaattttcgtattttttttagtagagacggggtttcaccgtgttggtcaggctggtctcgaactcctgacctcaagtgatccacccacctctgcctcccaaagtgctgggattacaggggtgagccagtcccacctagccatgcaactgatattttgatctggtcttttgttatccctttattccactttcaactttcaacccataagatcatgttctctctttttcacgaatttagattctggttgtcttatgccttctcctaaaccataaaattaaattttggtttttctctcttcagacttataagttaaatgctaaaatggcttattgaagccaaaacagtagccagggacattaatcagaatagtataattaccacaaaggtttcaaataatgccttcgtgcttgtttttagagattcatagaagggtaattgctttgatcttttttatcttcaactcaagtatttacttttatgtcctcacccttaactcggcatatggttcacaagaattttcttttacaattggtaagtgcatgctgtctatgtttgacagtccatttttacagggaataggaatttgtttttaatgttgttctcctccctcaactgacccagaacactgtattagccagggtgccaacaggaaacggcatactcaaaggtgtgtttagagagaatttcaaataaaaagattataggtatttcagaaaatgagacacccatgttctgaaaagaatagggagccttggtaggccgggcgcggtggctcacgcctgtaatcccagcactctgggaggcctaggcgggtggatcacgaggtcaggagatcgagaccatcctggctaacacggtgaaaccccgtctccgctaaaaatacaaaaaaaaattctctgggcatggtggcgggcgcctgtagtcccagctactcgggaggctgaggcaggagaatggcgtgagcccgggaggcggagcttgcagtgagccgagatggcgccactgcactccagcctgggtgacagagcgagactccggctcaaaaaaaaaaaaaaaaaaaaaaagaatagggagcctttaccagctaaggcctgaaaggggaaagaggagaaaattcttacatatctgatgagggctccagatgttggggagaggcccttagaggatcaaaatctgcaacctatggatggcaagtgcagccactttcaaagctgaagctggcagagagagaacagaacagataaacaccccaagattcctctcttcctacccactggtctcctgctgatccttcctgatggctacattcaaaaggcagccagagggaaaatggtcttcagaaggcactgagccactgaattagagcagcctccagggggccagaacagggcatagaagactggggagtggcattggagagagtaaccaacacaaacatctagtctgtgtgtctctgaggtgagatttttctacagcgctgttttttattaaaattatatagtgttacacagatcaataatgcttttaaaattagccaacagataattattaatgtctattaggcatggagtatctctattggaatataaaaattagtaaaatgcagtttttccctcaaggtgttcacaattctgtgcaacagttctcaccccttttctatttgtattcagacataacatgggtgttattaataaacacaatatgtcagtagggcagtagtcatctttttgtgatattcatgtgcacaaaagttgtacctacctttaggtaatattcctgttttggtgactataattccaccaactttattgctcagtaaagcacatcagctttcagcttgcaaaagtggattgaatgcacttcttttttgcctcctcctttcccaacattcataaaaatgacagattttggctgtgcatggtgtctcatgcctgtaatcctagcattctgggaggctgaagtgggaggatcacctgaggtcaggagtttgagaccagcttggccaacatggcaaaactctgtctctactaaaaatataaaaatattagccaggcatggtggtgggcacctgtaatcccagctactcaggaggctaaggcaagagaattgcttgaaccagggaggcagaagttgcagtgaacagagatcacaccactgcactccagcctggagagacaaaatgagaccctggcctcaaaaaaaaaaaaaaaaaaaaagacagttttaatgtaaaaataaaggaggtggagttagatggataaaatcactggaaatgaatacaaaaaattagccgggcgtggtggcgggcgcctttagtcccacctacttgggaggctgaggcaggagaatggcgtgaacctgggaggcggagcttgcagtgagccgagattgcaccactgcagtccagcctaggcgacagagcgagactctgtctcaaaaaaaaaaaaaatcactggaaatgggaggagaaaatggagagtaaataaaatcagatcaacagatgattcaatctttagactgccctagagtaaaggctgggatgaaggcgggcaaccagcctgtctgtctgccttctgtgtgtgcttttaagacgagacctgccaatgaacatgctttatcatgtcaaccacctaattcagtggagagtttatttcaggaaagacccatatattggcaggaacaactgaagctatttgttgttaatcaactgaataagaatatgaatatactcattcatttatattcaggaatatgaatggacagccactactcaccagacaatatatggaaaacaacaagtcaaagataaggacagtgtagaattgacaagacagtcttgaagaatagcaaagcttaccttaacagatatgtataaaggtatagaaactgattcagtgtaattttggcacaagaacagaacaatggagtagaatagaaattatagcaatagcccctcacagatataatcatttggcttacatcatatttggtattgctggtcaattcaatatctatatagaaaaaaatttaatatccctacctcacactatatacaaaaatcagtgctagacagattatagatctaaaggtaaattaataacaaaacaagcaaaaaacaatgagagacaatgtataagactatcttcataactttggtgttaggcttgtttctaaaacagaacacaaaaagtgatagccatgggaaaaattttgataaattgggttatgtgcaataaagaacttctgttcattaaaagactgaaaagaaaagccatagattctatgaagaaattttaacacatctgtctgacaaaggatagtgtacaggatacataaataactcctaaaagtcataagaggaaagcatcctgctcaatagaaaaataggaaagaaccctaacaggcacttcataaaatggccagtagatttatataaaggtgttcaacttcatcaatcgtgacagaaaagcacattaaaaccacattgcaaatttcagcaacaaaataaacaatgtagtatttgtttataacccaacatataaagtaaatttgcatgagcccatactgatataagtgattgtttgagtaaataaaactagtagtgcttagaggtaagggtaggagttgacaaatctttctagtagaattccaaataatatatatagatagtactttcaccttgagtatgggatgaacttgatgacttacttccaaagaataggatactgaaaaagaaaatgagtgaatccacagtagagaaacctggcaagcactgtttgaaccaagtgatcaagattattatctccaggcataattcagctgataccatgtagtctgaaaatgatgtgatgagcagggcatttcacctcaatggtattcttcctccaaatccatacccccaggctaatcatgagaagaacatcaaacaagcccaaattgaggaacattttacaaaatacctgacaagtcctcttcacaaagtcaaggtcatgaacaacaaggaaagattgaaaaactgttccagaccagaagagactgagaagacttgatgactaaatacagtatggtatcctaaactggatcctggaacagaaaaggtcattcgtggaaaagctggtgaaatccaaaggaaatctgtagccttgttaatagtaatgtataaatgttaaattagttttgacatacataccatagttacataagatgttaacataggggaaactcgattctttttatactatctttgcaagttataaattaattcaaaaggaaaagttggttaatacaaggccactataaattcatcagaaattactaaaatgaaagaataccagctcttggtgagcctgtgaagtaactaaacctcatacattgttggaaaactgtttgagtatccactgaaattgaaactgtacatgtcctatgactctgccatttcagtcctaggtaacctaggtaattctcaacagaaacgagcgtgtatattcactgaaaaaaaaatagaacagcatccctattcatatcaatctcaaattggaaacaacctaaatgtccatctttggtaaaataataaactgtggtgtatgcatacaatggaatactttacaacagtgagattaaactattacaatagcaatagcaagaaaaacccttagaataatttcataaaatagaaggtgtaaggagttaattccctctttcccagtggggcaatatacatctgccttaagttggtgggccaagcatatgtggctataaaaaaattaaaatgacaatctaaaattcatgcattaagcaaatatttattggacacttaactatctaccaggcacttttgtaggtgctgggaatgtagcagtaaacaacaaaaagattaaaactttctattctcatttagtttatacactagtgtgagaagacagtaaccataataaatgagatttttatatagtatgttagaaactgataaaaagttttgggagaacactaaaacatggtcaggagagtagggtgtctgatgacaagaacgaggagtctaatgttaaacagggtggcatttgaggaaaactggaagggagttggggagtgagtagtgcagattggttagaggagagaggaagggaattttgagaaaaattcttcatcttttttagcagggagtctatcaatgctatttaaagttcaaaaaaatcaagacattgtgtgtgtgtatgtacacacacacatatatatgtatataaatcttggagttatgtaaccaccaaaaaagtcaaaaatagaagtgctacaaaaagacaacttctggtaagttgagcctgtcagtgaaagggagacttttattttttatttttatatttccttccttctgcaaggtttgaattgttttgaaaatcacattttaaatggtcacattaggacacaagtaggccaggaaggagtgacattattaggtagagaaccttgaaaccactgtaattatatcttgaaaagataaatcatttgcacaatttagtgcttattattgatgaggaatttcttgtaagattgctgtcagctgcttcaaggagctactcaccctgttttctccaactcacagacgaccaagttctgtggatcaggcatgggtgtggcctagaccagctcagagcacagctgcaaagtctccccagatcctccccaagttaagcacacaagtacaggggcttggccacatgctgcagccaccagttcacactgattctgatagctctctttcttgccccactaatccacataacaatatgttgtccatattgctttgcagcatcgtgaaagtgctgactcatgtttcacaccagtaccaactcactctaacactcacaatctttcagctcaagctaaaagattttaattaggtatatggtgacacaaaacaagtgttctaattaaatttttgaaatgagtaaggaactgtaacattgcccctagataatggataaaagttcagtattaaatagactgcatgtactcacgcttaaattggtatagatgtaaaaaagaattagtcattgtatctgataaaaagtaatctattttatgaatttgtagtatactctgtagagcttgtcttttttgtctgattttacttgaggggaatatttcaaattgcatatatctgaaaggagaacgaatataattacctaaatctagaacaactaaaaatacttcagctaaagtatacaaataattggagtgctttttgtcttggttttctcggattatctggatgattgcctccattttctacctgatttagtgctttctacctgattgagtatttttcaggaggttgttactgctgttttcttagctcggtgacctgaagcattgattctgtgaactgttggtatagccaatgcagtttgggttgtccaactggtaattgggcctgataatttgcagacattatgtaggagtttctttatttggtagtttcattctcaaaaaaattggtgttattaagccttgagtaaatatagttgttaactctgcattgtggtcctaaccaacttataacaactgacatttatgaaggttccaaccgaggctttaataaacaatgcatccaaaaatgtaagcatggtggctgtggggggagtcgggagaggaaggggggaggagagaagtcagtttaaggaaagttagaaaaaaaagacaacatttgatattaaatttaatgtatttagttgagaattaagaggaaacagttcagcctgtgtggaggaaatcttcatgcattttattacctgtgaaggagttaaaaatataccaacctgccatattgactattgaagttaaagggcacttgaaaaacaccaggtgcaaaaagatgactctgaccttcgttccgtttcttaaaagcagaagatgaaattcccatgtgaaagatgccctccatatacttgcaagacacaacatccttatccttaggatcagaagttgtaaccaagagaatttagtatagacattgtaaaataactcttttaagcctctccacataacatagttgcattttcacagcttactattatttgtccaattcagtatataagtaactgactctaaccccttctttgggtcttcgtttccttatgagggctcctgtgcatataaaacttgtattgaagttgtatgtcagtacccgtcccctcctctgtatggaccttccttgtcgcctctctaaaaagaaaaaaaaatatgcatttctcctgttcatctgttttatatctatctaattctcagatccagccaaatactaagagaatagaggtggagttttgccttccctgcatctataaaacatctaaatcaaaattatatatatatttaatatatgataaaattttcacagtaatttcatggtcaaattagcaaaagaattaataaaatatacatttctctttaaaaggtctcaacttacattattggacaaatactagtaaattgctgtctgtaatagtcaagatttttcaatcttctcaatagtcagttgagactaatcaaaatagtttttacgtgtagtttggatgtggaaatgctaccactttatcactgaaattgctggagtttcatattgaaggtggaatgcacttaaaatggggtaacacacaagggaaaatttggcaaaatgatttcatggagtttcagatttaggccagtgatagccagggcccttaggagaagtagatgtttcccttttgtatttaatatgaataacattaatattaaaataaatgtatgtgtattcctttgtattcacaaaggaatgttattggatgtgtgagttgtcagttattctgggagatgtttaattcagtagcaggaaatggagcggccctggaatttgtaggaggggctttctcctctttgaggagccagatgtcatggttaggaggagaagggccatttttgcattgcatgtgtgagactggaatccccattttcacccactttaggcacttagatatgggattaatggtgcagatccatcaactaagagccctgtgtgaataccgagcttaagtctggcagaaggaatgtgaagcagtcctggaataatcatcaggaaagaattactgctcacctttgttccactgcccacccccccgcaccccaccccagatgacttcaaggtatcttaattcagcaagtgttcaagcaagtcattcagtacagccccagctctcacaaaatcttctctaccacgtttggcacgtctaataatgattataggcattgctacaaattcaatggtaatattgtaggctaccaggttagagacctctctaacttagtctgtctctttctcttctttccatttctcctcctttttcttccccttttccttcccccacttctttccttacatcctccttccttccctcctgcctgttttttccctccctttaactatctctctctactttccttccttgaacaattaaaggaatgcattaaagcccaaacaacaaaactgattaactcttaatgcttatctttctgaggaatgataatctatatgaacttgacaccaagactaaaagcttaagtggttgagtggatactaccaatatcaaaggggagaatgtcttctgtggaagataaatatttcaaaattggctatatcagaatgtgtgaggccataagctccaggaaacatacagttctaacacttttctggaaaaacaaagaggagaaaatgtcataatgtttatgttcttgccatgcaccacacacatgaacgtggctggaatttgaccaaatggacagagggtcttactgaaaccgaactgagcatctgccgccctgacttcttcagtggcagagggcccacctcagccacagttgttatatgtgaaaagccactggaaagaagtggagacaattgatgaagccccgtgtaccaagctggtttcatatggggggaagatctggtgagggttggggtgatgtgtacagaatagacaaaggagaaggggagaaacatctggattgtattgaaaaaggcttagctaggcgtggtggctcacatctgtaatcccagcactttaggaggccgaggtgggtggattgcctgagctcaggagctcgagaccagcctggcaacatggtgaaaccccgtctctactaaaaatacaaaaagttagccgggcgtgatggcaggcgcctgtagccccagctactcaggaggctgaggcaggagaattgcttgaatccgggaggtggagcttgcagtgagccgagatagtgccattgcattccagcctggacaacagagcgagactctgtctccaaaaaaaaaaaaaaaaaaaaaaaaagagcttatctgggcccatatgctagggactttcttgggtatggcagatctctgtcatcttttgattggatccctttacttcacttagacctgtgtgtcacctttgctgactgcaaggaaagctcagggcctgccagtatgtaacccaacagttgtatcaaaagcacatagggcataacaatatccaagtaagtttctgaattatccttcttcaaaacatgtctatacgactatgaagtgttatcgacagagcatatcaaccctaaactgtgatttgtctcagcaatggcagttactgatttgtaataatcagtactttacctagtttaaatcataatctctccttgagctcttaaatccacttttgtaatccatcaaactaaatgtaaatccctcagatggtgacatccaacaactagttattgtctttagccagtttatatttttaacgtacgcaattaatactatatatgcctgttagcattccaagatgatttttagatttcacagatgaggattgttcagagtttctcagtcttttctgtgaagtttaaaaaatctctttggcaaaaattcctaatgtgatagcagctagaagagtaattttcattggaatgaccttttcgatgggtaatttgacagacgcttgatggacagcattcttccatctctcagcccaccttttacgtcctgccataaaacgctggagcaaaattttacctcagctgataagattctcaatagtcatgtgttgcatatctccctcagagcagttcctcaaattttgaaagctgtctttctttttgaggtatttttcattaccaggagaaaatgtttcttttagggagatattctaaaacaatagcacaggtactgaacaaacttcccaagtgtctaagggactctctcgtgtggctgtatagtattggtttggtgtattaaatggcactctcatgtactataagagttaacacaacttccaaaggtgcctttcctcacaataagagaacagatttgactttggaaaaaaaatgtgactatgaagtacccagttaaaataccctaaaagaaaaaaatgaaagcacttactggtaaaatgaagacaatcaacttgcaaataaatgtgtttttaagatgtggccctggggtgacatgcaaattcaaaagactaatattttctctgggaataaaacattttggaagatattttatcttgaattctgaaaatattgccagaatagaatgcttgttgattgataaaatatgtgctttcatgaagaatatttcttatggtattacctttgtcaaagaaaagattctgtagtttggggagataaattataaagatgatacatacttatttgtgtatgtgtttgtctgtcttctctttctagaaggtatgttgatgaactcagatcatcatctcttttgtccactgttgtatctgtagtccctggcacaatgcctggtgtgtagtggtcagtcaataattatttgctgaatgaatgcataaacaaatcaaattaacaaattaaactctagattttcatcttcttcagaattttttttttcagtgttccaagactaaggacttttcattgtctttcaagttgggatcttaatcttatttactgcttttcatacaacaaacgtgttaaacatgtatcagaaaaaattagaaacattatctgtgattcttatatagggaggtgatttcattccattagctttttggggggaattcatgggtttgtcactctgttaatccagctgacaagcagaatccaaagggtgacagttagaaggctggaagggaaagggattgttgatgtggaaatgaaaaatagacttcagggaaagaggtagttagatgaaaatatggcaaaagagagagagagagaaacacctagagtccagtgggggtcatcacattgcaggaggaggatgagggcatgaagggggtccttggagaagttctggagagaaaaaagctgagacaaaaaggagatgaagttatggtcaagccagagaagacattggattagcactgcatgcatgataaaccagccatgctactagtataattctgacattttggaaatattgaaatcctacatgaagaataaatggtgtctgtattttctcagacaatgaatttgttcaaaacaattgaactcatggacatagagagtagaagaatggttaccagaggctgagaaggtagtggggggcatgtggaggacaggtggggatggttaatggtataaaaaatagaatgaataagacatagaatgactatgacacacaacatggtgactatagtcaataataatgtaattgtacatttcaaaataactaaaagattgtaattgtttgtaacacaaaggataaatacttgagggggtggataccccattctccatgatgtgcttatttcatattacatacctgtatcaaaacatctcatgtactccataaatatatatacctattgtgtacccacaataattaaaaataaaaataaatgaatttgtgacctaaataagtatgcatgacagaaaaagagaactttgttcaaaaattttagatttggaaattgttcttcatatcatactcctgaactgacttagtttccactcacatttaaaataactgaaaaagagaaatgagagaaatttacaagaaatggtgtgcccatattatagggtgacagttaaatgctgtccacgccctgacaccacacacccaaagaagattagatctatttaacaatgaaaagaatggactgctacaaaaagaaatacgttcatctctttgttcttgcattaaatgagaaatatttatcaggtactgttcatgttctaggcactgggtggtaaacctccagcagtgcacaagatagcagtggtctttgctgtcaccaagtgtactgcctagtataggaagtaatcacaaaaacagtttaaatgtaatgttaaggggggtacaggctacagtcagcactcagggcagtgtccctttacctaagaaaggagctggggagggtaagttcaaggacgatttttcaaaggaagtgagggattgaccaggcaagtggaaatggaaagaatatttctaggattgcatgctcaggaaaaagaaaaaagccaagtatgactgccataaggaatgtaaggtagggaaaaattgggagagaagtatggtgagatttttctggaaaccaggatggaaccagaactggaagcacttacatagccaaggtaaggagccaggacattttactagaggccagcgaaaggatttatttttaaattaaatattgaatttgagagttttctaaaactgtggtatgtatgaagagaagcaacgcagtgagcacccatgtaactaacacctgatttgagaaactgggctgtcattatctttgaagtcccctctgtaccccttgctaattccatctatttcacttttctgtggaataatcattcctttgcttttctttataattttaccatgaattttcatatctctatggagttcattgtttagttttgtgtgattttgagctttataaatggaagtatactgaaaattttttctgtacctttttctccttaatattgcactcctaaggagtatcatgttgttgaatgtagcccattatccattcatttcattgcagtatagtttccttttttaaaaaaatggatatttgcattatttccaggtttttgctcttacatgcagcataactataaaccaccttcttcacatagtcaatgaacatataacaattttctctaggtaaatatacttagaatgaaattgtttgtttatagaatatattacttttgaaatatattagataatgccaaattgcttcccacagtaattttactaattctttaaactactaaatgtaaaatagaattccagtttttacatggtcagcaaaacaatatagctagattttaaattttcgccaattttatggatatgaaatatttcattgtgattgagctcaagcatattttaatgtaattattgaccattcagatttactcttctgtgatgttcctggtaagatttttgacaatttttttactcattgatttgcaggaactctttaaaaacatttttttttttttactgataataattgtacgtatttttggagtacatgtgatatttgatatatgcatacaatgcataatgatcacttcaggattattagcgtatcacctcaaacatatcatgtttctttgtgttgggaacattttgaatattctcttttagctatcttgaaatatacaacaaattattgttaactatagtcaccgtaccatgctgttgaacactagaactaattgtatgttgatacccattaacaaacctttctttctccctcccactttccagactctagtaactatcattctactctctgattcacaggaattatttacatattaagaacactaataatttgtagattgtatctgtctgtgtgtgtatgtgtgtgtgtgtatgctacaaatatcttgccccagttaatgacttgtcttctcttcctgtatgttttttgatgaccaggaattgttgattttaatagagtcaacatttttatgtttgaatattttgtatcttatttaagaaatctttccctacctaaagccatagagagactcttctactttatataaaagtttcataattttgtctgtttaaaagtttactttacataggataactttttattttagcatatggtgtgagataggggtacagcttttccaccatacacgtgatcaattgtcaggcatcatttattataaagcctgtcatttctctacaggaacacacagctattataattctgtgaaattcaaatgtcttagtatttctgtgtctgcttctggatgctctaaactatttcagttgtcattctttttttttttttattatacttatataagttttagggtacatgtgcacattgtgcaggttagttacatatgtatacatgtgccatgctggtgcgctgcacccactaacgcatcatctagcattaggtatatctcccaatgctatccctcccccctccccccaacccaccacagtccccagagtgtgatattccccttcctgtgtccatgtgatctcattgttcaattcccacctatgagtgagaatatgcggtgtttggttttttgttcttgcgatagtttactgagaatgatgttttccaatttcatccatgtccctacaaaggacatgaactcatcattttttatggctgcatagtattccatggtgtatatgtgccacattttcttaatccagtctatcattgttggacatttggcttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctccagcacctgtggtttcctgactttttaatgattgccattctaactggtgtgagatggtatctcatagtggttttgatttgcatttctctgatggccagtgatgatgagcattttttcatgcgttttttggctgcataaatgtcttcttttgagacgtgtctgttcatgtccttcacccactttttgatggggttgtttgtttttttcttgtaaatttgttggagttcattgtagattctggatattagccctttgtcagatgagtaggttgcaaaaattttctcccatgttgtaggttgcctgtttactctgatggtagtttcttttgctgtgcagaagctctttagtttaattagatcccatttgtcaattttggcttttgttgccattgcttttggtgttttggacatgaagtctttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatacggaatcctttccccattgcttgtttttctcaggtttgtcaaagatcagatagttgtaggtacgtggcgttatttctgagggctctgttctgttccattgatctatatctctgttttggtaccagtaccatgctgttttggttactgtagccttgtagtatagtttgaagtcaagtagtgtgatgcctccagctttgttcttttggcttaggattgccttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcccatcccttgtaagttggattcctaggtattttattctctttgaagcaattgtgaatgggagttcactcatgatttggctctctgtttgtctgttggtgctgtataagaatgcctgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtctgtcatagatagctcttattattttgaaatacgtcccatcaatgcctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgccgctggattcgttttgccagtattttattgaggatttttgcatcaatgtttatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattatcgccacaatttcagctcctgttattggtctattcagagattcaacttcttcctggtttagtcttgggagattgtatgtgtcgaggaatgtattcatttcttctagattttctagtttatttgcgtagaggtgtttgtagtattctctgatggtagtttgtatttctgtgggatcggtggtgatatcccctttatcattttttattgcatctatttgattcatctctctttttttctttattagtcttgctagcggtctatcaattttgttgatcctttcaaaaaaccagctcctggattcattaattttttgaagggttttttgtgtctctatttccttcagttctgctctgattttagttattgcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttgtgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactctgtatctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgtttaatccgagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagaatttagttcatttatatttaaagttaatattgttatgtgtgaatttgatcctgtcattatgatgttagctggtgattttgctcattagttgatgcagtttcttcctagtctcaatggtctttacattttggcatgattttgcagtggctgatactggttgttcctttccatgtttagcgcttccttcaggagctcttttagggcaggccttgtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccactgttagtctgatgggcttccctttgagggtaacccgacctttctctctgactgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtaaatttggtcttttcacatagtcccatatttcttggaggctttgctcatttctttttattcttttttctctaaacttcccttctcgcttcatttcattcatttcatcttccattgctgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtggatgtcctttctggttgttagttttccttctaacagacaggaccctcagctgcaggtctgttggaataccctcccgtgtgaggtgtcagtgtgcccctgctggggggtgcctcccagttaggctgctcaggggtcaggggtcagggacccacttgaggaggcagtgtgccggttctcagatctccagctgcgtgctgggagaaccactgctctcttcaaagctgtcagacagggccatttaagtctgcagaggttactgctgtctttttgtttgtctgtgccctgcccccagaggtggagcctacagaggcaggcaggcctccttgagttgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctccgagccaggtgtgggatatagtctcgtggtgcgccgttttttaagccggtctgaaaagcgcaatattcgggtgggagtgacccgattttccaggtgcgtccgtcacccctttctttgactcgaaaagggaactccctgaccccttgcgcttcccaggtgaggcaatgcctcgccctgcttcggctcgcacatggtgcgcgcacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccctcctcagttgtcattctttcaattcttgtaattccataccctaactttataatactccgtgatatctgtcagggtaggttcctgtgttgttcacagccaagaatggtcaggctgttcttggccctttgttcttccactttaattttagaactggccggttaaatttcagaagcagaaacctatgagattttgattgggattgaattgaatttgtagattagtttggagagaattggcattcttacaatactgagtcttcacatgaatgaacatgctatatcttctctgcatttatttacaacttctttattgcccttcagtaagggttgatgatctcttcataaagtttttgtacctatttggatctattcctaagtacctgatattttgatgctattataaagaaagttactaaaatgttttgtttctgtttgtcactggcttagagaaattcagttgatttttttaagccagaaagtattctttagactttcgtggacactaataatttaactgagtctcttttaggggttttacacaattatgtcatctatgattgactattcttttcaaattattttatttttttactaattcttatacttgtccttcttgcattactacacttagagctccagtgttggatagaatgagtgatagctgattttgttcataatcttaatgaagactagttcatgtttttagttttgctatacatttatagatatataattattttatattaatttatacttgtatacacatctttaaatattataaaatatttacagtaatgtagatatttattatttatatacttaatatttttatttgttatatatagtgagtgtatgtgtatatatatatatgtgcatatatacacatataatcaatattgaaaagttgagtcagctcttattttcttattaaggttatgaataagatgacttgttgccaccaattctgttcagtactggagatcttaacatagtaaggcaagaaagacaaatataagaattagagaagacacggggaggggaacatcacacaccagggcctgtcatggggtgggatctaggagagggatagcattaggggaaatacctaatgtagatgatgggttggtgggtgcagcaaaccaccatggcatgtgtatacctatgtaacaaacatgcacattctgcacatgtatcccagaacttaaagtatatatatatatatatatatatatatatatatatatatatatatatgtgtgtgtgtgtgtgtatatatgtgtgtgtatatatgtatatatgtgtatatatatgtatatatgtgtatatatatgtgtgtgtatatatatgtgtatattatatatgtatatatatgtgtatataatatatgtatatatatgtgtatatatatatgtgtgtgtatatatatgtgtgtatatatatataaagaattagagaagaaatgaaaaactttttttttaggttaaggaagtttcttttaatttctaatcactaaaagtttttgatataaaggaatgttaaattctactaaacatttttccatatccactgaggtggttaaatgtttttcgcttttcatctattaatatgatatattgtattgattgagtaattatagtttcgcagtgttgccaggctagagtgcaatggcgcgatctcggctcactgcaacttctgacaccctggttcaagtgattctcctgcctcagcctcccgagtagctggggttacaggcatgcgccaacacgcccagctgatttttgtattttcagtagagacaaggtttcagtgtgctggacaggatggtcttgatctcctgacttcgtgatccaaagtgctgggattacaggcgtgaggcaccatgcctggctgattttttaaaatttaaattaaactggcacttctagagtaatctcaaactggcaataaagtgtaatcttttttatgcatcgctgggttcagtttgctaatgctttcttactttttttttttttgccaatattttcttcaggatgtctgtatctgtttttaagatcatcctataatttccaattgttgaactgcaaacttcttttcaaccctaaaatccaatggtcctataattcattatcgttgtcatcatcatttacctcattgctacaaaagcactaaggaaagaaaggagatggaaggaatgactcgttttgccttgttaaatggaagtatatttaaaatgtgatactctcttaagaatgatttttttaaaacatttacttagaatttccatggtttcatactgtctgaaattaattcatgaaacctttttctatgagtctcactaacttgctatagaatgtaccaagaaactatttaaaattgaattctgagctttgaacatgttctttttcagtttcacctgataccagttccaagcgcacccaatcttttctatccactggagatgagaacgttttccctgtgatgtttaaacttaattccagagccacaatcccactgataatcattgtccttttctcctatacattaaagtggtcttcttaattgctataatattcacaaggagcctattggaactggagtactctcagatgaagaacagtattgtaggtgataaagataaagtggtattgagaactacccaatttacttcagtgaattcaatctttcttaggaagcaagtggtacctgatatatttacctgaacttttggagtgataaggaaaatgtttggcatgcattcaggaccagagaaactttaaaggtttatctcagcaaaatagtattggaaaaatgatctatttacttatacgatacaagggtatttccagttctttgattctgggggtttgcagaattgttaccaatgagaaatataaggagtgttcaagtcacagggtttttttttttttatcgtgctccttttgcctgtgtggaagagtcatgcatctgttggggtatactgaacaggcagctttgtggcctactcctgaaacttttactggaatattattatataaaacacagactgaccaaggcagataccacatgctagaagagttctgggtagtacaacattaacaatattccctttcctatggtaatgggtgcagtggtgcacagcttgatttgctacattaggcttgttaaattatgttttcagtgtggccacggccttgtgttttctactgagtgagcctgctcaggtgtcacacataaaatctgttgctgatatttattgagtgtgtgtagtggttgggggacgagataaggttagagaaataacctttcttagttctggtttttattagatttccctaaaaattccatgtttgttatattatgttccatgtatgcctgaatatatggcacagtcacataaaaagcaatcccccattttcccaatgagaatacaacccttttaaggagatagatgaaatatccaaacgtctactcaagtttaattgattaacttactaagatatacattttataatcatatgcaaactttatttgagaaatgttgatcttttccatgctcacattttacaggttcattttattcaaacttatcacatgggttgttgatatgaatgccttcctatcatgggagcaattttttttagagtttcaaactgatttcctgagtacatcgtccctacttccatccatattgcttgagacactgaacttcttaaatctgtgcaaggtactgtcactagaagttttatcctgagacatgctttgcataacattagggccttagggttttttggtttgtttctgttttgttttgtcttttggttttgcaggtagaagcctgtaactttgactttactgtattgcttttacgaggtgttttttgtttgtttgtttgtttgttttttagacagagttttgctctttttgcccaggctgaatgcaatggtgctatcttggctcactgcaacctctgcctcccaggttcaagtgattctcctgcctcagcctccctagtagctgggattacaggtgcctgcaaccacacctggctaattttcatatttttagtagagatggggtttcaccatgttggccaggctggtctcgaactcctgacctcaggtgatctgctcacctcggcctcccaaaatgctggaaatacaggcgtgagccactgcacccagcctgcaatgctctttcagtggatagccaatactttcaattgctagaacccactctagggatcctaactctttctttggttcttttattactaattattcatcatttgtgttggaataggctgaacccctgtatcttggtaaccaaatacaacagcatttatttccttttcatacagagcccttacatatcctgatggctctccagaacaatagctttactgggagactctgacccagtgtgacaggcaccgtcagctgaagctgcaccgtccagaatacctggccttcctggttggcacgtgagagtgataaacctgggtggtctcaaacaggcagttaaaaactttgaagcagcacatactgcttttgctgttcactcattgatcagaacacatcagtggaaatggcagggaggcgtaatgtgctcctcccatgtgccaggtggcagaaaactccttgtagggcaaacaccacacggttgcacaatacccagcacttgcactggtggaaagttgttccaggctgatgtgcgccttatgacaacagtagagagcagctccacgatgagagaagctttttagtgttgaggactacattggagacgatgctgtcacctaatatatctcatacatggtattgaatgaagaaaaggagaagtagaaatacactgaaatttaattgggctcctttatggattaaatttaggaagaaatcttgagaatttccccctaaacaaaaatatatttactccattccctaatataagtagctacgattaacattcatatgacacatgtgagtagtttaaaaacccaactgcctgtcaattcccttaaagcttgtcaatagtcatgtggtagatagcatttatagggtgacagtgtatgtttctagcctaccagccaagcaagtcataaataagttttggccgtctctcaaacagccctgtttcatccccttgtagactgttaactacatttaaaaagtaaagtctaaagctttaaataggtcacattctggctctgacatttcagacagaccacatcattgaatggtgccagaccctgtgctggctttccttaatatttctttaagatgaaatctgtcctattcccacccctacccagcttcctctgcgactgacatctttacctggaggaaaacatttcattttcccaagtccaaattatatgcttcatttttcacagagtcatccttgtctcctctctgctgtcctgaagcagtgccttttctgcatcctggtaggctcaaccacttcttatctctgaccacatctacctcaacagctccagagcagcctccatcctctcgcgctctgatgtcctcctgcctgctcttctgcctccaccctgcctgctccacagcctattcttaacttgcaacaagagtccctcttcaaaatagccatcagatcaggtctttcccctgcttcatatcatctagtggctccccctttcattcagaggaaaagccacatttcttacaatgggcggattatttttctgttgatgccataagaaattaccacaaactcagtgacttcgtatgaatttattgtcttacatttctggagtctcgccggggtaatgcactcctcccatgtgctgggtgggagaaaactccttgtagggcaaacaccacaaggctgcacaacacccagcacttgcactggtcgaaggttgttccaggctgatgtggagcttaacaaggacttaacaagactgagttccttgctagaagctctggcagagaatctggctttttccagtgtgtagagaccacctgcattccttggctcctggtccccttccatcttcaaagccggcaatggccgtccggtctttattgtgctgtgccatttcgacattgactgcctttcctccctcttcacttttataggggaccttgtgattacattggactgagccatttagataatccaggacagtcttcctctgctaaggtcagctgctaagcaaccttatttcttctacttgcgatcttaatttctccataataggttcacaggttccagcaattaggagatggacttttttggggggcattgggggtggttattctgcctagcagggtacaaggccttcatgatctagcctgttacttctctgacctcatgccctactactttttcttacaaagtagggcttccccctgatggtgtcaccacctcagagacccatggagctaattatctcgtgacctttaagcctttgctcaaaagtcgccttctcagtaagctctgttctgaccactttactgaattgtagcccacagtctgctttgtgtttttccatagcacgtatccacatctaacataggaaacagtttatttttatgtttgttgtctgtaacataagctcttgcagagctcagatttctgtctgtttttcctctgttgtatcaccagcaccttgaatagtgtctggcacatagtaggcaaacaataaatatttgtggaataatggacagattcttgagagaatggcaaactgttttttaataaacataatttttttgtgtgcatcagatcttccgcatgcctccaagaggggcatgatatggtttgttttggggtcttccaaggtatttagtttgggaattggtttgttgtagacactcagaatacaccaaaaagaattacaaagtggggtctggggcagggaggcatgaagactttttcattttatcagtttagactggattccagaaacaaagttaaggagagtttgaggcagtttcataatcagtgtaattcaggatccaggctaggttgacaaggcaatggaagagtgcctgtattcttattcagagttggggtatcactatactgcttcttgaaattaccccctccaggtctttagccctgaaggctctttgttcttgtctcatagaggaaactagggaagagaatatctaatcactcagtgcattgtcagtgcagatgatgagaaatatcctgtatattctagcctgtgctcctgcttccgcaagaatttttctccctctgagtaaatgatttgaagagtgaggatttagaagaccaggtattattttttttagaaaaataaggttttgttataaaaataaatgaaatctatattttatcatttcaattcaggccctaagcatacacagtagttacctttcataaaacgttcttgcaataatgctattgcactgggctttgtaatgaagctttgatttgcatcgctattctgagaactttctgacaatggtaaggtaatattaggaaggcagaggaaatgaaatgaaatgagggtaatgtatgtccattgtgaaaaatgttaagttgccaaggcaatgtcatatcaataatattttcataaattaaattaagatacatggggcaaataaatattgcatttctctttattatcacttcaaatatgtgagggcaactattaggattaaaaccagaaattagacataaagcatctcagctgaaatgagagatgtgctattcgttggttcaacctgatgtgctctcaagattcttgtcacgtttgtttcagtctttcaatctctccccctcagtatactctagcagtccctctgctgtcctcctctctcatactctgtttcttgagacagaatttctgttgagaattagtaggagagtcagtataattccattaagcatcactttcatactccacaaccaaccttctagttttaaattctgttcttttaaatcaagctggttttcctatctttttctctcctgcttcctccctgtctcatcccctcccttcctaattcaccacctcactcccttgccctgtcttcctcccctttgctccctcttctcctctctagtatacacacacacacatatacacacagagagaaagtatacacacatgtacacaaaaagtatatacacacatatatacagcaagagaaaataatataagtgtgaagtatggatttaatccaaagtttgttacactgggaaagtgaggatgaagaaagctgaaggtggttggtatgaaagaatttgagtcctcattttccattattgggaagacaaaatatgatgtcccaaattgagaaataagtattaaaagggcacaagttttctatttaaaaatagagaggtcagcaccagaagaaacaaccaaaagaattgtgaataattgtctagagactagaaattagaactgtggctactcttttctcatcaagcctttcagatagtactgaacttcttaaggtttgtatacttttattgataaaatttaaaaaatttgacaaaaaggaatggattaagagatgcaaggcaaacagaaagagtattgatatttatatggtgaaggtaatgtaggtttaaaaatacaaagtataaaaaagcagaatgttagctaataaaaggtaaaattaataacccccaccaaaaataaaaaacaacaacttaatgattttgatcttgtgtgtgtcaaaaaacatatcatgttttaaaattattgtcttttattacaataattttgggggtacaggtggtttttgattacatagataagtcctttaatggtgatttttgaaattttagcacaaccatcacttgagcagtgtacactgcactcaatgtgtagtctgttgtctctcaccctcctcctaacttccccgcactgagtccccgaagttcattatattagtcttaggcctttgcatcgtcatagcttagctcccatttagaagtgagaacatatgatatttggttttccattcctgagttacttcacttagaataatgccctccagctccatccaagttgctgcaaatgacattatttcattccttttttatggctgagtagtattccacggtgtatatataccacattgtttttatccactcattggtcaatggacactttaggttggttccgtatctttgcagttgcaaattgtgctgctgtaaacgtgtgtatatgtgcctttttcatgtaatgatttattttcctttgggtagatactaagtagtgagattgctggattaaatggtagatctacttttgtatccttaagaaatctccatgctattttccatagttgtactaatttacatttccaccagcaatgtaaaagcatccccttttcactatatccacaccaacatctattgttttttgactttttaataatggccattcttgcagaagtaaggtggaatctcatagtggttttaatttttgcatttctctgatgattagtgatgttgggcattttttcatatgtttattggctgtttgtatatctttttttgagaaatgtctattcatgtcctttgcccactttttgatgggattatttgttttcttcttgctgatttgtctgagttccttgtagattctgccttctactcctttgtcagatgcatagtttgcgaatattttctccaactccatgggttgtctgtttactctgctgattgtttattttgctgtgcagaagctttttagttttattaggtcccacttatttatttatttatttgttacattcgcttttgggatcttagttttgaattctttgtctaaaccaatgtccagaagcattttccgacgttatcttctagaatttttatggttttatgtcttagatttaagtatttgattcacctaatattgttaggctttgtgttctaacccgaatctcatcttgaattctaatccccataatccccacgtgttgagggtgggacctggtgattggatcatggaggcagtttccctcatgctgttctcatgatagtgagtgagttcttgtgaaatctgatggttttataagcatctggtatttcccctgcttgctcttctccttcctgccaccttgtgaagaaagtgcctgcttccccttcaccttccaccgtgattgtaagttttctggggcctcaccagccatgctgaactgtgattcaattaaacctctttcctttatgtattacccagtctcaagcagttctttataggagtgtgaaaatggactaatacgccatcttgagtttatttttggataggatgagagatggcgatccagattcattcttctacatgtggcttgccagttttcccagtaccatttattgaatagggtgtcttttccccaatttatgtttttgtatgctttactggctgtgagtttttggctttatttctggattctctattctgttccactggtctatgtgcctgtttttataccactaccgtgctgttttggtgagtatagccttgtagtgtaattggaagtcagataatgacttcagatttggatgcctccagatttgttcttttgacttagtattgcttcagctatgtgagctcttttttggttctatgtaacttttagggttgtttttctagttctgtgaagaatgatgctggcattttgatgggaattgcattgaatctgtagattgctttgggcagtatgatctcatttttaccatattgattctctcatccatgaacatgggatgttattccatttgtttcaacgaaatctatgattttttttagaagtgtttaattgttttccttgtagatatcttttacctccttggttaaatacactcctgggtattttatatttttggagctgttgcaaaaaagattgagttcctggtttgattctcagcttggttgttgttggtgtatagcagtatagcactttattttttttgatacatgagaagagcttcaataacaaaaacaaaaactaaaagaagagtggaagaaagagtggtgcctctttaaaccattgctgatcctagattttttttaagggatgagatttggttccacatttggtgcatatcatagtgtgtcaggaaaaaattttcttatccaacttggggcatgtttttctggaagttgagctttaaataatgcatagtcgtgataaaggattgccacactgttttacaggcacaaataatctttttttttttttttaattgaaaggagtagacttttcacttaaaaaccaactcttctaataggaaagttttaggcttcctttaacataactattttattgaagtgatgaatttcccttctgtactttcaaaacaaatttgtttgttttcctttaaatggaaaaaaatgtgcctttcactgccctcaacaacgttgacctttgacattaatataatacttaagaaatgtattttagcccagttcttcctttctgccttccacttgattgctctactattagatttataatgctgaacaataaatgcaattcagctttatgtatctctagactaaataaactgagagataaaaccgagatagaaaacctaagaatctttaagtatagaacagggcaaaaagtctttctctagtaaatcaattaaagacttgacaggatagatgttaggagaagttagaatatttgtttatgataatattctacatacattatttcatgtgatggatataacagtcctcattttagagatgacaatctgtgtgtcaaagaggctaagtgatttccaagatattgcagcttcagagtagcctacacagataagttacagtcaaaaatcaagtacatgagaagagtctcagaaatgaaaattaccatccaggctacactgtgactaatcataataaaataggaattaagagggaaaaataaactttacaaatattaagtgaaataaaagatagtgcccggcatgtagtaagggtacaaatatttgctaaatgtatttatatgaagcaaattaaacaaatttatgcaataccttatttttgtattatatgattaattctgctttgtaactttttaaggaaattgagacatttgggatatttatagtaactaaaataacataaaattggtatcatctaaatatttaacattctgagctgactagagttcgaaatgttttgtgaaaaattccaagatattttctagaaaaaattaattgatattgagtcttagagtatattgagtagagaaaaacataccaagaaagtatgttaatcacatttctgtttaaaaatagaattttatagtgtacacaccagccgggcatggtggctcatgcctgtaatcccagcactttgggaggcagaggcgggtggatcacaaggtcaggagatcgagaccatcctggctaacacagtgaaaccctgtctctactaaaaatacaaaaaattagccgggcatggtggcgggcgcctgtagtcccagcttctcgggaggctgaggcaggagaatggcgtgaacccgggaggcggagctttcagtgagccgagattgcgccactgcactccagcctgggccacagagcgagactccgtctcaaaaaaaaaaaaaaaaatagtgtacacaccaacatattaataagttgtgcttatgtttttagttatgggtcataggttattgtaacatcttttttgttccttttggttaccagtactttgacttttcctatgacaagtacatattatctaaaaattacctgttaagttttttaaaaagtgatggaaagatgtggaatttgaatgttgatccttaagttcagattaaatatgtttcagtatttagccaggcattgtgctaaactctttacaatggtatctcacctgttcttcacttcaacccatgaggtagatattatttgttttcattttatagagaaacagaaaactaaggtgctctctctcatatttgaaagcttgactttagtgaaccaatatagtaatatttttccaagcaggcaattttaaacaacaatactgttaacaagctgaaaagaaatactgagagagagaaggagtggagagagtcgggggagatcagttccttcattatactttttttttgaagttaagtaattgatacatattaatacaaatgtttaatttaaaatttcccacagaaataccaacatgtccacaatatagtcaagcatgtcagttcaccagctgctgcttttccctgtagtcatccctccttgcagcctctgtgcatgaactcctctttcaatctgtgttatttgccctcaagatctatgcacagctgcaatactgaaaattccttttacctttctcttgggctgcgttctctttattgagatttcatagtttctcatttctggtttagtccctcattttcatgaagctgacttctcagtagctttctaagaaagattacatgagagcaaacactttctgagaccttttatttctaagaaatttttcactctaccatcacacttgatttatagtttggctgcatatataattctaggctagaaatctatttgcttctgaatcttgaatcgattgcattgctattttgtagcccccagtatggcttttgagaagtatgcttctattctctttttacattccagacatggatttttttttctctgtggaaacttttagcatcctctatttatccctaaagttctgaaaattcagagtggtgtgctttatcaagtctatatattttcagtgtggttatatatgatattttacctttgtcttcaatatttaatatcagcacttaaatcctcttcacattgtctgttacttccagattttttctactgattattttggccttttattttaaagggtttcctcatttatctgttatcctcagctgtatgtttatatttaagaaggatccccttaaaaagctgattgcggctctctggtgtatggggtttagtggtggaaggtatcccctaagctggtagcaccattaggctaattggatagagatcctgcctattcactcttggctggtagatgttgttatccactggccgtgtattgattatctgcagattatatataacttagcagcttaaaatgacaaacatttattacctcatacagatgattactgtcaggaatgcaggcatggcttagcttggtgattctggctcggggtttcccaagagtctgtagccaagctgtcatctcaaggatgggtcagagggctcactcctcagctcacatgtgtgggtgctggcagtcctaatttcctcaggttgtcagtatgtccctagggctgcttgggacatggcagctgcatcccctcagaacaagtgactcgagagagaaattaagaggggcatgctctaaagacagaagtgcagttttataacctaatctcagaatggacataccagtacttctttctgtcatattttattcatcgcacagaccaaccttggtgcactgtaggaaggaactacatagtgtaaatccaggcagtggggcttgctaggtggccgtcttggagacaggctgccatggacttcttttctcaattattttccgcagagaaagactcctctccatgtgccttacctgaagatttaagcctgggtgacagtgtttagggaacctagcttggaaataaagaaggggtctcaccattcagtatttgactcttccttagttttctgggttttttttttttacaaccatgcatcacactcagcctctgcagttatgcctggcatcatttagatcagaattggtcagcctacccagaaaatgcaactctgatttgtacaaggaggagagaagagaatgggcagtctctggagcacagactgaggaatggaaatgggccaaggcctcgttgggcattttacaggctttctacccatcctcttgccatcagccccaccctgaccttttaaagcagctgctttccccaattcctgagctttcctgggtccctgcaacttggttggcctccctacctctgtaggatgtcaggtctcagctgtctctcttctggagagagaattaccactgatcctggtccttatgttttcacttcccatcttccaacattttgttaacatcactcatctccactcattttctcctggttttcttcgtatttgtgagttttacctattttactatttcactgtctttgtggtagttttaggatggttgaatttctgtatttagcctgccattaagtatatatttccatttttctgcttgtataatttccaatacatatcctgatagatagtatttcctacaaaatttacttttagaggaaaaattcaaaatgttagcagactaatcagcttatcctgcccaaagcttttgagatgagaatagaatggattatgctttccatgactcttttgatttctggctgctttagaatgtagatttataagaaaagaagagtaggtgaaaatggtcagtagtatactgtctagggaatgagcttagaattctgaggattttagatttctcttggactgttgcttaaaagtaccactcacagcaaacacttgatagcttaacgcatacaaccgcattaaagagatagtgttttaactgcacatataacttaactatttctgtatttatcttcagttttcagtgtttaaacctgcctgtttcttacattgttggaatcatggaaagaaagctataaacaagttggaagtatttattacaatacctcaaggtgaaaccactaaagtccttctgtgggtaatttattatactgcgagatctcagacacatgagaaactgtcctgaactcccaaatgaaagcacttccaaaatacagcatttctaaaacgagtaacctttaacttatctagcataagcagaagaataagatatgtttaaagttttcatgtttttgctgatagacttaaaatctacgtagcgtttcctagattctgactttgacttgctcacacgctgtccctacccatgcaagctagaatctttcctctcccttcttgatttcaacatgagtttagaaccaaaggaacttttacttggtccggtgacagtttcccgtctgagacttccccacgcaggcacagagccatggcccctgggctgtttttatttgctctaattcaaatgccaattctaatttgctttctacggtgctcttttgttcgtctgtcttcttctagtatttataattgataactgtagtttaattattcaaaatcattatttttagatgtttaaaattgttttttttccccttcagacttgtatataaatgtcattatctcctgagaagtggtataattttcagaagcagagaatacattatcttctcttgtatccagtggtgtagtgtctgtcggggttcccaacctctacactattgatgctttaggctggctgcacctttgttgtggaggggctttcctgtacgttgggcgttgtagggtgctcagcagtgtccttggcctctgtcattggatactaataacatgcccacttcacaaatttaatctttctgtaagactcagaaatacataggaacagaaacaaaagcaaaaaatcagtatcgactgcttcttgagggctcactgcctgctgtgaagcagcatctgcaggtctgtggtcagcgctggaggttgaaaaccattttaaatgagcaactgtggcgggttcacagggtcaaagggcagagttcctgttgggatgtgggaaaagatgtgatctctactatctcagtggcaattccacagccaatggaagtaagcaatggaacaatttagaccatttgagaaccaaggtgtcaccctactgtgaaatctgcagacagagaaggcatttcatctgtatttttaccttcaatccttgtctgtgtctataagttcacattgccgacagcccacctgccagctctgctaccagaattgccttgctaaccagctttactcctggaatttaggaaagtctgagaaaagtcttcatctattcatattggcatgctggtacttaaattcaatgaaagtaagagtagaaccatgtattcaataaaaataagaatagctttatttgcatgctgtcactagtatcaacctaacttcttatgtccttttcaagtaagtcagtgaaaaccagaaatttcctgacagctggccttggaccgtggctgctttaacctctctgcaggggcaagtacatttctgtcattctgcatttgtgatcctgaggtctgactgtcacatgtacagttattggcatccacagggtagaacttctttcttatctatagttcccaggtacagagcaggaaaggagaactgcagccaaggggtgatatctaattcacaactgggatgccccagtgtgtgtgccgaggagaaggtacctgagtaatgttattcattaacatttatttctgggctttggccaattggtcttcctgtagggttatttggcatgttctaataaaatgtgcctatgattgagattatcttggattaagaaaataacttattcaacaagtatttattgagcatctcttctgtgttgagcactgtgctagagagtatagcacagaacaggccagatacagctctggtgcagcttgtagtctagtctaggagaggtagaattgaacacacatgtaactgcaaactttgagaagtgccacaaaggcaagagtattcaggaaacccagtttaattagagtcagagaaggtttctgtaaagaagtgaaatttaagctgaggacatttaaggcagaaggaatgtaactgtcataggcctgtactgtaggctgcaaagatcaacttctccatgtctcatgaatagttaattatgtatatttcttattttagcacctcacattatgcagttgactgtcgaacaatgtgagagttagggttacagggcccacatacagttgaaaatctgagtataacttgcaactccccaaaaaacttaactactaatacctattgttgaccagaagccttaccaataacataaacagttgattaacacctattttgtatgttatatgtattatgtatacaatatgtatttttatgtattcttacaataaagtaagctagaggaaagaaaaaattatcaaggaaatcataaggaagacaaaatatatttactattcattaaatggaagtagatcaatataaaggtcttcatcctcatcatctgcctgttgagtagatggaggaagagaaggggttggtcttgctctctcaggggtggcagaggtgaaagaaaatccatgtataagtgaacctgcgcagctcgaacctgtgttgttcaagggtcaaccatactgacatgtttacatgtatttctccttggcaagatgcagaccgagttcctagaagatagggatgatgtgttattcatataggtataacccagtcttgagcttcacaacaaacaggtattggatgatagttggggaattgagtgagtgaactaatgaaatgaatgaatcaatgaatgagtaaattggaggatgtaataaaggtggttgacatctgctttgtcctccgtatccatactttcttactctagatactgagaatctcttctgtcagtcatcttgtgcagtggggtttctttcttacttagttttgaacaattggccctatttgactttgcatgcccaggcctcagcaccttgcctggcacacagctgttcaatgagttatgagtgaatgaatgaaagaatgggtttattttcctgatcgtgagccttattatgtaagcttgcttgctgatgtctgaaacctgcagccttgcctgcctacctagaccgtttctgcactccacctgaggccaccactcccaacagttacactgaagttgatttgcctggaaatgcaaaatgggaaaaattggttttgtctctccaaaataaatctcaaaactgtctctttgtctgcctaggccaaaccactatcatctctgtctagcactatgacaataatctcttctttcgtctctctgcaatctgttttccacaaagcagcttaaatttatattttaaaatataaaaggcaaatataaaatataaatgtaggatttaaagtattctctaagtcagattgtgggacttacctgctgggaactgtaatggcctcctctagcacatagaatgaaatgtaaacccttctgcacctgcaaaacctatcttttttgaccccgcctacctctgttggctcattttgtgctctttttccctttgttcttcgtgctccagccaccctggccttcttcacgtaccttcacgtgtctttcacttacccaactctcattcccttcatgaggaacctgcccagaggagacactcaggaactctttggacacattcatggctttttagtccactgatttttagatatgactttacccataggatcatttctttccaaggaaacgttaagcagaacctcaacacataaagcaaatgaaagtaggggtactctgattcccatggaaacgaggatcccaggaacctccggtcctaaggcttcttctgaaaatataggtttccagagatgatggtttgcaaggcattgctcaggtccagtagtgcctgtctgacttctgtgtttactttgactggcctctttgaacttggaccactgttcttttaggcatttagaaattccttcctactcaactgaactcctgattctcaattcttagcctactgtcttgaatggccacacattctgctcttaaaatgttaaaacagtctagatgggaagatggatggataaaaaagttaaataaaacttgtatatggttaacttccagatagttcctctaagcaccaaaagagtccagagaagcaagagtttaagggtgggggctacagagatactggaataatccatggaagtgtctagatttgagaaaggtctttgaaaatagtaggaaatagtgagaaatgatgcagatagtctactatgcattatggtttgacgaaaaacataaagggaatgagacagtttgggtaatagaggggcagccatatcaacaaagcatgtgaaggagtgtctggcctgtagatatgtaatgtaaggtcacaaatgcttaggggagttggaccagtgccataacacagaacattataccctaactaacaaatgtgaacatagtagttactgttgccataaatatcatgtcctcagaaaaatatataattcagtgagcaaaaatttattttaattacattccagctcttgcttctgaagatccacctggttattttgctgagcctcagttgcccccccattccttttctggtcgaggacatgatggcagatggcaaaactcatctattatagttatttctttactgtttacagagtaaccattccctgacctcaaattctgaggtcatcgtatcaaagcctcctatgcactcattgttttctacttctgagaacatctgcccagcctggatggctctcttttgtataacatcccagcattgtctggctttgctcactggtcacagccagggttctcatgctcatctagtccttccctcaccttcacccatgtcaatgacttgcttaattacttaatttctgcttaattttttgatagcctgaatgaaatggtcctatcctcttcctgaatcatcctatgtaggtgctctccaaatcctggccttgtcactgggtgactggcagaaagataggaccattgacagaacagtgaggtcaagggggagctgacaagagggaaaagataagttaatttacaacacaattagtataagcagaggtgatgtttaggtggttacagataaggaactagaactctagtttgaaaatctgtgtttttaaataacactggaagataaagttcattcctcaggtattcattccttaaatgtaaacatatgctgttgccaggcactgtgctaaacactgtgagtataaaagtgagttctcactttaatgcctttaaggcattcactctctggtgtgagacacaggtgtgatatagctgtataatatgtctacatatttacctttagcgtaatctttccatgtaatactcagatcattaaatctggaaagaaggaaggaagtctaaaagtgagtactcactttaatgcctttaaggcattcacaccctggtgtaataaacagatatgatatatctgtataattttattgtatctacttatttacctttagcataattgttttcatgtaatatccagaacatgaaatgtgatcatgaaatctgggaagaaggaaagaagttaggagaccaacattctaccacttagtagccctatgactatagcaacccttctgaacctcagttttctgatctgcaaataagagcattggacttgatgaagtgttttcagttgatctcttgtgaaatcagatgcttttccaaggattccagaaacatttgatttcaaatgcttttttaaagtgtgatgaaaataactcatgcacttaaatgcattatgtaccaaaatttgcctcatcaggagagcctcgtttttcttgacccaaggttacaattacaccttataagtttggacaaaaggttacaaatttgatttagcagtataagcaaaaaaaaaaaaaaaaaaaaaaaaaaaagcacgctgattaataaaatatgctttttgtttctttcacctatagttgtttcatgaaatatttgcttggcccaatgagttttgctgttaaagacattgccatcaccagccctcatctgcaacatctacttctagctctaagcagctaagattttttaactcatgtaataaagttgatttatacttaaatttatcagattgggtggttctttttgacttaacagcttattgatgtataattcataacatattgttcacctacttaaggtatacaattaattggtttttagcatatgtacatagttttgcagccatcatcatcaattttagaacatttgaacgatgccagaaagaaaccctgtacttcttagcaatactccccaatttccctactgtccagcccaaccttaggccaccactaatctactttctgtcttgatagatttgcctaatatgaacatttcatgtaaatgaaatcatgtaatactgtatgtggtgtgttgtgactgccttttcccgcctagcatgttttcaaggttcatccatgctgtagcaagtatcagtactttattttctttttactgccaaataatatttcattttatggatatgccaaattttatttgttcatttataagttgatggacacttgttgtgagcactctttagctattatgaatagtgatgctgtgaacattttgtaccagtttttgcatgtacacatgttttgatttcttccaaatatatacctaggagtggaatggctggggccacatgatacctctgtggttaattatttgaggaaccaccaggctgttacccaaacctgtggcaccactttacattcccaccagcagtgtatggtcccagtttctccacatcctcaccaacacttgttatgatgtcttttttcttatagccatcctagtgggtgtaaagtggtattcactgtagttttgattttcatttctctgaaggtagaatggatggtttttgaaagaaaagtttcagcacaacaaaggcggaaactttgtttcaaagttacagaaaggagaaaaagatattagggatggaaacatataagtcaaagttggttagagaactgtctgagagaatagggcatggcagaggaaatctccagagagctcatttgtccagattatagccatgacacaagcttaatggcaataaagttatagtccccagaagaaaggcaggggtgtgtttgtgtgtagctacctctcacacacccagtttttccagcacaaagctgttgccgctttctaatctgagtggattggggatattcactcttactccccacctatatcccaaccctacagtccacggtcttttctgtcaccatgtcactgattttatagttcccttcacttaggatgacttctttattcatccaaatctcatccttaagacttggggacatcaggcctacctgcttggagcaacctctctgacctcttggacgatgttaacatcctttttatcccttgtgtggcatttaaagaggtttgcatcacacagcttggtacttagtgatacaattatcttgtatcattcacattattttatatgtggtttcaagtatcccagtgggttcattgaggggaaggaataggtttatacaatttgatattgcacataaaactagaagcatactaggtgcttagtgcatctttgttgagttaaataagagggttattcttctgttccatctaaactctgcttggaatttcataaacacaggcaggttctcactggctttgggaaaaaatacccctcttataaattcattaatacaaagcaaggggaagagttgatattttaagtttacattcaggtaagattacattgaaaattataacattttgttcaatctgtgcttgttacctacaggaccttgttatatgtaggaaaattatctttgaaacctctgtgtgttgtcgaagtcagatggctaatattgacccaagctggcatctccctcacttcacattggggatcctgttgagttgtcctcaaggctagccttttggaccactatactgcacttctgtccttaagctctcaatgtgaaatcagagacaggcaaagtcaagcaaacaaggcaaaggttaatacgagcaggctaatagtcaacagatgggagtcttcagcctgagtgagatcccgctagaggccttcccttcagagacccaagaacagttgaactggaaatttgaccaggaagggactccctaagagaccttgcctctgagcatgtcagctgaaaagatggcagagttcagagaaaggtgatgggagatggtgggcagagaaagcaccagttcctatgtactacctccaaaccagaaatttctaatacagcaaataaagcaaattggaatgatttcatgaacctgtgtagaggtctgcaactggaaaggatgtcctgaaaagcactattttatatagtttggtagaaatacatccacactgtatgagtctcaattttaaaactcccttgaggattaggaaacagattataagtagctagaatgtaaaataataataatttagacattgttttggaatgataaagtttattgtacatggtaaggaaattatgtattgtagattttcctgattctgggcatgcattgggaccacaggttatggtggctcacattttaggattgacttcccaacggctgctcacacagcctctggaagtggtaactttggaaggactggttgcaaagtggaaccagagtatattgcagtttcacaagcaggaggtaatagcatttattgagcaactatatgctctcttctctctctcttctcttctctctctctctctctctctctctccctctctctttctctctctctctctctctctatatatatatatatagttaatcttttcaatgaccctgtgtctttctttggatagaaatttaaaataaacttccattttaaatatgaggaaaccaagacttaaggaggttaaggaattgggtctagtaatatatcaagtcaatggcagaaacacagggaactcaggtcccttggattctgtagcactggttttattcctacactttaccccctccattgtaagggtactaaaatcttcatatgtggtcaaacaccttttacttttattaggagaaaatggaaaagaaaatccaaatactccaaaaaatccaatgcaaaaactccaaaatatcaaaagctacctttttcaaacaaattcagttttttattactcttactttcataatttgctctttttagtaattatttgcttacttcattgcttagatttaacaatacaaatagatgataaaaatctaatgattcagttagttatattttaaatgttatattattgtgtcacaaaaagtagacatgtaatgcatgtcttatctaacattacctaaaacatactggcttccctatgtaattctattatgaatactatgccagtatcttctctaatcattccaatttaaacatagtatctatgactggattgtaacagaaattggaatttgccggccaacactgaattggaaatgcttccattcaaattttcttacaaatgatctttagaaatgtattttaaatttcattctagcgaaaccaacttagagtgaatcttaatgggctagaacaaaatagattttggattgatttttctcataaaatatgcaaagccctgtttttaaatagagtttttccccttcaatattgttctttttctctgtttagcaaataatttgtctaaaacgtttctttttcagattttagttagattacaatagaattaacatcttagaattgccaaggtagatggaagatgaagagaaaatccggattccagaccatgctaacttcaagccagtgttttgcctgcagctgatctcaagaattaggtgaaagtttcactatgtaacctgttttggggctcaactcttcataatacgatcattcattaagtaatataaccatggataattgtaaaaaactgggacactgggttttccccccttactccacaggtcgactaggctgacagtatacaccagaaaacaggcatgcaaggcatccttctacatctttctcttttgcttgcctcttgttagttacaaagatacatactgtgccaggcactaagctggtttcaacagctatttatttagattgtgtgaactggagctgaacttgaacccaattaatagcaactgaacttgaacaaactgatatgaaatcattacaggctcagttccctggtccattatccctgaagagatcatccgacagcactccaggtgccttttctatgccaaatcttggtgcagtgcccaatcagagagtgtcggggggattagaagttcggttgcatcggagttagctcattaccacatttgtgatcgctttcacagagaggagaggtggtgatcccactgggcaggattgcagagaaggctttgttttcaacaccatctggcacatggttggcactcattaacacagcacaatgtcgattaaaataataattgtacgtggcagcaatgctgcttagacaggtccccacctttggccttccagcaaaggaaattgaagaaagagaaggctgaggagttgcctctggtaactctggtctctgggtttgcatctttcttcatgcccacacctttttttttttttttttttttggtaaagaagctacttttttaaatgtatgtatttatttttatttttagcagcagtacccccccaccccccgccaaatccccctgtttttttaaactgggaataccatgagtctgaccttgttcgcagttcccaaggaccctaattacagagctccggctgtagctggactcccaattcaatactgcagccaggaaatatttgctgaaaggggattctatgcagtcatatttcttctgcaacttgaattatatataattaagagttttaggcttttctcttttaaaggatgcatggatgaactcaatcattcaggtgctgagttaagactacactgcctttccttaaaaaaacagatgtgtatttacttcggcagctccagatcttgactctggtagcatctacttgatttgctgtttgggggataggagtgcagatttttgaaagaaattgtttgagtttgaatcctgtttctaccatatactaggtgtgtggtgaggagaaaatcccttaactcttggtctcccttttcttcactgctgctatggtggtaatagtcatccctaagctttaggatttctgtgaatataaacaaacatgtaatacactaagaataatgcccagtgcagggtgagctcttgatatgcattagctatgatcatgtatgcctcaccatcattttctttctttcttttttttttttttttttttttgagatggagcctcacttctgtcgcccaggctggagtgcagtggcgcgttcttggctctctgcaacctctgcctcctgggtacaagtgattctcctgcctcagcctcccaagtagttgggattacaggtgcacccccaccacacccggctaatttttgtatttttagtagagatggggttttgccatgttgggcaagctggtctcgaactccacacctcaggtgatccacatgccccagcctcccaaagtgctgggattacaggcctcactgttattttctgcaagagtttattcttcctccagattgtgcctcatacctatttaaattttttattcccaaatgataggatttactagttgtagtgatgtaggtagtggttatgtggacatttgtccagatatgttgatcaactttttttggtaggacactattatttaattccttgtcatgctagaccaaggttagaagaagccaattgatgtgggtaatttcctcatagatctataataccttcataccataataattaatgaagcacatcatttgtttccagagcagattatgcatatcttaaacaaaagaaataagttgtatatttcaagcctataggtaagcactataactaatgatcatgtggttttctctggttgtggaaccataaacagcatgccctctggcactgtaatgatttgtgttctataatactcagtgtaaccatggtttttattctgtttgccgtttggtatgtggaaaagccttcaagaaactggctttttgcaggagtgtttacatatcattcatgccaccaagagaagatgaccgacattttagatgcagaagaaagattaaatgcattcagtttaactagcggcactaaaaagggctgcatctttgtattgttgctgtttatcttctttccagcagtggaatattgagcttccccaggctgtgattcaggtattaatgccgattttaggtcgggcaagagtgtgttcagtctgcggcacttagatagcaaaggcaaactgctcacggctattagtcaggagtttctgtatgccagtgattgcatgcttgtgactcataatcagggtgattcacagcaaccgttagatgggcttgctgtggctgtgtttttcgtttggactgctgtcattgccaaaagtgtcagcctttctcctacagatctgaccgtgtgacacatgcacagtgccctttggttgtgctgaatggctcaccactaacatcatggctaagttttattatcttggaggaattgtctctcacagtgagtcccaattagacaaatgaattttgtgttgttttctttctgaagtgttactctgggattgttgacagaatttgtgccacagtgttctcttgggcagtctgaattccagattctctatcttggtttaactatgctctcacttgagaatcagcaaggagatgtcatgttatctgtttttctgtatacgtggagctgtatcggtggtctgggttcctgctgagcagatacataaataaccacacgtctctctgggtttaataccagcccggttctgacatccaaggctgactcctattccatgttttgccccaaccaccgaacacgatgctctgacccctcaacacacagatgccttgtacctgacctaataagttgagtcagcaacctgtatttctgatttgtccattaattctgtgtgtcctggttgagacccacttgcatttctgcatgcttgcttaacctacgcctgtcacaactacctctgttcctttttgaacttaacaaacatttatacagcccgcggtacgctagggtctgagcatacaactgggaaaagatagataggatctctgttctcatgaaacttcccttctggctcttagaagttatacatgtaaacaaatgcacaagagtctctctgatggtaacaatgcaatgaagaaaatgaaacaggataaaggaatagagagcaagtaactatgacagggctattctgagagtagagggaaaggtgggagaacattctacgcagagggaccagctagtacaaaggcactagggcagtctgggtgaatttggaaagatagagagccaaggaggccagggtggctgcagtgtagtgggtgggcagagaagagccagatgagacagagtcaagcctgatatagacagtcttttttctattttattttaaaatatttaatttacaaataaaaattgtataaattatacatgtacagggtgatgatttgatctgtgcatgcattgtgtacttattaccacaatcaaatcaacacattcatcatcatccttagttaccatttgtgcatgtgtctatatggtgagggcacttaaaaatcttctgtcatcaaatttcaggtaaacaacacagtattattaactatatttaatgctgtacatgagatccccagaatttatccatcttgtaactgaaggtttataccctttgaccaacttctcaacacttcctccaacccttcatccatggcacccatgattctactgtctgcttctatgatttaaactgttttagattctgcatatgattgagatgagatactctttgtcttttggtgtctggcttatttcgcttagcataatgtcctccaagtttatccatgatgttgcaaattgcaaaatgttcttcttcttatggctgaacgatattctcttgtttagacacaccacattttctttattaattcatcagtggacaccgaggttgttattgtaggtgttatttacacctatcttagttattgaagtaacgctgtaatgaacatgagggtgtagatacctctttgagatattgatttaaattcctttggatatatgaccaaaggtgcaattcctttggatatatggctggaccatagggtacttattaatttacacatttttaattttttaaggaacctccatactgttctctataatgactgcaccaatttccattcccatcgtgcacaaggcttcccttttctccacagcctttccaatagccagctgctatctcatctttctgataatagccatcctaacaggtatgaggtgatatctcattgtggttttgatttgcatttctctgatgattagtgatgttgtgcacctttttatatatctgttggccatttgtatgtattctttgaaaaaaatgtctattcatgtcctttgcccattattaaatctggttatttgttttttgatattgagctgcttgaatttataatatttttggagactaatccctcatcaaatatacagtttgcaaataatttttcccaattcataggttgccttttcattttgtggatttttttttcctttgctgtgcagaagctttttagtttggtgtagtcctgcttgtttgcctttgcttttgttgcctgtgcttttagtgtcatatccaaatatcattgccaagatcaatgtaaaggagctttttcactgtgctttttcctaggaattttacattttcagatgttacatttaagtcgttagtcttttttgagttaatttttgtatatgaggtaagataagggcctaatttcattatattgcatgtgtatatttggttcacacagcatcatttattgaagagactatcctttccccattttgcattcttggcactcttgtcaaagattagttgaccatatatgcacaggtttatttttgtgctctctgttctgttccattggtcaatgtgtcttgtttttatgccaataccatactgttttattactgtggctatgtacttttgtaatacagtttaaaatcagggtatgatgcctccagctttgttctttttgctcaagattacttttggtatttgggggctttttgtggttccatatgaattttagggtttttttctgtttctgtgaaaaatagaattggaatttatataggaattaaactgaatctgtggatcactttgggtagtatggacattttaacaatattaattttttaatccatgaacgtgagatctctctccattaatttgagtcttcaatttctttcaacaacatcttatagtttttgatgtacagatcttttacctcctcacattaacagaatgaaagataaaaatcatatggttctctcaacatgtgcagaaaaattcaatattctttcataattaaaaactcttaatagattatttgaccaaattcaacattctttcatgataacaactcataacaaattaggtatagaatgaatttatcgcaacataacaaaggttctgacaagcccacacctaatataatactcaacatgaaaagctgaaagtttttaaggttaacaggagcagactcatagtcgacagatgggagtcttcagcctgagtgaggtcccactagcggccttcccttcagagacctctaagatcaggaaccagacaatgatgtccatctctcaccacttctattcaacatagtcccataagtcctagccagagcaattaggcaagaaaaacaaaagacatccgaattaggaagaaattaaattgtctctgtttgcagatgtcatgatcttttacatagaaaaccctaaggaaaacccaaagaaactgttaaaactaataaattcagtaatcaattcagtaaagttcgggatataaaaatcaacgtacaaaagtcagttgtgtttttatacactaacatttaactatctgaaaaggaagtttagaaaacaattccatttacaatagcatcaaaaagagttaaacatttgggaatagattgtaatctggtagatcttggttagagtttattggattttaatagaaatggcaagaaacaagaatatgaagcaggaaagtgctaaaatctgatttattttgtgtctctgtttcagcctactttatttaagtatgatctctagtgccaggttgctagccctatctcagtttctgactcatatttttgacatcagctttaaaaatgttcacaaatatatatgcacttggttttcattattttgctgtgtcaaatacagaacagatttgttttgggtattagagcctttctccactattcaccaccatcaccctctactcacatcattgtctttctacagaaggccgcctttgactccgagagacataacctcttctgcctctgtggtgtctttgtgcctagtacttaccacttcctttgctctacctcatcctataagtgtctttcccctatgggcttggagttctttggagggagtccattttctcattcatctaagttttccctagcttccagcttagtgctttgaacatagtaggggaaagatggatatatagatgaatggattacgaatacccactaaaatgttcagtctgctatgaagccctcttcaacagttagaattataattctccctcttgctcctacagcgctttccagtgactgcttggaatctttagtggcattgtgttatgcattagtatgtatctttagagccctttgggggtcaaggactatgtcatagtcatctttgtttccccaggatttaacacagtttctagcatttagcaatcttcagtaagtgcctggacaaaagatgttaaacaggacataaaactccaaaaacagaagggctgtggaagtgtattaccagacagaaccctgggctagatgtgttttcttaaggcacttgtaattcctcagaaacttcccaaaccaatagggagttgcaaacctgctatggagcatcctccaggaaagcagctttggagctatttttcccgccaaactcttttgaccataacacaaagccagaaattgattttgcattgcaagccagtatataactgttctgcaaaacaaaaatgcatctttactctgtaatacagtccaatatcttctatgccctctgtggtatagaatgctgatcatgaccctttaaactgattttaagactcgtgaataggttgcagcccacagattgagaaaaccctgtttttgaggacagagatagtcccctgaggtgagcttcagaggaagaagcatgagctttacctggaacccataatatctcactgtactctgactgtttgttgaatatttgtataaatttagcaatgaccaagcgacaaccaattaaaacaaggcatcctggccaaaaagaatcaagttgtgtagtggagacatctttgtcatttagaattgagttgtttgaatgctgaaaagttgttagagataggtccaccagtcacttagttcaccatatccaaatacagcattgtgaatatttgaggtaaatgtgttgcttctaaaatgaaactgtgggcccactgagatatagggaacttaacgtttcttctgccaatatgttgacataaatattgatgttgttaagcatgtatgaataggagaactatttcagtctttttatctctttaaaactaatttaaatctgagcattaaaagactgtttgataccatatgtttgttttagataggaaacaaaatctattctaaacataagggcttatgaaatctgtattctgaacataagagcttataaaattagtatataggactggaagctatggtaaattgtttcatggccacagattcctcccgtgttagtatgcatggccctttgtaatgtgaccttgctgttcctcctgtccagaggggggtctgtttacccaacccttgctaagatatgttgcttttatgctgtgctaagaatccaacatttgctcagtaatgtctttttattgtggaatgtaagtccagcatgaaattgttgatttttctctttgaagaccatttaaaagctacttttgaaagtgaccaaggtctgtggacatgagcatcacaagccttttgtgaaaatattagatagacttcaagaacacaaccaaagactgccacagactagaaagatacacatcacaaatccatttagctgtgtacgtgaaaggaacaaattaaaaggttcagcaatgtcactggcatatctgagaattcaacctatttcattttgagacccacataccttatctgtgaaggcaactctgtgtgtgcgttttccaatctagatggatagcatagaatgagatgacctagacaagcacagcacaaagacagttgtgatagcatccgaactttcatgtgtagcttataagggcaattcctccttttctatgtaggccttttttgaaaatagcactgtgcattggtttgcttaccctgagaagacctgaaagatgagattatgatctttcatctcaaattaaagaaggcttgtctcaggaaccatttgacaagttcaaacgctgctgacttagatactggcctcttatcagcaccttcaatttaatgtttggagtgagtggtaggcctatgttgttgaatttttatcatatttcccctcatcttggtagattatgctttaattcactattctgtgacttatcaatattgtctgttttatgctattgagctataataaataaatagcgtaatgcagtacttacaggtagtgaaattgaggcaaaatgggcttgtgacataggctagatcaaaaaggtattacctgcaagttaataagtagctcagattctgctataatttgctttattcataggtcttgtgggggaaaaaataaaataagctttctcgttctgataatcccttaaaagagtcatgaagttttgatctttggcttatttgatttatttttaattgatagaaaccaagccattcctgtgcctctcaaaaatctatctgtggaaaatattttaacttttaaccaaattatgtcttcccagtattagtgaccctctatgttaaaatgtttttcccttgaaagttagaactccaatgttgttagaagagtttgattctctttttgaagaatcatagaaacacagtacagttttgtacctgtggcctttggattttgattcacattgaatttgatgccaggagttacatggaaaagtcaataataatccgtggatcattgccttactctgacactgggtgaattagcctgctggggtaatgttctccagcttgtgtaatgggcctatctagtagcaagacagcagccatatgaaacacctgggtggtcttccagagtactttcacatggattagatttcagttatccaacgtgaggtcacaaaggcttagacagctgggctggtgccacatcatgaacagagtgcgacttcttcctaccggatgcataatgtaaaaggtgcctgaggttaaagctgatccttgggctccaggagcagatatgggtcaaatgaggtctcaaaccacagttggaaatgttgggaaagtctctatacaggaaagaatcagattttcctctggcactttcattaggcatgttctctgccagaaaagcctagtttctgagttttctggattgagctttatttgattaacactggtttaaagttttaggtgttattaagcagaaacagaagaaagggcctgagtggccctttcctgttacacagaaaacagcatttgaggcacataggctttggaataaaatcacctttttagtgttcttagagataacagtggctccaaagcccaccatttttttccagtcttgccaggaactttgaatgatccaataaaaggtaatgatcaaaggtttcaaatgcaactgataaatcatatagatttgtattcaggatgcctgaaattgacttgtggatgtttctcatctatcaagaaggacttggtgatttgaatttagtactttgatgttgcagtaattgtttgcaactgcagctcaatggcctgaaggcattgctcatttctccctttctcttcttgcaaagagctcttgaagtattcttttacaggctgttctcaactcactgggggctgtgacctaaaatttaggataagagaatagttccataaacacttggtacagaccaacaacaatgccctaatgagccatcccaaatgtgcaccattctgaatcaatcatcccaagtccacaccctcttcactggatatatattaagattcacttcatggtatttataagggaattactaaagaaatcatggggaaaagattcctctacttattattttagtcaaggtatttcatatatttataagttacaaatatctttcaaagtatattttaaccagttcctcaatacttgaaaaaaatgctatagattatctccttttggaagataatctatttcttcctgctatttcaattagattaaattaaaacactcccaaattaaggctttctggtaatgttttctaaccgtattctgtagtttcctcaatcagttgttccactagtcatttagtgcatgcctatattctggctgagcaaatgtatcaatattcatgcaagggtgtccatctctagcatcaaaagccacgtgcccatctgtctactatgaatatcttagtcatcattttacaccaatatattatcttatatatcttctgcatctcaaaattctttttaaaattcagctcatccacagaatcttttcaggtgaactcaactattatccctttagctattccatgggttgccataaatcttatgaatatagattaacctcataaatatctaggatctaagactgtaaagtatcacaaactgaaagatcaactgtcagggcagtagattcctctataagccacagtaattgacgagattgagtcagtatctctgtgcatctactgggattgtttagcatcgttgttggtgtcacttttatgctcatttaccattaagttgcaaggctgataacatgtgctgcattagtgtgaatcgtgtttattttaaaataaatgttgatgctgaagaaaaaagtgttagttgaggggaaacaaaccagacagtagcaacttatttacatactagacgagatacccttttcatgacctccaaagttctcaggtctgggacatttcatactctaaagattacttagcttaaacatctgtctttgcgcctgtagctttgtttggttcaatttggcatgcctctgttgagtgcctattctgctagggatcctaagtgattgactaaaggaagtggcttgccatcaaacagcttacaatgtggttccaccctgttctcccagatatcactttctctctcacattcttgtttgacaacttgttttatcccgattttaaatgtccgtatttatttatttacttgttgatgattggtcttccaacaatccacagctcttcacaagcaaggcctttgtgttgtgtgctgatgtatccaaaatgcctggaagaccagctggcacattttaggcattcggtaaatatttaatgactcaaggggagacaaaatacaactacatacacaagacaaatagggatataacacaccctaaaaagatacaaaaacagatccacattttgcaatgctctaactacaaaacttggggggattgctatttaagaaaagcagcaataattttttaaaaattatatagaaatgaattatttagcatgaaaaataatcgcaatttataaataaagttaacatactagagatgacaaaatgtgagaaataatattaatgatatattaacacatgaaaatatctcgatattatacttttttctctataatttttggccatgtgttctttttttgttgttgtttgtttattgagatgaaatcttgctctgtcacccagactggagtgcagtcgtgctatctcagcttactgcaacctccgccacctgagttcaagtgatcctcctgcctcatcctccagagtagctgggattacaggcatgcgtgcgccaccacgcccggctgatttttttgtacttttagtagagacagggtttcaccatgttgtccaggctggtctcgaactcctaacctcaggtgatccccccccctcagcctcccaaagtgctgggattacaggcatgagccatcacacctggccagccatgtgttctttaatcacctctccatatgtaatatcaatttctgagagattgaataaatggataatttgttatttgctctagcatgggtaatccaaattgtttttgtttaaataacatttgggacatataaagggcttcacacatacatacttgtaactatgaaactgctacaggtttgtgtcttactagcgtgggaattttaattctgtgctgcattttcaagtatattctatataagagagaagttcccatttgtcaaggtatcgatgagaactgaattatttgcttataattgtatagatctggtgagtgaacaaatcttccatagagtagctctggctttgtgcatttcaaattttgtttatcttccagtgcccacatacttacagtactggtgcaaaaacagcacagccacatcattacttcacctggccctgtaccttagtatcatgaaactggttgaacttgcacagtgggtgttgggaatattcttatattacttaccaagatgactggcaatagattatatgcagaattgtttgtgagccacataaaaatagtccattatatatattctactatgtatataaataatccactatatctatctatcggagtcagagatatatctcatatatatatatatatatatatctatatatctatatatatatatatagtgggctatatatatatgagatatataaaatatataatatatataatgggctatatatatgagatatatctctgactccactatatatatatatatatatatgactatttttacatataggggactatttatatatatagtagaatatatataatggcctatttttatgtggctcagaaacaattctgcatatagttaatttattgccattcatcttggtgagtaatagaaacatttttccaacacccactgtgcatgttcaaccagtttcattatacagaggtacatatatattatatatatataaaaaatatgtagtatatagtggactatatatacaaaataagtatatagtggactatatatataaaatatgtatatagtgggctatatatataaatatatgtatatagtgggctatatatataaatatatgtatatagtgggctatatatataaaaatatatgtatatagtgggctatatatataaaaatatatgtatatagtgggctatatatataaaatatatatagcagactatataaaaaatatacgtatatagcagactatatataaaaatatatgtatatagtggactatatatataaaaatatatgtatatagcggactatatatataaaaacatatagcagactatatataaaaaatatatatatagcagactatatatacaaaaaatatatatacacagcggactatatgtacaaaaaatatatatacacagcggactgtatgtacaaaaaatatatatacacagcggactgtatgtacaaaaagtatatatacacagcggactgtatgtacaaaaaatatatatacacagcggactgtatgtacaaaaaatatatatacacagcggactgtatgtacaaaaaatatatatacacagcggactgtatgtacaaaaaatatatatacacagcggactgtatgtacaaaaaatatatatacacaacggactgtatgtacaaaaaacatatatagtggactgtatatgtaaagaacatatgtagcggactgtatatataaagaacatatatagcggactgtatatataaaaaacatatagtggactgtatatataaagaacatatatagcggactgtatatataaaaaacatatatagcggactgtatatataaaaaatatatacatatatagcggactgtatacataaaacaaatatacatatgtagcggactgtatatataaaacaaatatacatatatagcggactgtatatataaaacaaatatacatatatagcggactgtatatataaaacaaatatacatatatagcggactgtatatataaaacaaatatatatatagcggactatatataaaaatatgtatatagtggactgtgtatataaaaatatatatatagtggactatttgtataaaatatatatatatagtggactatttgtataaaatatatatagtggactatttgtataaaatatatatagtggactatttgtataaaatatatatagtggactatttgtataaaatatatatatagtggactatatgtataaaatatatatagtggactatatgcataaaatatatatggtggactatatgcataaaatatagtggactatatatataaaatatatagtggactatatatataaaatatgtatatagtgtactatacatatgtaaaatatatacagtggactatatataagatatatgtacagtcgactatatatattttatatatattttatatatagtcgactgtataaaatatgtatatagtggactatatataatgtatatagtggactatatatatatatgatatatctctgactcagtttccccttaactggaattccaaaaatactctgggccacttcattgccacccaatgggaggaagagtagtatggatggaaccttagtgatggaagagattacagggttaacctatagcaattaaaatattttacttatgtaaattttacaaaattatataatcatgtgatcttgttactaaggctcctcttggcatcatgtaaggggctcatgcaaatgaggacccctgaaattacatttatttccccacgcaaatctgcatctgggcattccaaagaaatagagattgtttataattattgggagtagaccttcaaagtgggacaggattacaactgattgcagtattagagaataatcatttagaggtcacatgatctaggacatttttaggtgatggcaggtggtctgtttggcatatacacctgaaaaagaatgtagtataagatataattagtggttgaggcaaacccttgaggtccttgaatgccagaacaagaaattgggaggttgacgcacacataatcaaaatccttcctttcatctctgtgattcaggagcttttatttggatttattaattcagatatatttgtttatttcagttagtactttacttgtttttttagagtgtatgcctttcaaagacctggacctttgcttgcaccaaacctcctctgtcgctttatccttaacccttgagacctagtgcatatctgagacctggcattaactaaccttaagtagcatgagcaaatttatattgtaaagtagcttaaaaattttgaaaaattgcagatttgtgaatacaactggataaaatgtgaaaactttaatagttcaacccacttcaagtggaagtcattcgtcttcagagacaagtataagtcccaataaaagtgagttaaaaaccccttcacatatttttgtagcactggctttccaatttcagctgttttccaaatactaaaagatgctttatcatgcgtgtgcttattcatatccattgtgtagtcagttgactattttgtgaattacttgcatttgtccatcatgtgttgaacaaacatggtttttgcaatctgaaatgagagaaaaatgatatgaaatgtcagttgacttgaacttccttcctcgttttatggcaatagtgggagtctcttttctaatggactcatatttaagatgaaagtttttgacttagtttccttagtgtggttttcgcatcacagtatctgaaagcatgtcctagctgctgcattcatcacaggccaggcaccaaaccgggtcaggcactcctgcggcgaaagtgatctcttctcagtactttgctataaattgtgctgctattgatatcattaccagtttttttttttatgggtctccagatttcagtgttgtgcagtttttttggcatcagctgaaaagccctatctgatgcccataaaatctatacaaaaagagaaaatgtagttgcctccaaaaacaaatgatgtaccactttcactagtcttattttattgagtattgatgggagtaatagcaatactggtaaggcatgtaaatcatctgcaagaaagactgtgtactctgggagaggagtttggatgccttgactagtgagacaagcatcttaccagatatgtccttgtgaccatgggttgatgttttcctctcaggtactcagcttccaccataccttccttttacctgtatctttctatcaaagtatttctttctgatggacagtttattttattttatttatttatttatttttgagacggaatctcgctttgtcacccaggttggagtgcagtggcgtgatctcagctcactgcaacctctgcctcccggattcaggtaattttccctgcctcagcttctcgggtagctgcaattacaggtgtgcaccaccacaccccactaatctttgtattttagtagagatggggttttgtcatgttggccaggctggtctcgaactcctgacctcaggtgatccgcctgccttggtttcccaaagtgttgggattactggcgtgagccaccacactcagcctgctgaccagtttagatgaaaagaattgctgctgcattgaagaggtgttattccccttacttctatgcacttacccagatagagaatgtggccctgccataggaaagtgtcaggtgagtaaaactagagtagaaataaagttcaaaagatttggaaacttcatttttctgggcttcagttcttttttttgtttgttgtgtttgtttgtttttgagacagagtctcgctctgttaccgaggctggagtgcagtggcacaatctcggctccctgcaacctctgcctcctgggatcaagtgatccttctgcctcagcctcctgagtagctgggactacgagtgcatgccaccatgcccagctaatttttatgtttttagtagagatggggtttcaccatattggccaggctggtctcgaactcctgacctcgtgatccacccaccttggcctcccaaagttctgggattataggcataagccaccacgcccggctacttcagtacttttattggctatctaaattagaaaactatctttttacaggtctacactggcactttgttgcagcccctcctccgtgctcatttagccagcaagaaaagggggagcagcttctttgaggtgacagtgctagaataatggttagaaggaaagtttctgacctatagtctttttgtaccatatctctgaaggatacacccatattttttcaaactcattcaacagttgttaaagttcaagataattgagaggtattgttccaggtgctgactagttgcaaagtctgttaaggaaatgtactacatgaaaccaagatgcagcctatactgtctttctatgctattaatatggattacctggaagaatgtgtttttttctacttctttctctcttctctaatttgcaagaactttagccacttgcagtttactttcatcatcaatgtaaaaaatttaccaacttacatgtattttaattcagagcattttcttctgttcatatttatcttgttatcctaagtgtcaacagtcgtggaaggagagtgtgttttttttttcttcaaactgtccaactgttttggtagcaccaaaggaatcccttagggcaaaggaaaatcgagactctgaaaagaccagccccctaaagaggagtctctttgcacataaacaggttatcgtgttaatcccagttcccttctccatgctttcaccccacccatttctctgagcactcctctgtgactttattaaacaataagcattctatatttctttctttctgaaaattctgagagagtatgaaatcctggcttttgcgttattttgcatgcgatgccattaatagttctttactgattcctcctttttattttcctctgttcacttcatgtttgtatctacctgctcattctagaaaccaatatgattttcattatcagcttcatattcatctttgtgaatgcccaccctattgaaaatctagtctttggtttctcacgcatatcaagacattttagattaaaagcaaataattctaacagtcagtgggctgaagccaagatttgtattttctctgagacaaatcatagcagttgccaaaacctccctattgctcttcttcaagccagaaatgagaatgattttaggtgtctgttttatgctccttctcatttgctttttatgtgtagtcagtttctgaattctcctgtgtcctcctccaggttctctctccatttctgcctgtgactgctgacaccctgttcaccttctccacgttgcccttctagcctctctgtgcgtgaggtcctctagttcttacagaatgtcttgtcagtgctttcaccgtgacctgccccccaccccgagagctgtccaggtgtcagtcaccctaggatgaaatgacaccaatattggtgacaagctggccttctggttatgctcaggagaatcattaaccatctttaaataaataaatccctgctgctactccccatacaatttagaacatgtgccttgtaacttttgatgtggggctcttgtttgaagccattgttgttttccctgctgcctgcatcatcatatgttatgtgattcttcaggaccttggtttcaatctctataactgcctatccttcaaaacccccaaacatattattaaatgacgtcacctgtcatttaagccatctccatcccaaacatatcctccaaatgaaaatccactgagagggagagggagagtgtgattataacaaagagacagaaacttatagaggtagcaccttacatttttgttggtctttatatcttgcatgattcattggtataccaatttcaccctttaactaatggctgccactttcaaaattgttttcctcaaactgaattagacgaccctcctcttggcttccttagtgacatttaaaggggacatggatcagtacctggaccccatttaataccagctgccccaccattaaaatagtgattactggagaattagaagatgcaccatcattcatagacacttgggaactgacttcactttctcctatgaggacgtggcttgactggtgttaattggcctaaattctgttaaaacctgacaaatcttgccatcttcctaaaggtctgtacagtaagtgagtgtgtaagtttttcctgaatgtggtataagtcctgaatgtcagtggagaatattctagtgagaattatgcttatcctgatatggcaagatcctatctggtgaggacatagtcaccagcagctacatacccaatcagggactcttctattcctgcatctagtagctttctctttggcttccattcagtttcaagtatcaactaaataaaatggggacttgatctagcctctggtgtatgttttcattggtgtgtgttctccaataagccacgtataacctacttgaacactttagtggtacctgcctttttgtgtgctggggtgtactgaaatgttcctcatttccacatttccttttctgaaagataacttgagagtggatgaacaccatgactgctgatcttaatatcctcatcccttctccctgtcctgatgcataagggcaacctcaaatatttaactgtgtgaaaaaaaaaaaaacccagcaagcagttctataagaatttatgctttaaaatactgaacaattcctattttatttgtgctttgcttccagtggcttttaaactatgattctaaggaacattgttgttccttgagctgaatctggggtttttgcctctaaattccaataataagtcttttcttaattagctgaaaaaaaactaatgaatagcaaaattttcccatttttgaactcccttctcacctcatctttatttgtgtaaaagttttgattcgtattgtaaggttatatttgttttagtgcaaggttagattttattattttaatttacaaattattccatgaaaattaacttgactttcaagagcctggctttttaagcagacgagataacacagctcacaataaataacaagtgctattacctacttttttgggggagggagtcctgtatgaaaattacataccagacagttccatgtcctatgcatgccttaatttatttcagcctcccatcagttctgttatgtgctatgttcaccaagttttaagtgatgagactgagtcacagagcagtgcaagttcaatgccacagagcaaacaaaggctcaatctgtttgactccaaaacccagggtcctctccactgtcctgacacatgacagttagcagtgttagtgtctaattgttactgttagatttataagcttcttcactgtagaggttatgtttcctttactccctaacactggaagcctctatgaaactggatagagttgtcccctctcatttcagttagctttccttgtacaatatgacttctactctaccatatattcaaggttttgcccaaattatcttcagtactcctaattacctgccctctgttgtgcattaggacttacctttctttgtcttttttttaaattttttatttattattattatactttaagttttagggtacatgtgcacaatgtgcaggttagttatgtatgtatacatgtgccatgctggagtgctgcacccaccaactcgtcatctagcattaggtatatctcccaatgctatccctcccccctccccccaacccaccacagtccccagagtgtgatgttccccttcctgtgtccatgtgttctcattgttcaattcccacctatgagtgagaatatgcagtgtttggttttttgttcttgagatagtttactgagaatgatgatttccaatttgatccatgtccctacaaaggacatgaactcatcatttttatggctgcatagtattccatggtgtatacgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtcaaagtgttcctatttctccacatcctctccagcacctgttgtttcctgactttttaatgattgccattctaactggtgtgagatggtatctcattgtggttttgatttgcatttctctgatggccagtgatggtgagcatttcttcatgtgttttttggctgcataaatgtcttcttttgagaagtgtctgttcatgtccttcgcccactttttgatggggttgtttttttcttgtaaatttgtttgagttcatcatagagtctggatattagccctttgtcagatgagtaggttgcgaaaattttctcccattttgtaggttgcctgttcactctgatggtagtttcttttgctgtgcagaagctctttagtttaattagatcccatttctcagtttaaggtggaactcagtctcttcctgacagccaccttcaaatagggtttagtagtttagaaaaacattctaggaagggttgtttaaaagtctgagataacagttcatatttaaagatgctcattattaatttcaatgtggaatgatttgcacttgttattaacacatttagagagaaagaaaaattagaagatactcaacaggagacattcaggtgtggagtacagaaaagccgagaagaagaaagttattcctgatatgtttaagaaagatctagccatcttaaagttttttttttttttttatgtttcaaatagctgatacactggtacaaaactgaattgtcatcttctaggatacactataatactatggcatattgattgaatacacaaacctgaatacttatcattattattactattattattactattattttgagacagagtctcactctgtctcttaggctggagtgcagtggcgctatctgggctcactgcaacctccgcctcccgggttcaagtgattctcctgcttcagcctccgagtagctgggattacagttgcgtaccaccatgcctggctaatttttgtattttcagtagagacagggtttcaccatgttggccagactggtctcgaactcctgacctccagtgatccacttgcctcggcctcccaaagtgctgggattataggcgtgagccactgcgtctggcatgaatgcatattattataaaattatatcttaaatattttagtgtgttattatttaaaaagcagatactgatagtgaatgaggactcataggcatgtgtctttaaatttgaagaaaaattacctactgtggcttttttaaagaaaatgtatttattacctaagaaaaaccatgtctctctctctctctcacacacgcacacatacactctctctctccatatatacacacacacacacacatacatatatatacatatacatatataaacatatatatatgactcagctgcataaaacaatgtaactaaattgttgatcgctaaaatgttcacttctgtgcctctaaatcaagttgattttgacaatgaggaaatgccttggtgaaccatgttggttttactttttgtttattttctcccattcaagattatcaacttgtaatttactggcctgattaaatgcttggaaataaaccagagttcttgaattttgccccattttcttaattttaaagataatgagttcctttgaggatattgcatttagactgacttgttcatttcatgttgctggtaattgaggggcttaatctgaaaggaacttagtcttcagattacctaagggacagaaaaagatactggtatgggactgggatcctactttcttaaaattttatggtactttttcttgcttctactcttcttgttttttttttttaaaaatgttttatttcaaagaacaattgccaaccgtacaattattggtatgtcagttggttaagaaatgtttgggatggaggtggagggatggtgaaaaatgtagtgatgtctcttaataaaaaggaaataaaggaatgtgaagttggactttataattccttttggcataggtttgtgtcctaagtagcatgttaatttcttatcatgaaagaagtttttttttttttttttaagaaaaggaagttctatctggacaaagataaaaaaatatttgcaattctatgttttgtacaaactaagaatgttaaagcacacataaaaaccaggtttgtaaataacctacaaagtggatgaaaaatgttcctttaagctggaatcgcttcagaggtttggggaatcattttcagaatattgagaaatgagaaaatgcatttcaactgttttctactcttttcccaaaagtacaaaaataaaacgctaatttttatatgagagtgattttaaaaccacaagcagattttttttgagatgtttctctgtagtggccaactttgtatgaagcaaattattttaggcctaattgcagtcagagcggttaggccgctggctctgctaaggttgaatttcatttgaactttctaatagtatgatcttttttcagaatttaataactgactcaaatatttaatagtggaagctttcattaaattaaaaagaaatcaggatatatttttagaagaactaacttattttctttatcagttctatctactttaggagaagaggaagagaatggaagcaatctctttgtgtacttaaataggcattaatgttgtaaccccagcaaataatttattttggtctatatcatcattcaaaagatttggaaagcaccaaatggcagtaataactatacttccagctctgttgaatggcaaattacactgactgtgtgaatcccttcattcgtctcctggataatcattctttttaatactcacatatattttctagatcagtttttagattgtacacagtcaacttgtgcattgcctaacagtttctgttaaacacaatggcttgttttgaaatgcaactggggaaagatgagagttgaaagattttgtttccatgtgtcaacctataaatagatgacaaaagatcattaaatggattaatttacaagcatccttagaaatagaatgtttttacataaaagcctgttgtaaaccttttaaattaaagtgcattgtgtcatgcactctcttcaccccagggttcttttgacctctcacctctcactttgtcttccaggcactccactgctggtgaggagaagcagtgacccagtgccaggcccacctgctgatacccagccaagcgcttcacaccctggtggccagagtctgaaactggttgttccagtaggtatcctgctgcttgtagttctaatgaaagatcaaagtgctgtacccataggttaagtgggactttgcagttttaaacacattgataactagatagagatcttttgatagtatatatagtattagttatactaatagctagtatgggctattacttgtatatagttatagcgatagctattacgtatatggcactgattatgtgccaagtactattttacctgttttatattaagtcatctaaacttccacatcaaggtaagcacatgtttttatctccatttaactgataatgaaattgaggcagaggaaggtttagtaatttgtttaaggtcacatagctaataagtggcaaagcaaggaatttcacccaggtgttctggctccaaaatccttgcttctggccagtacactatactgttacatttccttcatcttccagtttcgtaatgtccaaggatatcattatatttttgttgtgttaacccaatgctttgcaaaaccataccatgtgagtggtgtacattttcaagctcccaatatcacgaaaatgtggtgccaggattggatgtgtagaactcagcattcagattgaagaaaaacaaaatcattgaccaaaagtgcttataaccagatatacttataactaataggttaagtggagaataatttcctgaagagatgatattctccttccatataggactgtgggatcttcctgctaaatcctcagttgctttgaagagctgtaattgtgaataatcctctcagatagcctgagaattcaattttggctaatgactatataccattgcaataggtaatcttcgataacatagccatattaaaaattccctaaaagcaagactctttctcactttaagtctcactgtctataacgccttaagaaaaaataaacacatcatttataggtatatacggatgctgaaatgagttaaacaggtttttctgatttggtataaaatattcttatcaagaaccaatgtcaatgtgtatgagataggagtcactatttgaaatcattagctctttgctaatagatttgtggcaatattttggcatatttcttttattattaaaagaaagcaggtgtcttgaaagtattttagatgtaatgtttttccactaacctatttaaaactctatccttctaaggaaatatatttgatggaacattaataaaaatcaggtgtatgtgttctattttaatgtacgtacaaacaaaactggtatgtggtatgacttttcttaaaacacacactggttgagaccatgttgagtctaattatgttggattgggggaagacagctattcagtgagagaagaattacataaaagagcagaactacaatttagttttcattttcatgatgtctgtgtgtctgtgtaccctaaaacgagagtgtgtctgattaatgtgttagcattgtttgcatggagaaagtccctgtatttgcccattttcacactgctctaaagaaatacctgagactgggtaatttataaaggaaagaggtttaactgactcacagttctgcatggctggtgaggcttctggaaacttaaaatcatggtggaaggggaagcaaacatgtccttcttcacaaggaggcaggagagagaagtgcagagtgaagggggaagaaactcttataaaaccatcaaatctcataagaactcactcactattacaagaacagcatgggggaactgtgcccatgatccagtcacttcccacagggtacctcccccaacatgtggggattacaatttggtttacaattcaagatgtgatttgtgtccggacagaaaccttaaccatatcggtcctccaatgtttatttccatgtttctatcacttaggctctgggcttaaaccaattaagatgacatcaatgttactttccctagaggaaatgatggctactgtccatctggtaaatgctgtagccccaccaaaatatgacatcagtgagttccaagttggggtatggggcagaaagacatattattactagcaaagatgcatctcataattcaagaataaatgctggcgcccaaaatccttgtgccttacttatgcaagtgatcaaatatgggctgagtccctgtgtatcaacagtgaaaaggaaacacatgtttcttcctttcctcatagtgtcctctgtggatgatggagtgcagaccacagacccaaaaaggagagtctggtccttgcccttgcatggaatagtggcacatcttaggtgtctcttgcttcagttgtaaaataatctccatgaatactttaagctttaacatcccaaggtacagacattgtgccttatgtatctttatctagggccaagtacatggaagatgctcagtgtatatgttttggacttaggaatgcaagacacgtgtaagtctaggaagagtcctaaaagttcttagaaattaaccagctaattaattattattaattaatatatattaatatataaatatataataatactaattaataataattaatctgactcagccattctctccgtttcccaaagagcatctaccagggaaatgtttatctgctccaaggtctagttcaccacaggcaagtgacagatagtttaacttccctattatgcaaacattaataaagacacttaggtgtgtttatttttactagaaggaaggtgtgtgtgtgtatatatgtgtgttataactgttaatatatccttgcatagccaaacttatggaatgtttagatctacagtgtctagtttagtagccactagccacatgtggctattgagctcttgaaatgtgtctgatccaaatgtaaatgtacttaaaatttaatatacacactggatttcaaagactgaagcataaacaaaataacataaaagatctcattaataattgttatactgactatatgtggaaatgataatatattaggtatattggcttgaataaaatatattattaaaattattttcacctgtttttacttttttttttttacatggctattagaaagctgaaaattctatttgtggttcttattctgttttattggacagcgcagctctagacagaagcaaaattgggtatagcatgcatgagatagtttgagtcctggggaagatctttgagcctcacatcatctcttgggcaacagtgcaattcggtttgcctggggcagtcctggttagtgcccgttgttctggcataattattaataatgtcttcacaaactgtcagaggtgtccatgtatggatgataaattacgtggcaccctgcatatagccctacgctcacttttattgttcgctcactgataagagaagcagcctttcaaggaaaccttgggaacataacaaccacaactctaacactggtaccctgcagaggaggttctgtgtggcaaggacctgggactggagctacggacactgagacttcacattcttttccatctcttggattttgtacttggcgcttccttcacaactccagctacaccattcttgattcctatgatttgataagtgatggtgaattcggggagtgtgtgataatgtagccatgtgtcaactaatatgaaaaataattgcttaaaaagccatgttcaattgcatttcagtccaatatccacaggaagaaaaaacaatcaaaatttccatctcttcaagagtgttcacgtataagtaattcacagatggcagagccccaggtgggttatgttcagtcattcccaagaaatgaaacttacttataacccacagcataagaagctgtaaggatgaatatttgacacatttgattatgttgaaatactgcctttaaaacacagttgatgactgttatttttagttgcacttcattaggcttactgtagagggaagagttttcattgatgcccagagatgtgtgtttttcaaaagttgcaaaagttacacttgttttctagctgattaaatttattacaaattggttatttaagatgtacactctcagacatgctggagttttaaaaagggcttaaattagaaaaatcagattctctgaaagcttcaaattctatgtatattgagaagccactaaatctggtatttgttatttaacaccagacacacagcaaagaaatttgtttcctttgttcctcttttggtcaacatacctaattatcagaatagtacaatcattaatgtgcaaatagtaataactgtttatctttcaagacagtatagcaaatccaactctattgactgcttttgaattcagaaagagaatcctagaaacaggatattttggtgagagtctgcttgtgggacttcttaccttccttttcttgattgtaacctggtgttcttggcttaagggcatgccataaaacaaggttcttgaaactgatgttctcaaacttgcaatggaacagaactctaaaacagatgtgatttttttcttaatatccggttaactagcaaggttgttttgtgttttaatgactgtttatggtttttaatttaacccttaaggcaaattgatcctgcagggcgagaaaattaaaaactggattcctgaaaattataatactgtggttgttctcagagagtgaatggcattatttgttctaaaaccattacttgtcttacatcaccaaaatacttgacctatcttttcaaagtccatgtgtattttatatatatatgtatatatatatatatatatatatatatatataaaattaaaaaaataagctggcagatttgggggttgttaaattagaagttcatggatagatttcaggggggtctgttaactctctgaagttttatgccttagccaggggatgggggtgtgtttcatgaaagagattctattacttcagattttaaaagaataacaaaaaatcaaccactgtttgggggttagattaaataatgtagggaagccactaattctcacagtgagcagaatgagagaagttaagaagtagagaattatcacttcctccctgcaaatatgtattaaataatgaaggttagttcatcatattatcacctgtttacatgacacataatatgtaagttcaagattttaagaggaatagaagtttttgcattttttcattgagaggctaaaaataactctttagtcagtatcaacacaattattagcaactctaagattgggggtaaaggacacagaccggtggagggaaaacaccctgaggggaagtgtttccagttgtcctgtgtgttctactgagacaagaagggaaaatacagtgttctttggggcttttggtatgttatcagtgaggatagtggcaggtggctgctagtgagagtgcatttttacagtgagtggctgcattctctttaagtcttgctaagataatatgatgacgtgttgatttgaggaatttcccctcatatgtcacacattttcccatgtttgtcacatatattgaaattattgtcagtattgcccctgtattaaacttcctcagacccatgaaagaaatcaccgagatattacagagaaattcaaatagcttgatttcagggttaaaataattgatcgccactgtgatgttagaggacttttggttgcaggttgctgactatcaaaatccaacataaggcagggtacagtggctcatgcctgtaatcccagcactttgggagactgaggcaggtggatcacctgaggttaggagttcgagaccagctggccaacatggtgagaccccgtctctactaaaaatacaaaaaaaattatccaggcttggtggtgtgtgcctgtaatcccaagcacttgagaggctgaggcaggacaatcgcttgaacctgggaggcagaggttccagtgagccaagatcgtgtcactgccctccagcctgggcagcaacagtgaaaactccatctcaaaaaaaaaaaaaaaattccaacatataacttaccaaacattctgagtgaccaaatcatatttttctgtagaatcaaatatctgtagaaacactggaacaaaataaatgttgtgggtactgatgtgtattagaaggatggctctatccattgttttccaaagaggagagatggatgctgaagagcaaaacagggggagaaatagcatgtaatatactactgcattatttagagatactgaaactataaaaggtttttattttttttccccaccctgacacagtgatttaataatagttctggtgtttgtaactccagctgttcacgctgtgtgctgataagaccagagcttgaagacacattgcaacgatggctttcatatggctttgtttttaagagataaagctgccatccgatatttcatggggccaaatgtttacttcatttggcaagtttaggcagcttaatttttaaatcagttatgcttgcaagactcaagtttcaggtaggaaaaaacctgaagcccagtttactctgcagcagagtttttcaccatatctcagcagaagatgttaaaacaaatctggattgcctgaatgtctgtaccatgactaatcaaggaaactaagaagtgagatccctatttaggtgtgtgctccccgatttttcttcttgggtcttagtctaacactgaaaaactctaaaagaaggatcactatttaggtcaatttcagaaattaacaaggtaaccatgacatgtcttttatatatatatatatatatatatatatatatatttttttttttttttttttttaattatactctaagttttagggtatatgtgcacaacgtgcaggtttgttacatatgtatacatgtgccatgttggtttgctgcacccattcactcgtcatttacattaggtatatctcctaatgctatccctttcccttccccgcaccccacaacaggccccggtgtgtggtgttcccctttgctgtttagccttgatctgcacacaatgaaaactgaatgggttttgttttcatgtcaaaataaattgactaatcccttagatgcccaagatttctgctgtgtgctttctagaaagcctaagacatggttcctgtcctcaagaaacttacaacctcgttacagagaacacatctaaagcagttaaacagccctagcagtctgcaagcatgtatcagattatcaaataatacggttttaaccatcaaaatgagtggttttttttccctttagcctgcactttggtactctacttagccttcctaacccctgaagggaattgccatgtgcagtatctctattagctgttatctctctgaaatataatgtttacatgactgcattttttcaagactgtgaactcttcagaggcacaggccagtgtattcgtttttgtattcaagcccccaggcacagtgcctggcacttaagacgttatcacaaatatatgactagatgataaaaatcataaaatctagaatcataaagttagtaatctttgagttataactttgtaattttctaataactgttcaaaacatttagaaaggtcttgattagaagtttctggataatttcttatatccattacatctaaagatttctccttctaaattttcctcctagtccatctcccttaagaaatttttctaatttcagttgatttggaagaaaataaaaatacttctggtatgtgaattaattaaaaagaaagaacatttacgacgtgtttcttggcaaagcactgataaacatctcaatctcactttcacaatatgggcagatgtaatttgacagtgttgtttgaaattttgtaaagatgatgtttaaagtagttttattttaaagaccaagatcctgtgtgtgattgcatcaataactctgtgaccctaagaaaattagttaaatagtgggtgatttcctcagaaattctatgtaatggaagggaaataataaatagagaaactgtatgaactctagttgttcttagggacttatccatccaaactagtgacttcaagattccagatgtgaattattaagttggttggtatgagttcaactttagatttcattttaatgtctcagtgttcataaccagtcatgcagtgaggttatctttccatccaaaacaccaataatcattttttattggtcaaatgaataatatcaagaaatattttttaaatgccacacacacaaaggcagcagcgtaaatgcctacatatgcgtatgtgtgtacccttaccctctttggagggaaagctactacctaaatttgaaggctaaagtacatatagtcatgttatcgtaaagtgaaagttaagggtatgggttgtgtcttccataggttctgaacttctgtatgtaccttccaaattgtggacatttagtaaagactgatgacataggaggaaagggttaatgagagttcaccttgagaagaagcaagacaattggccttgggaggagaaggaaaattatttctttgagcatggtgtgattcatagaactctcttacgataggggacgtttttttttttatcacagcataaacgcttctaaagtacaagtttcaatttggtttctgctttcaaaatcttgtcatacaatgacattgtacagacgtttaaaagagttttatttcttaggagagtggcccctttcctaatagctctgtactttaaaatagaattcccatttagatgaatcacattttaaaaagtagctactgtgagtgttttacgcttgtggaaacatatagcatcctcataagcagcatgagagcctgtcaccatacagcttttgatgtctgattaaatgatcgtagggacatctggagggagttagttttgaagtaactggtgtgaagcactggagaatccgaagccttctgacagactaaaaccattaaaaaaaaaaaaattgctacttttagcaaatcttttttaacttgaaactggctggaaattttcagactcacatagccctgatatttctcaacagatttttcagacagaactctctacgttttaagcaaagaatggttaagtagcatttgttgcaaaaatcataaaggaatatcctttgaaaggaaaaagtagatactgaaagcaacagaagtcaaaattgatttacttaaagaaattgtctcctttttatctgcctttaattttaatcagtgtattttaatttttaaaggacacaaacacacacacacacacatacacacacacacatatatatatatatatatatttgacattcagctatattcttatgaagacccaaaggcatcaaagcgattgatattgatataaggttatggcatgttttgagcacctgtcaaaagtttctaaatgtcttgagtcaaaattttatttgcatagtctcataaaatacaggcattgtttatttaaaggttgtataatttgtaatttgtccaccgaggttctcctagtatgaggtgatttcttattgtttcatgaataaaattatgatatacctacatatatgaatatatttacaaatcctgaccttatgtatgtatatgtgttatatacatatacatgtgttatacgtatatgttatatgtatgttatatacatatacatatatacatgtatgtattcgtatatgtatgttatatatgtatatgtgttatatacatatacatatatacatgtatatgtgttatatacatatacatatatacatgtatatgtgttatatacatatacatatatacatgtatatgtgttatatacatatacatatatacatgtatatgtgttatatacatgtgtatgtgtatatgtatatatacatatatgtgtatgtgcatgtgtatatatacatatatgtatatgtgtatatgtatatatacatatatgtatatgtgtatgtgtatacgtatatatacatatatgtgtatgtgtatgtgtatacgtatatatatacatatatgtgtatgtgtatacgtacatatacatatatgtgtatgtgtatacgtacatatacatatatgtgtatgtgtatacgtatatatacatatatgtgtatgtgtatatatgtatgtgtgtatatatacacacacgtgtgtgtgtgtttgtgtgtatgtttatatacatctcctgccttgaaacccttgatcattctccactgcattcaggatgttttaaaatttcttggtatggctttttaaaaaaaagacttttttctcttttttaaattgtggtaaaatatatatatttactgtcttaacaattttaagtgtatagttccatggtataagtacattcacattgttctgcatccatcactaccacctctctccagaactcttcaccttccaacactgaaactctatactcttaaacagtaactccttattccctccttttccttggcaaccaccattctgttatactttttctccctatgattttgactactctaggtgccttatacaagtagaatcatgcagtatttgtccttttttaattgtatttgtccttttttgactggcttattttactgagcataatattcttaagcatcatccatgttgtagcatatgtcagaatttccttccttgttaaggttgaaaatactctgttgtatttgtatacaaatataccacattttgcttatctactcatctcttgatggacacttgagttgcttccacattttacctaatatgaaaaatgctactgtggatacgggtgtaaaatatctcttccagactctgctttcatttctttccgggagatgtccagaagtagaattattggatcatagggtttattctaattttcattttttgaggaaccaccaaattcttttccacagaggtgtgtcattttacattcccaccaacattgcacaagagttccagtttctccacatccttgccaacacttgttggtttctgttttgtttttagtaatcatcctaatgactgtgaggtgatatttcattgtagtttcgatttgcatttccctaatgcttagtgatactgggcatctttttaagtacttattggccattcatgtatcttctttgggaaactgtcttttcaagtcctttactgatttttgaattgtgttcttcatttatttgttgctgagttctaggagttttctatatatgctggatattaactccttatcagatatatgatttgaaaatatttttctctttctttacattgccccttcactctattgtgtcctttgtgcagacatttttaattttcatgaagttcaatttttcttttttttttttaactgtgctttttgtatcacatccaagaaatcattaccaaattccacattatgaagattttgccttatgttttcttctaagagttttatagttttggctcttaggtttaggtcttcgatttattttgagttaatttttgtacacggtattagataagggtccaacttcagtcatttgcctgtgaatatccagtttccccagcatcatttgttaaaaaggttattctttcccccattgaatggtcttggcaccactgttgaaactcatctgaacataccttagagggtttatttctcagtccttgatgtggcttttaaaaacttaatcacaacctatatgcttagctttatctctagtcacactgcatgaaggaccctatgtatgagagttataatttttcacatgtgcaaagaaagcttctgtctgtgggtctttgcccagatgtttcttctgctggaagaatgacaaatatcatttgtctccctttctgctaatgaatgtacaggtacccttcaaaacttagtgtaatggcctctttctttactgatccttatccacaccctttctgctctggacagaatttaccacttcccactgatggcatgctggaatacctctagcataatttgttccaccccatgttatagttttctgcatatgtctcctttatgaatctagaaacttgtaggtggcttgaatttccttccacattagaacacggcatcatgcccaacagcagcatttatatattgtttaaggaatgggggaattttctaatcacgattgctcatttcaaccatgaagcaatttaatttcagctttaatagcgttaatttacattctacttctgctagcgagtagccacgtaatactacccagcacaccttggaggagggctacttttctctttcaattccaagttcatgtcagtcgtggacacttaattattaatatatgtgttcaaatatattatttcatcccatgaacatctgcaagttcagctttattgcctccattttacagacgacgaagttcaggctcaaacgagttaacttatttgccttagatcacagaactaacaagtagcagtgctaggattcagatttatcttaacctgcagtatagactcttcattctacccctcaaatcaaatgttagccttgagagtagcatttgtccacattatgctgccattgctttgggcaatcttcctttgaaactgcctcaaagccagtttatcagcccctcctcctaaaaaaagtcatttcatcattttatagtcactatttttccttcaaaaatggtggcgttctatttgatgccaaaatctatattgtacagttagtctcagactgtttacacaatttagatacctctgtgaaggagaaaatttttccaccacaaaggaatttaatgcaggcatttaagacattcatattcatagaagaatgcattcagatgggctgaaagcagcagagttttagaacaattttttgtttattcagttgcctagtgattaagacatgtaggttttgtccctgactcatccattgactctttgtcaggttaagcaagtgtaatttagttctgtgtctggaaaaggaagattgtcttctatattggccacggtggaattgcaaggttaatgccttctatcttgagtacagcatttagcagactgtgggtgcttaatatatgttaataatagtgataataatgaatgttgataattaaaggtcttttataattactaaattttctatgtgtgttaaatataattaaagggaaatgatttaaattaatatgcatacatataaaaactagagctagccacagcttttatttttagcttctcaactaacgtcatgaatgtgaatcttatattaagaaattcaattatgatggcagtttcactagggtcatgtatagagaacccatgcatggttctactctggaaactagaaaggcaatttgagttgaaaaacatgggcatgaatgggaagcttcaagggactttagtggttggagcttgaccaaatgaagttgtgcatcggatatcgttattatgaagtatctccataatactccctttgagttctactgggagtcagaggtaccttactggaagctgggcaccatcccagaaatacagataataaacaagactgcctggagggtctatagaagatataggtagaataaaggaaacagtaatcataaataataacccaggaaattcagcttggagattcattctttgaactcaaatgctcagggttactaaaggttattatttcttaaggttctggcatggcagtggaagtgtgaaccatgagatgtggaaggctagagtggttaagaacatggactgtaaacatgactgcttggttcaaagctagcttgaccactgactgatttgctggtcaatttctgtcaagtgtttgttttccttcttttggtctcacttttctcacctataaagtaatgataataaaagtacttacctcacaggattgtcttgagaaattgatgagtgattatttgtaaaaattcttagaacacatggtaagcactatgtgtgtgtgttaaatacatacgtatgttggatttgtgccatgcatggttggatagaaggtgtaggataagatagactatagaagtaagttggagagtaatctgcattaaaagctgaatttgatcatctttagctttaatttacagaaggcacttagcacacagctagcaaaaaatattgattccaaagtcgagcattaaatgcatactgagtgtcttttgcttatagagacccttgcaagttcttttaatttcaaaaaaaaaaaaaaaattcctccaaaggcaagttcttaaggcaatattggaactacatcaatgaacccagccctggctttcttctcttgatatgaaatgttgtcttccttataattattttgtttaagttgaaaacctagaaggaaacaggaaaggacggattattaagcaacaagccagtttcaaatggttcaaacctgtcatccatctcctgaggttttctggaagcccccttcccttgtacgcttctctaatttgctagtcctgctgcctttatcttgactcaccttcctcacttgtttacagggtggatatcttctcattcattaagacaaggttaaaataccacctcctttttctatcccttttctgaaactctacttccaagcagaagtgtagtatttttttatgtaaatattttatgtaatatttttaaagcaatgtatgataatacgttcgttgaggtcgtaatgaaagtatgttattggagaaattagtgtttaatataggaccaaaataacagaggtcagacatgagtcacagagagcacagtgtggatgccctcagatcacacacttgttcctggactgaggcatgccctgctgtgcccacagagctacctgttccctcctcagttcctgctccccgctcccacccaaacccagaaagagtgatttataattctgtcacaaacagtaggaccactcttatttgcatttgtgtgtctctttccttcccttccttcccttggagtggaagtgcactgaggatggagaatgtattgttttttatctttgcaggccagcagtagcatgtggtaggtatttaataactgatgattgaataaatgaaagaatgcataaaagaagtaatggataagcaaatgaaaagaaaaaaagaataaattagcagagagaaattaagaaaagaataaaatgtttttaaaggtaatgtacagtatatttttgtatcttttgcagtgctcagtttttaaaaataaacaaatgtattttaatttattcagcatgaaatttatttatatcttatatctatgtctgtataagaaaataaaacagagcagatacaggtctctgagagtattatgacatttctgcatttttaatgtacttcaaactccatccttccaagtcagcttctttcattttaaatatagttgcagtgggggtgagggagggggtttgcttggaaattattgtattattaattaatctattatatatattcaactttagtctctggtcagtgttttcttagcaatttgcaaatatgcaattatctctgtatatttgggatagtagttacagaaactaccaaagtaaccgtttaaagctaaaatttggaattttatcactgcaaacatttatctttgtgttggggacatcataatccttgtagctattttgaagtatataatgtattaaccctaatttgatcattatacgttgtatgaatgtatcaaagtatcacatgcaccctcaaaacatgtacaactatgatgtactaataaaaaatataaaaaaataaaattttatattttaaaaaataaagtcaaaatttgagttttcctggatttctaaatttgtttgataaattaatgaactagaaattagtctttgcaaggaccaaaggatgcaggtagaaaaatgcttaggagtttgttatgattcaggtcacaggaggcaaccacccaaattaccagcatgattcctttatccgtgtaactcagcagttgattcagtaataattataaaacacccacaactacacttattttgtgctagttatttttctaagtgctttaaatatattatttcatcgaatcctcttaacacccccatgaggtggtcccattgatatttctgttgataaggaaatgaggtacatagaggttaagtaaatgtcaaattgtttagttgtaaagcaaataaatggcagaaatatttaggaaataaaatgtacatatcttggataagggaatagaacatataagagatgtcaagaataattcccacttttcatgtttgggtagtaaagcatgtaggtattctaccaactgacatacagaacataggatctgtttgtaggcaaagatacaagtagagatgcttggaaataaaaaaaaacgcatatccaaactttgaagtcattggtgatttcagaataagaccagtttctataaagggaagtgaggtaaaaactgttctgctattagttggaaaagatactggaggcaacgcattgggaacagccctgtggaacttataatcgcattgaggagaacatgcacaggttaaattttataagctaataacaatttaagaactaattccaagtggcaaaatacaatttaaaatggttcagtggaaaaacaagggacttttttatttttttatttttttgaagaatggcacatgtaattcatgagagtgttgaacatctacatcttgggaagtgagagatgcagctgtgcttcaggaaaaagtggaatctgagatccaagcaattgcttctgcttcactctttcatagatttcatcatgtttacctgtttacctgcccactgtcttcctccacattggggagacatgcgtggctgctaagaactctgcttttcccatctgcagagaggaactaattccttcctaagctttagggaaaaaaagtctgattggcccagaatggccactttacccaagctatggcactttaaatcaaccatggcaatgggggtgtggggaatgttctgcagacatttgatgtatgatgccagtgggagaagagcagttttcaccatgtggaagactgcgcagacattcccataagtgtatacccagagtcaaggccaggtatgaataatcagtattggcagtgagtgccgtaagttcagggaagaactcagtgtcatgtggtcaagggagcttcaaggaaaaagatggcttgatgtggactttaaagaaagggtagacatttgataagcataaaaaagtcagtgtgcaaattcacagcaacaaagatgtgtaagtcatgttgggtagaggaagacctttctgggcagagttaaatttgaaagcactgtttctcaaagagttatcaaaagaccccttccctcagaaacaccaaatggggttgcagaaatgctaatttgagggctccaactcagtctgttgaataaaaatctttgggaacaaggtctgggaatctgcatcttagacaaatatcctttagctattgcagtctccagtgtaataacagcatggagtgaatagaggttataaagaaaggctggacctggcctcaatagggcaagctgcttaggcacaggaagatgaggtcagctatttccacattggtgcttagagggaagaaacccttagaagcaccatctttatgaatttattcaaagatgccacagatagagtgagaagattacaatatatctgacaaattaataaacactggagttgtgaaaaacaactgtagaattttgcatgaaattgtgaagttgtaaaaacagaaacaaagtgagacattctgttgacgacaacagtagtgataaaacacacacaaaaaaagctttttgtttccatagaataatttcacatggccataaagatatcctgacccaatatataatttaaaccctaaatacgtattttttatttcattctgtgctatggtttggttctagtttgtttgttaccatcaaaagtcatgttgaaatttggtccccagtgtagccgtgttgggaagtggggcctagtgggaggtgtttgaatcatgggggtggattcctcaagagtggcttggtgctgttctggtggtagtaactgagttctctctctggtgagaatagattagttcctgcaagaatggattagttcccaagagagtgggtagttataaagccaggatgcccaatggattttctctctctttgcattttttgcttctgctttaaccttccctgccatgttgtgatgcagcacagaagcccttgccagaagccaggccatgcccatgaactttgcagcctgcagaaccacatgctaaataaatattttaataaattacccaatctcagatactccattataggaacacaaaatggactaagacggcccccatttattcatacttattattatcagcctcattgaacaggtagacaaaacaaccacaaaaacaacaaaaccttaccatctccataggtaagggaattttgtctcatataggacacagaaggaataatttaggacacagactctctcgggtctgggaaagttaatgtatctcatgtaactaactgacattcaccaaacgtaagaacagataaagtttcccccgacagaccctgtgcatattttctgctctcaatttggctgaggtactaatcttaatctgattgtgttgaacagaacaacccacccttttagcatttctttgtctggcaggagtcctgacatttggtcgcatggttaacatcaaacacgaagagaaattccttctggtaatacagttaagataggtgcctttttcctgaaagttagcaatattctcactctcatggaaggctgtactgatggaggaaccaatgaagcagaaaactctaaaccacagataattcttgttatttctacctgagttgaaaatacaatgtgttcattagcagcaagtgtatactgtagtctgacaactgggagacctgccttctggtgtaagcttagagactgaattgtgtggtcttggagaagttacttaacttaccagggacagtttcttcatctgtaaaatgagaaaggtggtatagttaaaatgggagctcttgtgtagaaactgataggaatataaactggtgtaacacatttggaaatcagtgatcttaattctcaatctgtgaatttgtaatgaggaaacatgttttttctgctttttttcattttgacggtttttcttctaattctaaatcatctaaataactgatgacttaaatcatcatttaaatcatcaagttatttaaatcatcatctaagtaacttttattttcagtttttcctcatgtctttcaagtgtccaaaaataccctggatgagttgaaactgacttggagtcagcttcccctgaatcccatgcagtgcgtgaggggaagggaggttgtgcacctgaacaaaactgggggatctaatggaaagggaagtaagatgaaattatctcagtagaaactaacactctattttttggtcaccaaatatttctttgcatcttgcatccacttttactaggctttttttttttttttttttttttttttttggtttataggcattggaaatattttccccagtccataattggtttttgtttttcagagaaagggtctcactctgtcactcagactggagtgcaatgctgcaatcctagctcactgtaagaaactcaaattcctgggtccaagcagtcctgcctcagctcctcagtagctaagactacatgagcatgtcaccatacctggctaattaaaaaaatttttttgtagagatagaggtttcactaggttgcataggctggcctcaaactcctggcctcaaaccatcctcctgtcttggccttccaaagctctgggatttcaggtgtgagccacgatacccagcctataattgtttctttaattttaatttgtgttacagataaattttaaatttcagtgtttatgcttatcaattttcttttattattatagtgtatatgtttaaagaaaatttctaaaatgaattacaatattttccaatgttttaagttggaatttaagcctttaatttacctataaattttttaagtggtatgtgtgtgggtctatttttattttaatatttggcatgagaaatcagttatttcagtgccatttaaaataataaattttgtttatgaaatgctatttctgtgtttatttagatgatgctattttttcttttatcactgaaagcagcgtaattccatgaatacattttctaatactcagccttcctttcatttctatggccatttatcaaacacctttggccatgatgcattctgttttatatattgctgaattcagtttgtaaatatttcacttgtgacattatcatccacataactgagatagttctgtacttttatttcttgcattgtccctgtttagttaaagaattaaggttcatgctttacatgccctacataagcctcacaaaatgtgtagggaaacttgattgggttttctcccattatctgaagcaatttgtgtttagcattggaattatattttctatgaacacctgttcagtctgggactgtgcgtatgtgttgtttctctgtttggggatggggcagggtataggagaagatgacttactcagattttctgttttgtctagatgaatttttgtgtgttgccaatttttaaaatgtccagaaatttatttgtagtattttcaaatgtattgtcatagtcttaagatttcaaagtaatctacactttatgtgtagttatgttctccacctaaccccaatattgctaatttgtacatattctgtttttaatttttttctctttggttaatcttagtagacatttgtctatactattagtttaaaaaattgtttttaaggaaacagcttttgatttagttaataccctctattctttcattcttttccagtttattaacttttgcttttatttcctttattttagttttaagtagcctaagaatagacaaggaatgaagttatttttttttttaccttttcctagcttcttgtatgcttaactcatttatttgtattttcttgttttacatgaatgcactgaaacatgtttgtttctaatcaaagtacagctactactatagctgcatccgctaatttttgatgcacaatattttcatttgcctttcatttctaaatgctttgatttctgttgacttcccctttaccgtatgaattatttagtagtatattttaaattttttgaacatatgactctgtacccattgctaatttaattgcattgtatacagatcaagagattcatataatgctgatttcttgaaatttgtggtgatattttgtgatctagtgtatgattaacttttgtaaacattcaacatgtagttaacatgaaaacatgtctcctactttttgctatatttacctgaagcttgttcattttgttcttcaaatattcgatatacctaccttttttttttcttttactctatctgccagtttctaatagaaatgtactaaaatttcctagtgtggctatatatttgtcaaattctgcttttcattttctgaggttttatcttaagtgtgctgaggctgtttttagttgtctacagttctctatccatattagtaatttttcattaaatcctattttgcctgatacatttgcaaccacttgtttgttttggttagatttttttctggtgcatttttctatccttttattttaaacttctcagtgtggttttaccataggcatgtctgttataaggggcatatagatagattgtatttaaaaatccagtctgataatctatgtatttaaatagattagtctaatctatttaaatgtattgtaattactgatctgtttggttttatttctgaccaccattgaagtgacaggttttccccaccttttttctctttgtttcaaatctacaaatgttacttgtattctttgctcattattcataaattttagcatatatatattttatttcataacacagaaatttgaagtagattatacttactgtgatacaacaagcagaattgactgatacaactctgtggtcttaccctgggttgtctgaaaaataagctagctaggaccagagccctcacccttcaccctaagtagaagaagccgcacttgaactcagcttcaagggaccagtggctccctggcaccagcagcaggcatagtaaatttccaccgtcccaaagatttccaggtgtgaggcagctggcctttgtagagcacctcagtaaagagctagtatctacactctacactgcctcatgtcaagattcttgtttaatcccccactatcaaggctactcttatgctcatcctatgaaaagtaagagtaacagtttgtgtggcctatgtcctgtgataccccacccttggcatgtttagcagaacaccctggtctctgctcagccttccttggggtcactaggaacctataccttctcttcttcctgtctcctggcttaaatttctccaagcctgttccttaacccatttgctatgtgattgtgaaatcattctcagccctgttgcttagtgagtggtctgcaaaaggaccctacttgcaagacagaagctatgacatacaacccctaaaacttaaatatgtatctaaaacaataagtatttttaatattgtaaatataacactatcgtgccccatgaaattagcagtttttaatatcaatacttaatccacattagaatttccccagttctccagctgtttttttaaatcaggatttaatctaagactaaacactgcatctagttgctatgtcttttacatctctataatctttgttcatgacattgacttgcagaaaaccaaccagttgtctctgagcaggtcattttgcatgaatttaattgcttccctgtaaagttgtttgaattgttcctcttgtccctgtaggttctgttagctgaaagtcgtactaaagccttgcttaaatgtaagttaaacattttagcaatactatatcataggtgatatatagcaatacttcttatgtataagatcaaaagatacataataagttttgttttgtttttcgccattagtaacctaaatttgattattgggttaaggtggtgacaaactcatccatccattgcaagcatcaatatgttctacttgaaacaataggtaatcatttgtgaactaactttgtcactacgtccagttactgtcaatatttttataactaacaattttatgctgaaatactaatttcattaagttttgcagtgtaacagtttttaactatttcatttcttctacatttgctcgcactcttttataatgtagagctttccacagctttctataactggggctatttgattacctggaaataaagtgcatactgttaatgtaaaaaaaaaaaccacttaatttggggttttaaatggccagttttcaaagtaaatttgtttcttggaagtgtcaaatgatgacagaagatttttctttggcttctttcttatcactgtggactcagcctttcataaatacagtgtgtgcaaatcacccatgatctttctttctgatgtctcagctttgctgagtagaagctccttcagactagcttctgggttcttgacatgattgtattaattcttacaagtttccttcctttatggaacagcaagatttcccaagatcactatataccttcattgccccacacttgccgccattcttctcgccaaagatctgtagagaatggtcctagaaaccaaactccggtcctaggtgtgcatcttgttcctgagaacaaattacttctgtatcatgttctggccagacttagggaaaatatgtgaatatatacacttaaaatccagagttgaaatcaatgtctataattgttttatcactgagtttaatttctttgattttctaattgcttctctttcaccttgagagtcttgagtgctattaactttaatgtaagtatggatttgatttattctacaatgtaaatgtttttaaataacagcactgctgttagtacagacaacaaaagatgtaccatcaaagcattaacatgtaaagtcatttgaaataagaatcttttcactttgtagtgtatcacgtatgtgtgtgtgtatacagagatacacacatagtaatttttaaaataaattattgttatccagaatttctgtcttcctaaacataactgccacttttacacactctctctaattgttggtactctcacattgctgtctatagatccaaattttatcttaaaaaaaacaaaaaatgcaaaacactggtcattacattttaagcagatttagccacttgtttgagcaatttttgtgcttgtgtgactcatgttttctgtgaattagcttttttttaaaagctataaattatgagttcttatttgtatttcttcttaaaaatatatgtagtctcacataatagtaaacatcacacttttaattcatcttgttgtaaagaaataagatatagtttgacgatggtattcctgtcattaataaatcataggcattaaataatatgatcaaaaattccacattaaaagactgcttacattcttataaacttgtatttggacttcataattaaaataattcaggtcctttttttttttttttcttctttgagacagagtttcattcttgtcccccaggctggagtgagtgcaatggcgcactcttggctcactgcaacttctgcccccctgggttcaagcgattctcctgcctcagcctcccaagtagctgggattacaggcgtgcgccaccacgcctggctaatttttacatttttggtagagacggggtttcaccacgttggccaggctagtctcaaactcctgaccttgggtgatctacccaccgtggcctccccaaagcgcagggattacaggcatgacctacggcacccagctgaggattaaagtataggtggagacaattaaattttatttcatatcagtggttcacaactatggtacagtataatctggatattttaaggtctaaataacattttcttggtaaaacttattttaaatagaaaaattgaaaataatgaggaagaaaataatatccttctctgtaactgcattcatttactgtttaaaaaataatttgcactacttgctatggccatacttcttagtttagttatactaattctatttagtaaaagcgacgataccaacttttaaaaaccaacatgcaatgagatagattagaattaaaattttatgtatgagagtcaaaccattagctccttaaggatagaaatgtcctgtttttcttcaatttgctcagtatatgatatacagtaactgcagaaattaaatttcagagggattaagtgattttcctaagtcctatcttcataaattttaatatatatcttttaaacatttaaacggtatccatgaaatttaatacaaacattattagcaaaaagccagttagttgaaaataaagaactaagattttgttttttggttactattccaattacctttctattaccctagagctgaataaatggttatttgtgtgaattaaagtgggccacttaaaaaatgtaaatgtaaaataaagctattttattcccctcttgtgtaaacagcagttttcctgtaaatcagggtgtgttttaaaaatcaccatccctttgcttaaagttgtgttattctatataaagaagattggttctggtggtgtcctgctgtggtaaattttgaaaagatgtcgaaaaacttgtcttatttgctttgaagtaagaaaccaagataaaactgaaataaaattaaatggaactagacaacatttcatctcatgctattttttcgggaaaaaaagtccaaatgtatatagtaaccttgaaagtaagtctgtagacattatcaaatcaatctaaattgagttagtgtatatgtggtaggcagaaactggtagaaattagtttatcttccccagactctttctgttttctttgtacaaagtaggataaacttgtttttagacctgattatgtttctttgttgcttttttccccctttccctaaaagggcaaggattgtccatattttgttcaattcacaccaggcgttagaacaggaaaccattaaaaagccctaggcacatgtatgacatctgtagctattattggaaagatgtgttgaatataaaacctgaaacatttccaaataaggaatataaacaatgatccccagtgttttgtagtttcactgcttataaacaacaaattgaagctgtagggctgattcttgtgatatacatacatgtgaacaacctagcccacacatattcctctttatcttattaacaggatctctacaaaatgcacttcagtcccattagacaaatggtaaggctgttgtatgactaatcttagtggacattttaaaagcttattttaaatatccattgcttcttttatttaaatgtatctttttctagttggatccattcattcctagagcttctcatttataagttcagattgtattgagaatatttgtgtcaaaatgcttgattcatatagcactttctgaaataattttgctaatcttcaaattgtctatttgaataaaaacaaagacattaattacaaaaaacttttgaaaagactattgtctcattaacttttatgctaagaattatatatcttatgtaatatatttgcatatatcaatgattttccactcatttgaacttttaaaagttgctaattggtaaaggaatcatctaattctaccttgatgggtttgaaaggagaacttaatagtagtttatggaacgacttcagaaaaactatcgtatgtcatctattgcctgttgcattcagaatgaacaacaacttatcttcatagaaaatggtactactgacttagttgctctgccctctatgtcattcttagtgaaaatgctgtgatcaggtgagctcttagtaatcatggctgtctgatgtatcaaagaggtttattaaaacttggaagcagctgtggcatagtacaatgttctcgatcattgtgcatcgcaaaatttacaaatgttgagagtgtggcttttctttagtctgtaaatggcagcacccaatgacccagattccccttctatttcacaggcgctcaaaagaaaacaaaaaacaagctgccagctttccaatttaatccttaataataacaatcttccaagactccatattttcctaggtcatttagacaaatgttattctacatcaaaatataattaaatgatccaatatcagtttaaattgcattgttggtgtattgtttccaaattataattgttaagtgttctgtagctcactgaatatttttaagtttgttgtagtgcccagaggcaaaaattgcaatgggtacaattttataaatcaaactcattaataaataatgttttcattattactggaataaagagaaccatataggatgaccttttaaaaacattactacttacaatttgaaatggctttaaatggaggattgtacataatgtattgtaatgagaccatcccttccagacctataggtatttcacatcagatttcacagtgaaggaatgtttgagagcttcccgaaagttagacaatgcatttttatcttataatgttttcttccttaaatttagaagttttgtactagtaaactttggttacttatttgtagatttcttttcattgctcatggtgaagataggaattattgcatacaatgattaaattctcccgtatgaaaattatgtttacaattaatatatagaaagtacaacttagctcaataacattttaatccaccctcaaaaaagaaaaggaaaatccaagatcatatattaagaaatatatatatgcctatgggagtttaaaattcaacttgtcttcaagaagacaagaaattttacctcttttttaggttgcaaaattatttctatacttcttatttcttcataagaaatagtttaaaagatgttgaccatagctgccttacctttataagaatttttgccattctaacaaaaaaaaaaaaaaaagaatttttgatagacattttttctgatacaatcatgaaaatatacaagacactccaaaaataacattttccttgatctctatggttaaacttttttcataaacacatacttttgctttgtattgtaccattcaaagtaggaatcaaattttaaacatgatggtaatgttcaaactgataaaactaatattcatcaaaaataaatattagtacaatatcccacaacaaaaatgaaccactgcttgtaattatttaaagctatgaaattatatattttatatgataaattacaactattttataattaacagtgaacatcatagtaattaaattcgtgcagtatcctgtgtcttatgagaactttcttttctttaaactttcagttttacctaacttcatgatgcagagtggttctgtttgtaattgctttgtaaagttctgaagtgcaggtttagattcacagtgcaggtttaaagctgtctggttaactatagtctcaactgggtaattcttatataactagattgatgcagctaagaaaataactaaagtcagtcaaaagtattggtcaccaatgcttcaaacaatcccattaatctggctggtgacttcaaggatgtctaaaacttctggataataacttgtctcttgttatgctaattaccctttccacatttagcatcacatctgaggagactgcagattgagttccatatcatttcaataaatgttatcttaaatgttaacatacttcaggttcaatgtatatagtttagggcttctcaaagtttgttccacagatttctagctctctagattggggatcatcagcccccagccatggactagtactggtccatggcctgttaggagccaggctgcacagcaggaggtaagcagtaggcaagaaagcactgcctgcgctcaggctcctgtcacatcagtggcagcattaggttctcatggaagtgtggatcctattgtgaactgtggatctaggttgtacgctccttacgagaatctaactaatgcctgatgatcagaggtggaaccatttcatcccaaaaccattaccccatttcccccacccccttccatgaaactggtccctggtgccaaaaagattggggaccactgctctagataatctgtgtttcattaagatctggaaatgctacatactatattccctccatgagttcacaatatagcaaattaaatattctgagtaaactactatttcctaaatttatttgactgcaggatcattttggaagcaccatccactaacatcccatagaagacattgtgagaaatactcactgcgtcacaactcattaatagcaacaaagttgcccctgaatccggtccaccaatcacacatcgtttgcttcattatctttgtctatatatagatataaacaaatatatatatctctctcaagatttagattgtcaggtgagtagagagggagggagggaggagtattgtcatttctaagaaatgtcaaaagccacaggtacttgaaaaggcctgaaagatcagggacttggcttcctttagagccttgaacaaattacagaactttgcttggttttgttttgcttttatcagttttattcatcagttgagagtgtcagaaaacttccctttgagttctcaagtttcatggctcaaggcgaattttctgtttcttttctgtttttaagaacttgggtctagaataaaagataagtaacaattcagtcatacccttttgcagaacactctcagtatttgcctggcagtttctcttgatgcatgcgtgcttgattttagagaaagccgtgaagttcatgcattctgtagttctgagagtgatctctgttacttgaagaagccaaaaatgcagagccttctgtacccctccaaatcttatttttaatgaaatattatatgattccaaggaaatttaaacctatgcaatgatttcttagagaataggtgagagagatgcctgagagataacagaatagggacgtctgggatatatatatatatccttggggatttttttgattatagaacacatgagcattaagaaatagcacttatttaaaagagactgttcagttgaatacctgtgttgctactaatcacttcatagctccttactttcctatttaaacaacaaaagagagttggccataggaatttttgtgttgaggtggggaagtttataaaggaatagaacacataatcatttcaatgtctcttttaatggaaagtagttatttgcatttgtcacaaattaaacttacctaattattaaaatgctgccctttggtttttgacttaataattaagaatgacttcattgtgattttaatcccagagagtcagtttatgtctgtataacatgcatggctttccaaaaaggtgatttatgtaattaagagtgagatatagtttatttatgaaaaggtgcttttgtgtggttaaatgtttaacctgagctaattaggagccttgagaattttagttagcaagttaaggcattcaaaactctgaatgggtatttataatttagctttgttccttttattagatgtgacagagcaatttagtattgtaggttcactcaatggctatcgcagcatcattcttcataatttttattaattgtatggttttccttttatgttttcaggtgagagtatttcttttctaaagatagaccaaagacccactttttttcctgagtaattctgtctcttaatgaatgctacttaatccattagggttcacataagtattctatcaagatagaaatttaaagtaaatgtgacttcattaatttaaacttgtagtattttgcttaaattcatgtaatttttttaatccatagggtaagtgtggagattgtcaaacatgttaataaaatatttgacactgtttcagtgaagagctgaggtctaatgtcctctcttcttgaatctggactggcccagtgacttaattgaaaatcatagcgtgcagcagacattgtgtgacttctgagactagttcagaaaaggctatacctgtggcttccatctgattcccttgggcatttgctctgggacaagccagatgccatgtaagaaagtccatttctctgagtccactttgctagaaaggccatgtgtaggcaatctagttggcagccatggcagatctcccagcttccagctcgcatcaatggccagccacgtaagtgagccgtcatggatgcccagacctgtggagccttggcagcagccgactctacatctgactgcagccttgtgagagaccccaagcgagggctgcccagcttagcctttcctgaatccctgacccacaaactctatgagatgtgaatatgtaaaccagaatacatattgctttataccactgagttgcctgatgatttgctatgcagcaataacgaccagaacaagtaggttcaatacattgcatagatctgttcttacatgatgtgttttaaaagataaccatgatttaaataaattactttatctcaaaaagctaatccaatgttattattaccttgtgtcttagtctgtttgtgctgctatacatagcaaaatacccgagactaggtaatttataaagaacagaaattcgtttctcacattgctagaggcaggaagtctaagataaggcaccagcagatttggtgtctggtaagggattctctctgttttcagtatggcaccctgttgctgtatccttacatgacagaaggcagaagggcaaaaagagcaaaagggacaaaaaaggcttcgccaattccctccagcccttttataaggcattaagccattcatgagggcagatcactcaagacctgatcacctcccaaaggccacacttcttaatactgttgcattggggattcagtttcaacatgaattttggagggcacacaaatcttgagggagattatagcacctcctgagaataagttttagaaattagtaatatattattctaagtatacataaataatgtgtgctgataatataaaccataaatttatatcttaaccaaaaaacatttaataagattatgctaacgtaaaaattaatgtgcttaagagtttaattctccatgaattataaaatcacaggcagataccatatagtttatatttatttaaagattctaagagattttctgtactcatactttactacccagaaatcaaccattttccagtaagttcaagttggtgagctatggtatagaattagaacttttcaggttcttgctgagagccttttatctgtgtacatttaaactagtatttttattatagaattaatatatccacatgctcaaaactcaaatcataaaaaagtaaaatgaaaactcagcctccctggctcctattttgtttcagtcccacaggcaacccctgatcacagttgctgtttttacatttttaaggtggctatgataaaacttaaaattaaattttacacgtattcccctttttcttgatttgtcaactttacagaatatctactcttgtttacctgctattgtaaatgagtaatttcttacatttaggttacctcctatctccctttctcctgctctgcttccggttatgtataattttcactttaatggttatcttcagattaattgttgcctttatagctttaaataatatacttaaacatctatttcttgatttacccaccctggccaatatttcttactccttgatatgaaaagggaaaaaataagaatactcttccttatattaacttttccttgattcatcgctatgtttttataaatccattgttacttttatctaaaaatctgttttattctactcttgatgaatatttgaattatccactttgggattattaataatgcttctatgagcatcttgcactgtctttggtgcacaaatgtacatgtgttgctaagtctgtacactgtgagttaaaggctgtgtgtataataccagttttcaaatagctatactaaattatactcacaccagcagtatgagacagtaggaattccatatcctcatcaataattggtactgtttgcctttttcattttagctattctgatgggtattttatggtataaaattaggtttaattttcgtttccttgaggattaaggaggttgagcacctcttcatatgtttgttggccatgtttattttatgaagacttatatagataggtctcttgcccataattgtattggatttcatccatctccctcctctctctcatcactgtgtagattttctttatatattctctgttacaacccttttatcaaaaacatgggttgtgggtatctgcttgtgtcttgctcttttcactctctatttggtaacctgggtgaatagttattttaagctagttcaatctatcaatcttttcctttatggatggtgcttttatattctgttaatatatctttccctattcccaaatcataagcatattctttcctatttttatgaagttgtattattatttttgtcatttattttaaaatctgtaatctacctgaaatttatttttttctgtggcataatctagagttacatttgtgttttaaaaatatatttatacatagttcactcagcaccatttattttttatggagaaaatatagatttacttattactttctagtctatgccattgtccttttttgctatgatgctaagacctatattgtactgctaaatagaaatggtgacgatcttctcaatatttgtagaacatgtttagatttttgccattaaatatgatattagttctaagttttttaatagattccctatgttaggttgaagaaggttccttctgttcctaataggctgagagtttttaatcatgaagagtgttaaattttgtcaaatattttttctacatctgtttcttttgtctgataatgtggtaaactacattagtgaatttttgaatgttaaatcaagtttgcattcctggtgaaaatcgatttaattaagataatattatcttttgtatatattgctatgtttaatttactaacagttgattaaatatttttgcctctctatttatgagtgttactggtccctgactttctttattgagtaatgtatttatatggcctaggtttcatggtaatgctagtttatataatgtgtgggaaagtgttctcttctttattatttctgaaagagtctttgtaggactagttatgtccttctcaactgtttgagatgtagtaatctcggcctggagttatctttgtttcaaggtttataaatatatattcgatttcttcatttgctatagagccctttaagttccatctttcttattggatcattactggtaattgggtcattcaagaaatatgtcaatttcatataaattgtcatatattggcataaataatagaattcctttgtttttctattattgtctgtggaatctgcagtggtgttccctttttcattcttgacattgatacagtagtccccctttatccacaggaaatacattccaagatccccagtagatgcctggaaacacggatagggctgaactctatagtatactcacacacctatgataaagcataatttataaattatgcacagtaagattaacagcactaataatagaacaattatagcaatgtgctgtgataaaagtcatggaaatgtgtgtttgctttcatgcttgtgtgcactttctctctctgtctctctctaaatatcttcttgtgctgtactcacctgttttcaaacctggaaaactgataacgcagaaagcaaaactgcagataagaggacactactgtaatttatgtcttctctctcattctgcctaggtgtttgttaatttttttcatcttttcaaaaaaaaatcagtttgatttcattgattttgtttcctgttacatgtccatgttccattttattggtttccattcttatttatactgttttattctgcttaattgttctttagttttttcaagtggaagcttagataatttattttagaggagattaaatatcttcaggccaataaatttgaagcctttgctttaatgggcaacatattactaactaagcctcttccaagaaaaatcgaaggcctaaattagaagcataatcttaagggaaattacaccaaaagttaaaatatatcttttttttttttttttttgagacacagtctcgctctatcgcccaggctggagtgcagtgacgtgatctcggctcactgcaacctctgcctactgggttcaagtgattctcctgcctcagcctcccaagttgctgggcttacaggtgcacactaccatgcctggctaattttttgtatttttagtagagacaaggtttcaccatgctgaccaggttggtctcgaactcctgacctcatgatctgcccatcttggcctcgcaaagtgctgggattacaagcgtgagctactgtgcccagccaaaatacatcaatttttttaaaataggaaaaggtactagactgttatatagtaatattcttccagatcttcaaaagatacataacctcagtagcataaaagtggttttaagaatagaaaaaaaaaaaagaggaaataactttccaagttacttggaaattcatctagtcttaaactaagtaagaatggtatgaaaggatgaacaataggctgatttcacttataaaaatcaacatcatggtagaaaaagggccaattatggttttaaaaacctaaacatcttcctgaccataccctctctttgattttaatattatttgtgcctcttctctttcatttctttatgtttatcagtcttaccattgacttttctgtttgattcttctttttttttttagttttattttttgaggaaacaatttttgccctcaaaattaatgatttcaaatgtggctgtattttctattttatttctttgttttttatattcatgtcttcttttcatttctttaggcttattttttagtgttttcaacactttatatggtttagaaacttttttaacatctttatgattgaatattttaaacatacacaaaaatagattagtataatgaacctccatgtacccatcagctagtttccataatgagcaacacattgccatcttgtttattttcccatttcataattttactttaatactgcaaagcagcttcccaacatcacgacatttatatataaatacttcagtgtacatccctaacagaaactcttaaacaaaatcactgtgtcatcattccatctgacaaaagtagtgaataattctttaaatatcacctaatacttcgtccatattaaaacttattcaaatatctcaaaaaaaatctaaggatcagtttgtgtgcaatagaatctaaaatgcacctacacgttgcttctgtctattatgactctttgcattcttattgtataattgtttttctgttttttatcttaatttcttagaagttagtgaaaaaacagatttttatatatagaaaacaatcctggaattagcagattgctgccttatggtatcatctaaattgtttcttcattccctgaattttctgtagttagatctagaggcttgattggattcaggataattctttcagcaagaatatttcataggtggtgctttcagcttactacttatttgaatccctttgtaaggaacatgtcttattgctgcacagggttcagatgatagccacccaatccttcctttatataattcaccatcactctttcatttgatgtttttatcacctattgcaatcgttctcttttaaaataaacatttaatttttaaaatgttgttatgtaatttcttatacatttctacatatttctaaatttttattgtgactttctctgttatgtatgttgtttaggtaacatacttcctataaagtttcctaatgtgcagtggtgaggtttttgctcgtttttaggtttctttttgttattgatcttaattgcactgtggtcagagaacaagatgtaagatgtgtatttatgggctctttagtgtctattcaggttgttttatgtcatagtatatggtcatattttttctctatatgttcctttccttataagaataaataataaactttttctctatatattcctttcctaatatgtttcatgtatgcctttgctttaaaacattattagatgccactttctatgttcatttgaagattataccgaagtttctagctgttctgcttaaatacctgatatcctttagtctgtagtagctggcagttattgagagtacatcaaagtctccattatgatgctggatttgtcaatctccttataattgtatccctcttttatattaggaggctacgttgttaggtgcgtaggttggaatttattatatctttctctggattgttcttttttctttatgtaattaatgaccttttaattccctagtaatattttattgacagccttttgtctgatattaacatagtagtacaagtttttttaagttagtacctactaatgtatcttgctgcctttcaatgttgtcatatttagatatgactcttagctaaaggtaagagacattcagtgatcactggttttattttttttagtttgagaatctccgtgtttcattatttcattttaaaacatggaaaatctttagaacttttttcttaaaaagaatagacccttgttcaaacaaaatacttttaattaaaaattgagtttatttttatgtaaaaattgttgccattataaagcattctttcatattaaattataaattatccatgatatgattttttcctttaaacaagaaatgtatacattatcattcattgcttttccttgacatttatgtattttaaacaataaccattggggttttcaccttctttgtactttttatcttaaagttagcattatttaaattaatttaggtattttccatcaaattattggccctaaaacctttagtgctatttttatattcagtatatatttacattttaattatatttgaaggtatttaatttttgtattcatttgaggaatgaaatataacaatatatttttcattattttatcatatttatgaatgactgggttgcactggtgcaaattattatcattctgatacattatataaggctgtatcttccaaagtaagctttaaaatgtgctcagaattgttcattgcagaaaggaaccttgggagagtgctgggaaacaataaaaggtcaagtttaatgccttcaagaacttgtggtgatgctgttgctagcaagaacatactgctttattagttgcatagctttattagtaggtgcagtttactaccactcagtatagtttccagcctttcaagtgaaggagagctggcttaattaattatggcatttctaatctcacttaatttgttattttagtgaagccttcaacaagccctactggtttttcccccaggtgacagtaaatattacagaaataatacactttacaaaatgggtattgaagtgcacctctttggaaagccatatagtgcagacatatttatatgacaggagcattctaaatgggatctcatgtggcctctttattttccatgaagatgcacatagaatatgaaagggagtaaacatgtggcttatgtgggagcaattacaaaggtctctttgtatttcctaagtccaaaggcatccattcacacctagttctgcatggtttcagttgcttctctgtcaatttttttcccagtgcatatgatttgaaaactgtagttactgtgacagtattttggttattagatatttttgttatggttttaaagtaattaatcccttgctactttatacgtttcatgacagtggtggaggaaatggggggaaacctttggaggcactcctgaaagaatggagagagaaattaatctccagtcaacatagggtctaatgcagttataagagaagcaaagatttagggccagccccctgctccaccacctctgtcaattcaccactggatgatgaagcccacaggggtgggtgtgactcatctgcatatccagcccctaataaatcaaattgtgcaattcagggaatatggcaattgaaaaccagatgcttagaccactaagccatcccttctggcacatcgtaaagcatggtgttgtaaatacagcagataattgaaatttagatttcagatataggcactgttagcagccctcctctagctttcattgctgagagtcttccaagtgtgtttaacagttcatattaaggcaattgctgtcaaaattaattaagcatttttattttttcatattttttaatctcttctttgatgaggagagtattcataatacaaacaaaagacaggcgtctgaacttaaaagtacatccaaactgaatatggaaaatattctatagtttgggaaataaagttgtgaactccccatttggtttctttcaagtttttgctttaaacaaaacacaggttttttaagaaaaaaccttgctactccattgattaaaactgtcatccttctttgtccatcatataatgtactttccataaattagctgcttcacttctttttataccaatcaaattacagtggtccttaggcttaagtgggtcacaggacttggcttcttataaccctcaaagccccttagctttttataaaagccatcaagcatgccatttgatctgtacattttctctttttttttcttgctgtcttcaatattatggacaaaatttggaatattttagtaggttgtctacattttataaaacctgtttttgtaatgagactgttacaaatgagagtaatgaatgcaataaagttaagaatttgttgaaatgatattaccttattcaaaagtagatagagtaaaagtaaaaagtctatgaagagtggtggtttgaattgggcaatcaacctgggatgaatgtcaccatttcatccgtgttagtattaggcatttcaaatggcaaaattatatcaccaataatattctttcaaaaaggaaaaacagctctaccaggcttgaagtgaccctgaccatcatagctattcagacagaatgggtgttttatcattccatgtgaatatcgtgtgttgatcggaagtcataccaaaaaaaatacttaaagtgcatcttctaatgtgacagtgtaatcataaggacatcagagttaagccaattattctagttcacagcagttttaaattgaaagctatttttgtgcaatggcatctagatgaatgtgattctcagagacaggtaaatagtgtcaggctctaaagattttgcaactgtgatccaaatgatgactgagttcccgcagtgaggccataactcatgggcactcaccagtctttccagtactgagaagtcatcattagcaccctaatggaaactgaggatcatgatagaaacgtactcagtgatgcatttgacagctgtacagagtaacttcctttagagggaaggattaaaatttgacagagtttgagcataaataaggaaataaattaagataagactagatctagatgcatgagcacattgaggattgaattattcaatccaagtggacagaaagaaaataaatagattgttatatttcttttttaaaataatagggtaaaatgtgataagctgggcttggggggatgactgagttgctttgaaaaataatgggaaagaaaacccaagcagttttgctctgttttaaaccatttggaccatagccacagaattcagaggaagagaaaactatgttaagtaaaaatcaaccctcaactttcactatgttcgggcaaaactctgggaacagtgagacaaattcatgtcacattaatgaagagagttactgacttacactgtcccctttctattcctttgtatgtctttctgcctcctggtctcaacctctttgtgtcaataatagagatttatgggaatgactgccaatcataatgcaaagtatatagaatggtgcaacacttatgactgtcttttttttttttgaggtggaatcttgctttgtcgtcaggctggagtgtagtggcctgatctcagctcactgcaacctctgcctcctgggttcaagtgattctcctgcctcagcctcccgagtagctgggatgggactacaggtgcccgccaccacacccagctaatttgtttttgtatttttagtagagacggggtttcaccctgttggccaggatggtgtcagtctcttggcctcgtgatccacctgccttggcctcccaacgtgctgggattacaagcatgaaccaccatgcccggcctgcagtgaggccataactcatgggcactctcttttttttttctttcttttttttttttctttttttctttttttgtttgtttgtttggagatgaagtctcgctcttgtcccctaggctggagtgcgatggcatgatcttggctcactgcgacctccgcctccagagttcaagcgattctcctgcctcagcctcctgagtagctgggattacaggcacctgccatcatgccaggctaatttttgtatttttagtacagacagggtttcaccatgttggccaggctggtcttgaactcctgacctcaggtgatccacccaccttggcctccccgactctctttttctgcaagcgcttaatccttgggcttactcataaaatatgtgccaccttgatagggacatacctgaccatctgactgaggagggcaaagtaggaggtcagcaaacaaatttcatgccctggctcctttcactgtccatggcacttcagcctagtgctgtacaccaactaccaaacaaccagtcatttctctgtttttcctttctggtgagatggcaaatctgagtccaaaatctcattgattctccatttcctgaagtcaagggtaggactgagtcaattattttgttcaacttttttgtatccagtggatgtcctaaccattactgtttctgtatgcatgtacttcagtctttaagaaagaatgaaaaccaggtttttttctttattgtcatatctgtaatttgctcctttctcagaggaaggtcatccacagaaaattaaccaatatgtttgattctatagaactatcatttttgcgtccagttgccattccttctgaagagctgttaaatgcagtgattttaatctgctttgattgcctcacaagtgaagaggtgatttgctgtattttgtagaggtgcatcaacggagtaccctcagctacagaattatttcccttgtaacaagaagagaagagcaaggtttacatcaccactgtgcttaaaaactcttatctgtcaggaagcatgtgcttttctgtgcaaccctgggagttcattaaaagtgtgaggttgcctcactaattagatatggcggagtgattgggcatagtgctgtgggagaaaccttaatgtaactggagtgaaatgaaaatctctgttttgttcataccaagggaaggtttgattaaaaagatttcctctttttcatttgggacactgttttgttgtgtcatgtggcattgagtaagtgatctgttacaggtttgaaacataactgcttcatgtatgtttttaaccattccttgttattattctcataacatattaaaagtacagttcaggaaagatccaaatatttacaacagtttctctggggtttgttatttctgcatgcacttgtgaaaaggagtgctggcccacattcctctgctagggagtatggtgctgcagtcagcttcacaatcagatggcaggttgggtaagttggtttactcactcagtcagttaatatgagtatccactataaactaagccaataaaactcaggcagacaaccggaggtgtttttacatggctttctttcttccaactttgtaagctagaagccaggtcagtcttcatgaggatttactgagtgtagacactgtgctcttggagcctcttgggagtggaagtggagagagacgggcagtgatgcacatgctatgggaaaagattggcccattagtgtggggaagttctttatgaagctggtttgtagctcttaggcaaaagcaatcagaatgtgtaaacagtcggccaatttcatcctctaccagttttcattgcataggattttggccccaaacaattgctcaactaactacccatttggtgagtctgaatgggattcaaggattaatccagagatgatatttggattaaatcatcactgtctaatagaagcagttataaatatgtaaattaagcaatctgattatagtacaccttggctgcttctagttattctagtaattgtctatgcagggttagcggaagagatttaagcattagaggctgaagtttttcaaccccaaagtagccaacaaatggaatagaagttaagaacataagacctttagtacttatggattcaacatttgaaatcatatacacatactacatgtaagccaaaggcccagagcttgtaataattcataattttgccgtggcacaaactgcatcatttacactgggaggtttgtatgtggagtgatgtattttcaaagaggctccagaaaagatcgcagcattggcgacctctcacttttctgcaccttctcggggaaatagatgaggagggtggccattagaatatcctccccacattcactcaggcttgttgttgttgtttctagcaaccaccacctctcctatttagatatggtcccacagagctatcactatttaaggatgtgtctgcgaaaacatttatcatcatctcagtgctacaagtctcttacaattctgtcaaagatatgggcttggattagcagctacatatcagttcttatcttacacttggaatgggggtgaggttagagaaagaatagcagtgtgtttgggatcttgctggtgctcagttgagttgaattatagaacatgcaaaggggaacagtagacgggccattcattagtatcttctctccagcttctgtgctccttactccccagaatggactcttcagagcaaaaagtgtatacattttttcatctctgtatctccagtgcttagcactggagcaaaggggaccctcaataaggacttgtgaactgaatgattcctgttttgctatgggtttgctagccctgttatttctcatttgatgatatagttttgttgaataatgagcgttacccaaaaacctttcccttgaattcccgtgttcaattttgcttttgattacagagttcctaaagcagaaggctactagagggagaaggtactgagtgaggtcaaggtgtaagatgcctgtggacatggatgtcacccagggtgatactaaaagataaggcatgagagagggagaaaatattaattaaaatgatggagcaagaggaagtgctgaaggaccaacttggagactctcaggtgtggacaatgaaaagggaatagtaaagcagcatggggcagcttccagaggaggaaacaggaaattcttatctagaaacagctccaggatgagagtgggcagcatgaagaaaatgatcatgtctcacttcatagggttgccgaggaagtggtttctttggggaaagtttattgtcatttacatcaaggtagcagagacaatacttaaggaagttcttgagcttatgaaagagtttcagggcatcctaggaacagaggaggagaagggtttggaggtacttgggaggtgatgcaccaatgaaggctaaggaaatgccgaaagaagaaagagcaatggaagaggacagttgccccaagagttgtttctaccttgacccacgattaagtctaaagaaaagagatagctggaagaggagaggaatatcgagcaagaggttcaaaacagattttctgagatggtgggccttgcttgcagtcttgcctcaagtgtaaggtccccatactgatcaacaatctctagtctgtaggttcaggatctggaggtttcagcatggaagtttcctttctcagctggtgagaatgtgattaactcaagcttccagcgattgtggaacttagttgattttaaatattggtttaaatgtattttataaataatgaaagtcattttaaattacattataataaataaaatataggtgcatatgtaaagaaacataaccagccaggtacaaatcagtgcattctcttttacttcaattatttcaatccataaataaagattagctttcaattgcactttaaattctcttgccagagatgcctctggcaatggttccagctggctggcaacttcgaatgcagagacagtatcatattgtcatattcatctttgaatccccccagagtccagcacaatactctgcacatggagtctagcataatactccagacgtcataaatatatattctattgaaagttaactaagaccctttaaggaaaaggaacagatttgtttacccagtaaaccccttgcaagtagagtatctgttgtatttcagtcctgtgctaagtgacagggataccaagatggatgagactcattccccacctcaaagctctcagaaccaagcaaggcagacagacctgtaaagaaatcttcacctaccccgagatcaatgaatgccatgacagagcttgcacatggcatgaaagtggcactgaagagggagattgagtccatgcagagtgttcagggaaaaagtggctcatactgagttgggtgtgaaggtatagatggctggatatttgccaggcaagcaatggtattctagaaaactggtgtatctaggtatgtgttgagcatctcccctttgccaggcactgttctaagctttgggaatatatttgtgaacacaacagataaaaaccactgcctgcctacttggagcttacattttagctattgataaccaatagattattttaatgggacagtgcatccctctacctctcaagcactgtaaagttttaagtttaaaacatttgtatttaaatagaaatgcatggtggtttccttgtgtgatcagaatatattctggtctggctatagctacttttgcagagtctctcctaactctttgttgtgtttctacccttgctcaaaaaacaaacaaaccttttgctgactgctgcccatgactacagctgctctcagcagttcagacctctgcacctcatttcaagctgtgtttccacatgctataagaacccacgatggtgtagccggctctggatcaccctacttctctccatacagttgtctttgactcttccgctgttcctccttcttcacataagtcatggtaaggattgcttcaagtgcctcttaggttgtctgaagaaaacccttccccaaattgtttattttcagtaggtcttataagctgtgaaattgttttttgaaactagaggcttccaataaagatgtcacaaagtgaaatgcaagaatgacaaagtgaatggcgaaatgattgtgtaggaagatatatgaaggtcataggagagcaacagatgcacatggcaaagtcaggaaggtttgagtctgggtgagaagagggtgaaatgcttatagacgataggcaataaaaaagaccttttcaagaagtccttgaacttgccttattcatgaactaagatggcttgtcaatgcggttctctatctaatagttataaaaaaattctttaacacagttttggcttcctaaattttgagattttttttttctaaatgtactaccaaactaagcacacatacgaataagtgtgcttttcttttctttcttaccctgttcatgacacagctatggaattggtctgtggattaaaaattttctgcagcacattttcatcctgaagattttcgtcatgaagaccagcagggaagtatgcttgtgttggcatgcgtgaaatgcctgtgcaaaaataaacaattgctttaatagtgtgaccttttatctctactctctctgatccaaacctggcttttgtatagctttgcatcagtgtatatgggatatttactagagccaaatttgattgagatgtatttcagccagcaaaatgaaagtggttaaggtagaaatgcttggtaattgctgaattatcccaacttccttaagttttttctatttaccagctttaggtgatgatttggagttacaaatgaagccctagtaccatataaatgtccattttgacagacctggattctaaatatttgagaagatggtatagtttaaatagattaaatgaaagaaggatgtttataatacctttgatcatacattttatgatttagcatgatctgaagcagaccttgtggaaattgctgtttttcaatatcttcaccctttcaataataaacaacattatctttgtgtatcgaagcactgggcttaagcagttttaatatatttaatgatataggaaaactaggggaaaattagctataactgaatgtgggaaagaatccaattataaatagaaattatgattataaacatgtttatatcagtcttgtatttgaaaaaattgttttccactcttttcagcacttttgaaatgtgttatttgaatatgagaaagaaacagtgaacaataaaggaggggttgcagaattactttgttgaacttctaaacttctatggctctgaagattttaaagcagcctttacttgaacatatttgtgtagggagaagtgcacccactggtgttagccttatgttgaaagattagcagagcagatgaaatgttgatcttgccatcagtagttattttcatttctgatacctcgatgagatggatgaatgtgtttggtccactcaaatctcacaaatgaaacagaattccctctctacccaccatcacctctgccttttttaaaagctcacagctgtcttttgacacctggtatcagcttaagtcaacttttacacatttctaccaaaaataagcgataaaaccaaacacaaacaaaaaaactccagcaggtaaagggtataattttaaagaactttattataaaaatttcactggtcttttaaaatctcaatcagaatactgagaaatcttaacaatgaactctaactgtgctgattattagcaatgagaagaaaagaaaatatccaagaaaagatcataggaaaataaaaaagaaataggggtatagagagaaggttttggttttatttcaggtatgcttcatgccatagatttattcctcaaaagttgtatagaaattagtatgttaagaaagtataaaagtgttatctattctgagagtgcttctcaagggaagctctccaagaaaacatttggtcaaatgaatacctcttaattgatctgttggggaatttttatatgtatgtttattcagttggagtttgcctgccttagtatttggtgcattatgacattttatgcttggaatggaccttaaaaatcttcttatccccaatataaagaaaatagaagtgagggccaggaggtgatgtgtctggtcaccagacaaagcaatgatgaacttatattagaatctgtgtctcttttgtgttagaccagaattcagttactgtatcttgatcttcactcattttaaatttatttttattaaacctatgaaaatcattcagcatctcttgcagacacaccagatgaagagaaggtgtggccaaccctgattatattgattatcaatgggatttagcctctgtagcacataatccacaactgcataatctctgtgaaaacagtccattgaaagttgtagacttttagtgcattttacaaagttcagaactgtttacactgagtgcagttttatcccatatgcattcaggtaatttatccacatggcttagtgtgtgtttgtgaatgtgcatgagcaccctgtgtgcatgctctccataagccaaggatttgagccagtcatttaatgttaatgattttacctgctcccaggattagcaagggactagttagtagaatatttatgatctaatcgtattccaaaaaaggttttttttattttaaagatgcaattattagagcataatctctagaataatgaaaaacttgatagtctttcgtataaataatttctctgtttgtttcataatatggtatcttttccttaccctgtttgcctgaaatcaacaaccaagagacattacaaggtaaatacagttaatgtgcttgctttcaaaactaagtcttaggaaacgggggtcccaagaaattttggttctttctttgaccttcagtttcttcttcgacaagatagtcatctttttgtcttgcatatgttcaggtatgaaattggaataggagtgccaagaaatccactagattgttgtggatatacatctagttatatgtgaaatagtttgagatctttgaaagaaaggtaaagtataatgaagacattattataggtttttgttgctgtcattaaaaaagaatccataacataagtaataaggtcaacattccttaagtcagcaagtatttattgtggtgcacagaaagaacactgaactgagtatcaagaatcctagattctggctttgtcactaacacaacatgtaaaaggagaccagtcatttcagctttctgcgtctgagtttccttagctataaaatgggtgaactggcttcactcatcaacaccatccttcccggcttagttaataatttttaggatttttcctgagtctcagatctgtactagctactttaaggcagtggtttttgaagtgtggctcctggacaagcagcatcagaaacttgtagaagctcgggactcaccctagacctactgcagtagaacttcaagcattgagtgcggggcccagcaatctaggttgtcacaacactccaggtaattcttctgatccacgttaaagtttgagaaccactgttaggcatagaaatgaataaaacacagttcttcttaagcagcttttaatttagcacttttatatctctaattgtcatgccaatttctggctatgtaggtgtaaaatctagtggcgtgtgtgtgtgtgtgtgtgtgtgtgtgtagtaaattataggcatattaattgctaagactgaaacatttagggatggtatctttgaagtcaactgagagatttccaatggcaaggcatttccaaaggcataaaaaatatatatgaagtttgaaaataacagtgtttaacaatcaaattgcatgttaatttcatgtgtgcttatcaaatacagtttgttttactttagcacagatatttttgttctgaaaagtaaaaacaaatattctggaattatgcccagaattttaattttaaaatttacattatgattatgtatgagcaccaggcacataacctgatgttcagatcctctctgtataatgtttctattactctcattctaacattcatgtgtattttcaaaagaaacttgcagttgacttttcagaatgcaaatcttgtttttaaatgcacctgagtttttaaaacataattcagctgcagttaaattttatgggcaagtggtttccaatgtagctaaaattcattgagggggaaaaatcatggccatatatgatcacctgtaaatcagagggagatacttattgatagacaggaccgctatttcagttctcatctgagagatgaaaaaccgagcaataaaactacttttaatttcattttgtagcgacactagaccagggaaattccatgagaacttgggaatgcgatgagcattctcttccaaaaaaaagtatcaatagtgttaagtttctttggacatgtataacctagtgatgcttcataatgaatacacgttcttgtatgaaatcagtgactggtactaactgtgaaatatgaaatgatagcctggtactgataccttaatcacccctggagagaccgttgcccctcttggtgcctggcccctttcatccagcctgtgagcacttgcagttgttagcgctagtgctaaccaaatgtaaacacctttactttccagctgttgctaattggtttgggactaattatagaagtgttgattttaaagctaaaaatagtgcggtgatgtttaaatccaactcattttggctgtcagaaatgctcccttgatcctgaaagtgttgctaaaaacgttcgctttaaaaaaaattgtagtaattaaacttgtctgttgtgagagctacatatgatctgtctgttccctgctctgatgaaagtggtaaagggcaaacatcttaaaggtgtctgaccagttggcaggacacaatctcctgctgaactttattttagacagcaaagccttgtcatttgaccaaaagaggagataaaattttgaaatagctctataccttgtatttcatacagctcattatatccttctatgttaacattaaaaatagaagctgtaagaattatattaataaaattaattatagagcgtccaaaaccattatgttttctagaggcaagtttgaggatttgaaatcacataattaatattgttcaaacataaagctgaagaaatatggtagctgtttggcatcagttgtttatacctctgattcttcataatcagggttatttttctacctttccttccaaatttaaaagtcatcttacagatttttctcaaagtcatttaaataagcaatgaggaaaactatattttcatttttagacatgtgcaatttcatgactcttcattttaccatgtaatttagtgaaggaaaagcttaagtattcttaacttatcatttgtcagttattttgtaatttttggaaaaaatgattttatgtaccctgttaagaggtaaactgccttgtcgataagtatcaaagcactgcacagctacagtgttgctgaagtcaatttgaaattggctttatgtccttataggatgccctaagcatctgtctgcctgccccatcttcagagaatatcaaagaattttgttagtgcaatatatggaaatgatcttggcaagtgataaacactgctcattagttgagatgataaactatagttactacccttttttgatagcttcggcaagggaaagtgtttttgatattatcttaataataataggagatataagtctgtgaatgtgtattctttttaaagtctgtagtcattgacatgatttctccaaatgtgtagtcagttcagaattacccttgagcagattatgacattgtatttggcccaatattactttcaaattgtaattgatatttccatatactcagagaattaagtaacttgttgatatgaatagaatctttacttgctatctaactggaactagatgaaaaattcattttttaatcttgcgtaatgttgatttgagccagaaagtatgttatttttctaccttgttagggatcaacaacaaagttccatttagagtatggtgcagaggcaacaataatgatataaaactttatagcaaatatcagtttttttctttgacactctgaggatacatcccatacagaattataaaactaaaaagaatatttattttaattaactgtcactgttaactgttcatggattgagagactttatgatggttagattgtgatactctccaaattgatctatgtattcaatgcaatccctagcaaaaacccaactgttttttttttgcagatattaacaaactgattccaaaattaatatggaaatgcaagagacccagcatagccaaagcaatcttgaaaaataagaacgaatttggaagaatcacacatcctgatttcaaaatttagtacaaagctacaataattgactgtgtcgtactgacataagaatagacaggtatagatcaatgaataaaatacaattgaggatccggaaatatacccttacatttttggaaaattcattttctttaagggtgtcgagacaattcaatgaataaaaaaacaatcttttcaatgaatgatactagcacaactagatatccacatgcaaagaatgaatttgaactccttcctcacacagtgtgcaggaatgaactcaaaatgataataggcctaaatgtaagagctaacaccgtataagattcttataataaaacaaaggtgtacatctttgtgaccttatattaggcaatgtttcttagatacaaaaccaaaaacacaagctacaaaagaaaaaataaatacattggacttcgttaacataaaaaacttttgtgctttaaaggacacatgaagaaagtgaagacaacccaaagaacaggaaaacatatttgtaaatcatatattggataagaaatttgtatatggaatatttaaagaactctctacaggtcaataataaaaagacaaatagacatttctccaaagaagatacacaaagggccaataatcacagggaaagaagctcaacatcattggtcattacagaaatgtaaatcaaaactacaatgacatatcactttatacccattaggatgaatacaataaattaaaattaaaaatgaaaataagctgtggcaagtctatggagattttatacccattaggatgaataaaataaattaaaattaaaaatgaaaataagttgtggcaagtctatggagatattaaaaccctcatgtattgctggtaagaatggcaaattattcagacatgtgggaaatagtgcagcagttcctcaaaatgttaaacatatagttaccatatgagcaacaattccactccacagcgtacgccagagaacagaaagcatatgttcacacaagaacttgtacccaaatgttcatggcaacattattcataataggcaagagtggaaacaacccaaatgctcaccagctgatgaatggataaacttagtgtggtatatccataaagtggaatattgttgggccataaaatggagtaaaatactgatatatgctacaacatggatgagcttttgaaaacattattctaagtgaaagaagccacaagtcttatgattctgtttatatgaaatgtctacaataggcaactcctttgagacagaaattagattaatgattgacagggcctgttggggaaggggaggatgaggaatgactgctaatggagtttgaggtttctttttggggtgataaaaatgttctgacattagttgatgatggttacaaaactctgaatatactgaaaaccacttaattgtactctttaaaatggtgactcttatgtaaattacatatcgataaagctgttgtaagaaataaaaatgatcttaaggcaatcctttagatgactgtagctgcagccccgcagacatggggctgcaaacttacaagcgatccaaccctagaaccgcctagctaagctacttctaaatctctggctcagagaaactgtgagagagaataaatgtttatttttttaatttattaagttgtgggataatttattatacaacattagaaaattaatacaatgagctcttggtgttatgtgcttgatatatagagaagcagacacaaattcattcctgtgtaagagaaacagataagaaagttaatgattttggcaaaaatgaggccatcaaatatcctgacatacatgataatcacaggttccaatattatgttaaattatccacctaagtatttttgtaacccgcccaaccctgtctccacttatctgtaagcatatatcaagcccttcataataatatgaatgtttgagagctttcaaaaacaatcgtcttttaaaatttggtaccttaaaccatgaagtgttctttagccttatggaaattctttcttatctacatgaaaaggagaaaattaattttttaaaagtctagagtagaccaagtgtttcacaaaactaccaacccctgcatgaaatgttgctactcaatctaaaagtgagagacattttttttaactcatttcactacaacaaagtgcttctgttgcagttatgtcttactttctttaaaataataacttggctgggcgcggtggctcaagcctgtaatcccagcacttgggaggccaagacgaccagatcatgaggtcaggagattgagaccatcctggctaacacggtgaagccccatctctactaaaaatacaaaagcaaaattagccgggtgtggtggtgggcacctgtaatcccagccactcgggaggctgagccaggagaatggcatgaatcagggaggcggaggttgcagtgagccgagatcatgccactgcactccagcctgggcgacagagctcaaaaaaaataaaaataaaaatatatatttttttatttttttatttttatatttatattttatatttatgtaaaataaacatattttatatttatgtaaaataaacatattttatatttatgtaaagtaaacattttatatttatgtaaacattttatatttatgtaaaataaacatattttatatttatgtaaaaaacattttatatttatgtaaaataaacatattttatatttatgtaaaataaacatattttatatttatgtaaaataaacatatttttatttatgtaaaataaatatattttttatttatgtaaaataaatatttatataaattatataaataaaatatttatagatatatttatctgtctcaaaaataaaaattaaaaaaagataacctaatttacttatgtccagcctcttaagctcgtatgttgtctttcttactctgttggaataatgcattcagatgcataaatgctgtttataagtgtgggtttttgataatgggtctttctatatctggtttgttgctttgatgaaaccggagtccacgtgtaacaatagtttattgtgactccacttatgaagagacaggtatccacaggattccctgttagggaacagctctgagccctaatgtcttctgtaaggaagcagcagcatcaggcgtgctttctagaatccatcctctcctctgcttctctgggtaacatccaatacaacttttccactgtcctggagtacagggcctctctgaccctctaacctttctgtagtgggagcctgtttacaattttagaaattaaataggcaatttgaatctctctctgaagattatcctcagagtcaaatttcatgacaaagtaagagttctggatttcttcttcctgcagtgtttctgcctgactttgacagaggtgactttgccaggcaatgttttttcatggattttgcttttctttatattttaatgttgtgaggggcaagcaagtacgtaccttaaggctaatatatcaccatctgtcaccagagtcccccctttggtattcttttcctttctggtttaaaacactcaatcccaaaagcctatggctgagtagcaagaagctaaatgtattccaaagctcttaacatattgcattgtgtagatgacccatttgagcatttcagaaaccaaacaggagagaaaagaacattgaaagcacagaaaagattaacacctgcttccagttttcaaagaaattagagcatactgtatatatccagcgtaaagcggtttactctcccatattgggatattttattcagattttcaattcaatatgcacagcatcacatgcttatgactttgtttcactataggattccacgcagaacttggaagacagagaagttttgaatggtgtacagacagaactactaacttcgccaagaactaaggacacattgaggtattctctttatacagataagaatatctgatttatttcaatttgatgtgttttttaatagtttataattgttcttactttacaagaaagatcaggataagtagaatcatggagtgcaacatgtcccaagtctaacagttacttaattcttcttttctagtgttttcttcatatgagaacttactgacaaacatatatacaaatgatccttaatccatccaatactcttctgtacccaggatttctgaaatacttttttctctcctcaaacagcaatttcaaatgaacatttcagaggtcattgtggtggttttactttgactttagctctttgaaagcaccaaatcctagccactagaccaccggggaaccctaaatttagctctttgagtgctactttgtattgtgctttaacacccttgtaatagtttacttgatgaaataaaatgaaccctgtctatcaaccagggtttttcatgttcttaatgaaggcaactcatttgctgtcagtggctgccatgtttcccagtactttctttgctttgcattgattcccagttcagctctaggtagtgcctgggttcatatcgcagctatgcctctttactagtcctgtgagcttagacaagttactcatttctctttctcttagtttctagtctgtagaatggaaatagtattaaaatcttattcagagggttagtatgggtattaaatgagttaatacatgtagaccattttgcacagtgttgtggttaggataaatcctgtgagtgtttgctgctgtttctactactatcattaatatcacatcatctctattattgttctaatcatcattttgtttaacgcacttcaaatttggcataaggaaaataatttcatatttaatagatggttacttcagcattaggtaaagctactgaagtttataattattcatgcagttgacgtattcctttcatttagtccaaacaattaacatgaaattagctttttaaaaacataggtcatcatcctttgtcatgtgctttactgtatggattctcctcaaacttatttatagccacgtgagcatagttactctttatttagatcgtttctttgactgatgagctatacagtattaaaaatttgatggaaactaggctaggtggtgcctgcctatcatcccagctacttgagaggctgatacagaggatcacttgagtgcaggagttcgagtccatcttgcaacatagggagaccctctctctctctgaagaaaaaaaaaaggcggggggatatggggtagggagtaatagaaaatcttcaagcaccatcttttcagaaacttaataagattatctaattatgtctacctccagaaactaataagattgtttctggaggtagacataatgattgtaatgctcttattctatttggctttaatttcacttatttcagtgttagctttttgaaaagtttgttaatatcttgtccaaatgctatgtgaatagcatcatagagtcaacattagtttggtttatggctgtatgaacaaattagccaagctttcttcagctacagggaattgagagaaatggagtataggaacttaaaaatatatatattcttttatttatttatttattttatttttattttgagatggagttttgctcttgttacccaggctggagtgcaatggcgtgatctcggctcaccgcaacctccgccccccaggttcaagtgattctcctgcctcagcctcccaagtagctgggattacaggcatgtgccaccccaaacccagctaattttgtatttatagcagagacagggtttctccatgttggtcaggctggtctcgaactcctaacctcaggtgatccatctgcctcagcctcccaaagtgctgggattacaggcatgagctaccacgcccggccaaaaacatatatattctttagttaagaaatgtatgtgtgtgtgtgtgtgtgtgtgtgtgtgtgtgtgtgtgtgtgtgtgtgtatatttgattatcaaaacgggcttttcacatgagttttcttatcacctttaataggttaaggaactacaattcatagcaattaagtgacagctagagacttaattgacacccaccactcttgtctacaaagccactatttcaaacattcctgttgcgtgtacattccctgatgccttggtgttttatttcatgctacctgaccaaggctaggaaacttctcatataaaagtgcagctaaaatcagttttatatcaaattcaaaaagtagagtgagtgcaattcccagcactttaagaccctggagtgggaaaaggatgataacaatcttaatgccattgaatgcatgggggaaagcttggaggttacagttctaagacagggcattgattctagccagtatgagatgaaaaacagttgaagtgaaattaggaagccaattctgtctgaattacatggtccatatgctcctggggcagggagaatctcatatgccacagggcttggcccatgcataggactttgggcacgcatccacgtagaagctaagtaaattatttgtagtctatctcaaaatgtcttgtaactgtttaatttctataatcattgctcaagcctttgttatccctcagctacaccattataataacctactaacttctctgtcaaatgtcagtttccccttattctaattgatcccacatattactgttggataaaatgttttaaaccacagaatttatcaagccattccttagttccagaccttttggatttagataagtcttgggtttgagtactaactctgctacttactacctgtgcaatcttggactaattacattacttctttaatatgtatcttcataggaaaattggtatcatggtcacatagattattgtgaagattaaatgagatatagtacagacaaccgacttagcacaatgctaaatgaaaggctgaagaaacattaattgctattgccattatcattgtcatttttacacagattgtagtttattgtaactatttctcattcacccaagcaagactgtgaatcctccaaagggtttctgacacctaatacaggtcttggaatataatagggacatatttgctaagtgaatgactgaatggataaaacacattgctccataaatcataagcaaaactgttaactgctcacccattattaacgcaaacatctttatttaaaataacatttaaaagacattctccaaatagttttacaatatgcatctcttatgaagcaccactcaacttattttgatcttaaaaagacaatgaagcaagaggtttggtggttttttaagaaaattacactttgaatgtctctttaaatagcaagcaatatgtacaaaagaccttcacctcatccctaattcctatctcatttctgactctgccttatctctccactcctgcttccacagataagccttcttccagacttgccttttgtttcattcttaaaacgccagcgcattttagcctatcctctcctgtgtcaaggatatctattcattgatcaaactgtttgcagaggccatctcaaaatatgtgggacatttccccatgttttgatgctttattcctgtaatcattgctcaagcctctgttactctattagtttcagctagattattgcaataatttagtaattcctgcctcaagtaccagtctctcccttgtggttcccttttccaattggtgtcacatatcactgcataaatatttctaaaccatagcgtttatcacacttctccctaattctagaacctgtagtgacttcattttctgcaaattaagtataaatttgctagccagaaatttaacacaccactctgagctttgatctcaagctaatggtttaatctgtctcctgtacacagcacctttctttgtttcccttttctcccttcttctttctcctcgttattctctctcccaccttcctccctccctccctctctctaatattacaaccaattgttatgctcacagactatcctcgttcaatatctccatacagttgactttctctcctgtgcatgcccactccatcccctcacctatcttttctgatggaagacccgtttgtccttcttcaggaatagattcctaatcccagcttcccttcctaatcctgtaccctcctctgaaacacatcacaaggtgcctccactttgaaactgcaccttggttaggcagttaagaactctgctctggggtgcaataaatcactatttgagtcttgactctatagaaatggtatgatgtcggacaagttattaaactctctaagcataagtttacttctaaaatggatgtgatataaatgtttactttatagatttagtatcagtacatgatataatgtccagaagaaggttagtacactgcctcccaagtaataccttgcattcaccgagaatctactactgtaacccatcgctttctgttcttttttattacctgtcacaaccttccccttagattataaactcctcaagcattggtctttgttttttccttgtggaacttccccaatgaaacaactcaattaatatttgttgaattcaagtgaagtaagtggatctcatcaccaacaacaaagtctttgatagatttttactcagtacatttgcatcctcaagatatttcaccatcaagtagagttcaaggttatccacagattcttcctggaggtttcgctctgtagtccgcctctcatactattgcatgccacagatctatgaatccacccttccagaaaatcagctaacactcagccatgtgctgcagtcctttgtcttctctctgcatgtcagcagtctgattgcaaataaaacgtgttcctcaatcctgcagtatttaaggcttttttaagaaagtcttactgaggaaatcaatagaaaaaaatggattattctcttttagcctataagcttgtttccttagacagttctaacaatcatactaatagcaggtagttattgaatgctttgtaaataccagatgtggtatgtgtaacatatatgtgttatgatctttatttttcttattaaagccaacaactctaatagggaaatacctaatctttttttttttttttttttttgagatgaagttttgctctttcacccaggctggagtgaagtggtgtgatctccgctcactgcaacctctgcctcctgggttcaagtgattcttatgcctcagcctcccgagtagctgggactacaagtgtgtgccaccacaccctgctaatttttgtatttttagtagagatggtgtttctccatggtggccaggctggtctcgaacttctgacctcaagtgatctgcccgccttggcctcccaaagtacagggattacagacgtgagccaacgcgcctggccaggaattacctaatcttaatgttctccgtgtgcaaatgaggaaactgaggcaccaggtcttaattaaaataatttactcagactcctgactcaaaagttaccactgggatacactttctctgtaattacacatgtgaatcatgattttcttctgaaataaattacccccggctccccatcctcaatttcatctcttccatacctcaacaagtgacctgccactgagttcagtaatcttagtgttaaaaatgctgtccatttgccttgtgtaaagaaatgagacttacaaacatctgcagcttctattgtatatttttccctcaagcttgaagtctttcttctggatggaaaccaaatgaagcctttcacttctagctctagcagagttgccattcatgacagtctcatttttagaccactgattctgcagcttcgcctatagttttgtctaaatctcagattggtagcagctggtttcagttttatcaattagatcttagagcattttgctattttaatactagttgaactaatgctttgtaactatctgcttgttttagtatgtcttagaaagttgtataaagatagctattttgatcttagtaaaattttcccacttttcttctatgtataaccaaaatatttttcttttatctcacacagtttattttctgttttttgttttttgttttttttgtaagtggctgtcaaccgctttttctttccattgccagaatatcctgtctacctcattttctgtattttccattttaaaccaaccttctagcttattttctggctactatactgtcctctaaaacataaacataaatgtgcacatgtcctgttcactagtccctgaattctactctagagtttatctaaacaaatagcaataatagcctattttcatgtctttgtaaaatctcactttatgagatatgtcgtcaaataattgtgtccagtcctacttgctgtgtttctcttccatgaagagtgcatatatagagatctctacagagcacaactccatcacgtatttctagtactgagggttgttttctctttttaaataaataaaaatatgtgaactggtccatggggcattatttttcaaatgttctcctttctaacttgaaacaaataatagataacattttataaagaacatgatgagacatggtctatgtaaaattttattacttatctttattaaatagatctaactttctataagtgcttatatattacagtaaacaaaattgaaagtctgctaggctttttttctgggctagtactatttttgtgataataatttaaaagttatcaaaaatgcttctagctacaaaattgcaactattgtgtgtaatggtagaataaaaatttattctgagatactgaaaggagaatctcataaaatagaactcaacttttaaaattccattctcacaaattttttaagtattcttttttaaaagattggctacttaaaaatgtttggctttcttaagtgaatgtaaaaacacattattaatgattactaaagagtaggtatcagtatgatacatataatttattatgtcttatagaagggattttgagtgggagtaaagaaatatttgtgaaatagaaaagaacatgagaattcataaaaggtattctaaaaattcttaagctgaaaagttaaagtctgtaacagactaaacacattccaaatgcctctagatattacatatggatgctatctctcagcatgtggatacttgatacatttaataggaaagatttgtgttgtgctttcagtgcaaaactataaaaatatgttacaaaggtaagggtaataattttcagtgactaagcaaagcttgaatctctgtttataaaagtctttaaaagcagtattttaaagctagaatgcaaatgctttgggtttagtcttccacaaatgcctaaaaatgcactataaattctgttagtatataaaacgtattgcttttttgtctcttgaaagccatacaactttctctgtcaaccaagcattttatattcagaccttataatgcatatctatatataacagtccatatacatatgagtgttcatatcctcaaatatatagaatcatttaatactatattatcactctaagatttgttttgtttttagcttttattccaagcctctgacataagctgcttgactgaacaagttttatatatatcagcaatatctgggcaaaactcacttgaaatttattaccagatttgaaatttcatcatattccacaaatgctgaaaactgatgtgctcctttttgcatttcttaatgataataggcttgcaaagaaaacacattaaaaatcaacctaatccactgatgagaatatatttaatgtatttattttagattgctgataatttagagaatacttcgtgcagagtgaattcatcatgcattttgcttaatgctgttctcaactttccagcaagaagtcaaaatttcaccattttcaatttggagcagaaagcatttgtagcagctgtagctcttaatttgacatctagtttcaggtcattttcatgtaaatagggaacaatggagaccggcttacaatttccataacgtggatgtttccttcaactttattattttcttatgacaattatattttctctgtgggattaacggagccagtaattgttcacagttattatttataatctttatgaaaacttggtagttctactctttagtactcaaaagctcccagtgccttctatatttcagtcatacacacaatccattaatgtttctagctgatcctttccttaatcaggggtaggttaggcaggtcaggctttctatttctttctataatacattttcttcaggctttgcaacctctttttctacctttacaaaagtataggaggtgaaaatttggaattgttctgttgaatagaactgatgccctattgaaaagcaagtttgagttttgatttatattgctttgaacatgcccatatgtattaccaactgtggcttcacagccattataacacgtaattctgtgctttttctaataaatattttatttcatttttcctctgttccagagaagaagcctactttatgctgaagcatcgatgtgctttcttctgtgttttttatgatctgtacagcaattttcaagtgtgttttaatggggaaaattttaatttttgtgtacctcttttaaaatatgttgatttatgcagattaagttaagtaggaagttatttttgtaggtagtcatttccatttgttcctcttctaggagtaaaagtaagaaatcagatagacttttaaacattttgttttctggatcatctgaacataccaataaattatgtactcttttgactttgaagttgtattagttgatataatcctgagcaggggtgtgtgtgtgtgtgtgtgtgtgtgtgtgtattttagatgtgctccctctgttttttagcagacactcatttgtgctcttgtttttttctgccccagtgatatgacaagaacagtggagatttctggggaaggaggcccattgggaatacatgtagtgcccttcttttcatctctgagtggaaggtaagatgtttttctcattccagaagctcatgctaatgaaaaccctgatttgagctccttttcccaaatatttttcacaaggagattaaatgtgaattctattattcaaatggatacctcaagacatacttctgttggccacttaagtgttggaaacaaaataaaataattgactttaggatgtaatggggaaagaaatcaatcactgtttctccatttacaattaattatgaaatactttcttaaagtatccttatcagtgacacatagtaaacagaatccttggcaaagatgttaacatattgttagacaaatgttgcaactgaattttttaatattccagaatatacttcaacaagtgagtataataattccaaattgatatatcctgttattcttcaagtatgtagcatttagaataataaatattctaacattttaagtagctatatctgatgctgtgtatgtatgatggctttataaaagcaatgtgtcatcatgctgtattttcctaaaatataatttagtcaattaaaaataatttaccacatccttttggaatttttaatacattatgttgctaaatccacactggtaaaaatggcattgtagatcgtatcaacacttcttgaaatttacatctatctaactggatttaaaacttgttctcttgatggaaattaaagtgtgtgccacagagttcatattacccctgttaaaacaattgtactgaacttgttttagatattatgtcactttgtaataagacgaccacatttagcactagattgatattgacaagggttgtcagaaacttaaaagaaaatcagtttttcactaacatgacatgattttagttaacttactgaatttattttcttaaacacatcattgaaaaggggggattccttagtttagtttaggatatcaaagacgagacaagtcaattgattttcccaaggtcatacaaaatccagctctcctaacttctcacttcattgttctttcaagaactaaaattttctcaaaggttatatagtattaatttagtggttctgaatatttattcaattcagtctgccctatagcgaaaagaacagatttagtcatggtattttggttggcatcatattcagcaggtagccatctgctacctgtaattgcgaagtcatcaccttttttttttttttgcaaataacatctgatgccaagctctcactggaatgaatgttccccaaaagaaatgaaccaaaaagctagcaactcttattgtctcatttcctgtgtgtgttaataagtgtgtttataaatgttatgggttatggcataggacaaactgaggttgtttttgatagatagggtgaatatttactcagttgtcatgagaaattctaatgacttttggcagaagtatactgacagaattttgtgaactaccagagctattaaatgaccaggctctttagtttaatgaaggtgggatagagcacaagatcttcccaatttccaaaaatgagaaaatatacagtgtgacagtcactagacttcattttcagtagttcagaaaacaagctgatcctatagatcagaaatcacattctctcacttcaaacgagggaaatacactaagctttattgatttcctcccttccttttcctggttctgattcctagcacaagccttgtagaatagaaggaagagtattggacgtggtttcagaacaactggatttgaatcccagtgttcttttttataaccttgagcaagtcccctaaacttgccccttttgagtacctactttacatcaaggttatggggattaaataacattaaaaatgtgaaagttccttgtaaaacacctaatgtatgaacgtgtaaatcatcagtctgatgattattttggctaaaaccaaaaagcctgattcagaaatgtagttttattataagttcatggttaactgttcagtaacttggtgaaatagttctattatttattttttgctatccaccagtattataggaaggaaatttaattaaaaaacattaaaaatgctatggaagtggagacatgagccaataaaagttaaggagtaatgagtacaggctgaaacagcacgcttaactcaacccatgtgtctagatgcaactgtgtatagagcatgtcagacaagtgtctgacttcataatgccatatggtttcactgtgtgagcacaggggcttcgttaaggtcatagtggtatactttgctcttaatttccttccatttattggtttgtgccattattttaaattagaatttacatttaatttttttactaagattactgtaattggctttgcctccaatgtatttttttatttttttttcttttagaaaaatgttgccacacctgttgttgaataagaaacctaatctaagttagatcatcctaataagtaaattatagtggctgctctgctagataaagcctcaatgaattcattagataccatcgcagaggggtgctgaatgctgcttgtattgagggccattggctttcccagtaaaaacaaagcaaacataaaaaaaacaccaaagttcttgcaactaaaatgcaacttaattttattcagatttttaaaatcaatgtggtttttgtgaattaaaaacatgaaatctaattcgtttcagtacagatgcataatatgcctcagtttcatagggaagacagctaaacaggagagagaaggagaaggactggatgaaggctgataaagactgtgagaagagatgttcaaaccaaaattctaagctggtagagtcactgaggctgtgtgacattgggaaaagaacaggaagggggcaaggagaagatgttggtgcctaaatgataattagaagagcaagaagaattgttacccctctaattctgtgaggctgtggatttcagcatcctttatcactgttcattaatgcaaattaactggttagtctcggcctataactcctcgacagcattaatctttaaattctgcgagtcttggtcccaaatgagacagctaccacagcccaccagttcagggcaaagaggataatgaggtattgttttctgagccttcttgtattggtctggatgaaatcaaactggagggaatctatcccttccacggagcagagagggcagaagtggtttgttgccagggaccaaactaataaaatcagtcagttttacattttaccaaaattacctctgacacatgggttttacagttgggcttattctgtcaataaatttttcatggaaagttagattatttagatcagtgaggttcacatagcatactccagctgtaatatgccagctaaattgcaacccagtggcccgaaagaattaattcatctcccaaaatgtgaaattaaatcctagggagtaacattacatgactgatgatgtactgaattaaattaaaggaagacttgaatgcttgttaaaaaaatatcacttacataaacacgtttataaccacatgtgagcctcctaatgaatcaagttattgtgaatccaccctaacaaaaatccaaaatgtgaactcttaggatgctgtttaatttagggaaaaaacccataagttttatctattattttaatgtgtcaaatagtttcatttttaatactgtgtttcaagattaaagtaacacagaatatgactaatttgctaacctactggaactaggaaatgaaccacaagaccccactgcacacttgtgcctatgaccctgagccttccctgcagtagatggcatggctgtttgctgttctttctcctgcagcagcgtgctgtattcatttaacattttgaagtgagacccaaatatcactgccatgcctgttgaggtcttgagatgatgggagctcattaaggggacagaggttcaactccgtggccactccaaacaggaggactactttctctaatacttgcattgtagattccccttttctatggctgaccctgttatttacacataaaatgtactcatgttttatttaggtttgaaatttaatgtgaaggtattttgtaatagcacacatggattttatacaaaagagagtgacaaagtcgaaaagcaagagtattgataaagtgcagatcacagtttctccaaatgtagcagactcctcttgcaggacatatctatctttcttactctggacacagctaagccttgtcacatcacgaggagaagggaaatcccacaaataagaaataatgaaaatatgtataagttccatttcttacggtttttggtttagttttggtttatatatgtaacagaattgtgtatgtatgtgtgtacacacacacacacacacacatacacacacacatattttaattctagtggctatagttttctttcttctttccttctcttccaaccctcctgattctaagctacagccacaaaaatccagaggcctctttgtatcctctctaatttagcctcttcttggttgaaattttggacaactcttcccaaagcctgccttcatcatgtcgctgccctactcggaagcggggtctgctagatgcccccctccaggtccatcagattaagttcattggctgtttgttcaaagcctttgtgtgtggcactggtctcccatctagttagctctcaaatctttgaaggctctaggcttgttaatgtctttagtttttggacttcagctgtcccccaaatgtatagtgaaattacctggtcctggtcctatgactttgtctcatactcctccatcctgatcacacaggaaacacccaacacatacttgatttggtagcaccaacaaatgggatccagcttccttctaaactgagtaatatgatctgagcttaaatgtttctttacttcttaaaatgcaaatttttagaataggtagtaagactgcaaaaatgttactgtgaatatcctaatgctctcccactgctaaacatcacgttgccacgttggcactaactcagacttactatagtcaggtgtgatgcccttctccaaaccacaagtctttggtgtcaactccagtaaactagcctttcaataagtttactgcaagcatgagaaatgaagtcgcagattgatgttggtacttatgcatatttatctagaagggctttttctcttgtagtcagttttggctttttttggattagggattaaaataacaaacagttgcctgaatataaagtaaaatttcttttgtaaatagaaatcaatatgtatttctgaatagttgcaagtggagaaataattagcatttattattcagtaattatatttcaatctaaattttgcatttaggattctaggactcttcatccgaggcattgaagacaacagcaggtccaagcgggagggactatttcacgaaaatgaatgtattgtaaaaatcaacaatgtggatctcgtagacaaaacctttgctcagtaagcattttttcattgttttatttactttcttgatccctagcatggttataagcattactgaactcattatgatcaaaatagtaggtagaatttctagtcagttccctttgaacgatccaggatatccattttcgaatgcttctaatgttttagcctactcaaaggtggcccacacatgtctctggcaggtctgagaatgctaaactacagaatatcacaagccttcctgcctggctgtctttactggggcgtcgttgaacgggtttgtttttcttgggctatgggtcacttaaactggtatttaacggctcttttcacagactgttggttcagcttattaattaactttcttggtgtcagcagtcttccttaaactaaaaaatctgtgagagatgtctgaggactcaccgaatcatagaaacaaacagaaaaaataaaataccgtctcctggccaggcggagtggttcatgcctgtaatcccagcattttggggggccgaggagggcagatcatgaggtcaggagttcaagaccaactggccaatatggtgaaaccccatctctactaaaggtacgagaaaaattagccaggcgtggtggtacgcgcctgtaatcccagctacttgggaggctgaggcaggagaatcgcttgaacctgggggacagaggttgcggtgagccgagatcgcgcctttgcactccaccctgggtgacagggagaaactccgtcttcaaaataaataaataaataatactgtctccctcaagaaatcatctttctgcatgtgaaaatgttaagggaatagcttcctgtacccaggaattagagtgtatagtaatctgatgcatatttttttaatgtgtgttggcattgcagtgggattctggaccaaaggactaagtactaataatccttgggagtcatcaccaccctcttgtttctgaccaaaacagctcctaatacatcttctcgctgggcattagttgtcaatattgtatgcgtgtttgtggacaaagatgagtggttgtgggtcgaggaaaagtgggtactggctgctaagtatgaaaagaaatgaaaccttagaagaatctattgtgttaaaataatgaatgatagacaaaactatagttagtaataatttttaatatactactgtgctttttcacaaggacttgataattatgcaaagcaatcattattacttctgttttatagaggtggaaactgaggctcataaaaatttagtatagagttagtatggagtagaaactgattcctatgcaagcaaaaataacataggggaactgaccacaggagttaggtggagttaggcctatgtgaaatcttccttctcccctaacaatttgcagaattaagcacttcagaaaggggggtgcggggtagggtttaaggaatcagattgcagttgggattatgattagttattatgtgctgtggctgctaggaacagagacctgaaataagaatagctgaaacaagattaacattaatttttcctagcaacaagcaaacgtggaagagggcactccacagttagtgcggcagctgcacagccgccagtgggtcaggcagcttccgttttctgctttgccatctcgccatgtggctactatccttcagtggaaaaatgggcacaagatggctgctgagtttcctcagtcacttctgagtttcaagaaatagggaagagaaacaggagaacaataaaagtttttgtctctctactgaaccagccgcttctaaagagctttcctttaacgccttcatttatatcttctgggcaagaaagagtgggaaaggtagttgtttgacctgggcacagggcatctagaggcatgaggaagaagaaaatgttataagaagtttgaggaagaacacaaagtgttaggtcataaaagtgaaaaacacagttgctctgtgtgagagtaacaggaagggtgcatgttggattgaaattccactgagacattttggcacagccaaagcacctgccaaaatgtctccatgagcaaacatggatgtcaaacttgaacttgtgtaacacaacccatgttagagaagatctgtactttagaaggatgtcctaaaagaaacctaactaatgatctgatccaaaatatctattttgctttttatattcactttggtaatcacttctggttagattttcatctttagaaacatgtaaaagctgtgggtcattggataaattatttcatctctctgagcctcaacttccatgtccgtgaaatgaaagctatttatacttaccgaatgtgctttctaaattagagaaggatgcatgctaataatgcatgtataagctagtgcaggggcacctagtgcaaatagtaagtggtaactagtatgtagttggcaaagtcattctgataggaatattgatcgtgtctcctatgattagccactgtgctgctcttggttgccatcctcctggggtactttagaagatgctgcacctcaaagcagggtcatcatacatttatcaactttctttccagggctcaagatgtcttccgccaggcaatgaaatctccaagtgtgctcctccacgtgcttcctccacaaaaccgtgaacagtatgaaaagtcagtcattggctctcttaacatttttggtaataatgatggcgttttgaaaaccaaagtgccgcctcctgtccatggaaaatcgggactaaagacagcaaatctcacaggaaccgatagtcctgaaacagatgcatcagcttccctgcaacaaaacaagagtccccgagtaccaaggctgggaggaaaaccatcctctccctcactctcgcctctcatgggatttggcagcaataaaaatgcaaagaaaattaagattgacctaaagaaaggtaattattaaattatgcctaatagcattctattattgtaacatgtaaaattggttaagagaaatgcattaaggctaatttagttaattctcccttcatttaattgtatcaaagaatagatttaagtgtatacttaggtaacttaaatttcttgaaattgtacttttttattcttttcttcggagtgtatagattattttaaacaagaaaataataaagacatgttgggaagtggaaagaatcattgcaaacctgatatcaacagagcaatattgtattacaacttaataccaaataggcatgaaaattcagttgtccctgttctgagcacgattagtgattcttgaagcatcctttaggccatgtccaaaaagcatattgtttttctaagacagtcttctaacaacaaaaatttactcctcagaaagcaaatatgtaatgtttactaatttctctgattcaacgtcacaaacatttaaaacatacctaatttcaaaagcatgtataatattttctttcttcatctttttcaacttttctatccatttcaagcacagatcagtgagaagagatcatgtgtgtacatgcatatttatgcagtattctacacacatacataagcattcatgtgcttctgtgcttttgttcattttgtaacctctgctttatattaccttcccccattgcaaccttctgaaattctgtgtttttcaagacaactcaaaagaaaccaagatcttatagattcttgtctgaattaatagagaatttatggtcaaaaggtagttttagaaaaactattaaggtctttcaaaaacaaataatgtatcatcatttaggatatgaaaattattctggaaagattctctgatcaaaatttcattcacctataagaattctattctgggaataaaatacattgactagtaggtacaaaaatacttcagtgtgcttatcaatcaggttttttatttaaatgcctcagttgtattttttgtacaaatgatccagctgtgtgtaagacacagatttgggtgttttgaatatagaaaaatgaatcagacacagaatcaccttaaaaatttattacaaagccttgaatgcaaaaatgaaagatacgacatcacatctgtactttggcaagattaatctgacagcaaaaagatacactgaagacaaggccaaacaacaaaggataagtaaagggtgcactgcatctgtctaaaggtggaaacataataggcatgcattaataaatgactggttgtaggaaggaaaaaagagaagaattacagtgattcctgaggtttttcagccagagcaagttgcataatggagatgtcattgctagaaattagaattttaagtagatgaggatatttgaaaaggtcaggatctggactggagagggaggtacatagtgaagtttgaaatgtgcatgatgacatctaggaagctgatatcaaaaagagacattggagccatagagatttaggtctctttcattggaagatatacttggatccaggagctggccaaggcagggagtctaggggacaaactggtctaagacagatccttgaggaacatctgtggctacatgggaggacaatgagtaagatttagagagagtgatggatgtgatgtgatcaaagataggaaaataatcagaaaataaagacatgaaaaccaaagagagtcaatttcaaaaaaaaaaaaaaaaataagtggtgggaatcatcaaagctagaccaacagagatggtcgcgggtaggtcactggtgatggaagcttgaagaagcagtaagatggaagtaaggatccttcagggtagagaaatctgagcatacctttagactgagtgaaaaatacatgagaagggagaaattggagatgcaggagaacaggacaggaacaacaagatgcttgctgaccagacaatgggatgcagcagtacaaggaattgagacacaagtagagggctcagccataggttgtccagctcatgtaagaggctgacagaacttaagtcaaatggccttttgcttctcaggaagtatgaagtcaggttatggtttattgagaagtcaatctcctgggcatctggataacatgtgcatttcttctagaacctgaataagccaaagtgttacacatctggattgggccctaaattcactttgatactgtcatggcctgtcaggaactataatctgcatttgaaacacaaataactgaagcatatttaaaatgtcccagaatgtaaatattttactgattctatattagtctaaattaggtagatcttactgtaagactgaatataatattactcatgcttaagatgactatacattttcctgttcttatacactaggccctgaaggacttggtttcactgtggttaccagagactcttccatacatggtcccggtcccatttttgtaaaaaacattttaccaaagggagcagcaataaaagatggccgcctacaatcaggggacagaattttggaggtaagaattggaattaatagttgtatgaaaatatttcttggcatttaaataatgccatttaattgcattgaaatatatgtaaatatattaatatttttattttgaacctaatatatattaaaaattattacttatagacaagataagaactttaactatagaactggttaatgaggagtctaactttgtaaatccccaataaggtcagtgatatggggccaaatgatagtgaaaaccatttctgatcttccctctcttatttctacctcttagagtccctgtgaaatttggattgaatctaagaattcaacatatattcagttagggctaaaaagttaaaaagtctttgtaatagtcttttcaaacttggccaggacaagccagagtatctcaggtcattctatgctttgtccatatccctatcatctgtgctaggatagcaatgaaaacagctggaagggattttgcagagagatatatttgggataccaaaagcaagagggtggctgtttgttttcatttatttttgtctgaggacattatcgtcttgataattatatattgtccatttacctttgaagcaaacatcttcattaaaagcaacactttagcttttcatgttgttctagatcatgaaagaagatgcaccaaatgactactgtagctccaaattagaatttcccttaatctatgataatctggtgactataattttctaaatatgtttaaaacctgcaggattctattgctaggttcgtatttgcagagaaatttgccttgtgatcatggttcactctgcttgttgaattaggcagaaaatggcgctaagtaagcctttgcaatctgctttctaccttaagcggaatcattttctggtatctgtcagtccagtttcccccacataagaatgtgatgtcttaggaaaaactgctgatattaattaccgactctgagttcatccagcatcatgatgatgcattatgggaaatattgttgggttttgcccatgtatttagttatcatcttttcagagcttcctcaagtatgggagcccatttgcttcttgttttcaaaaactatctagtgtagaaggagataacaagtattgtgattgtggctgttcatatgcttttattcattaggtaaatgggagagatgtcaccggacgaacccaggaagagcttgtggccatgctcaggagcaccaagcagggggagacagcatcgctggtcattgcccgccaagaaggacattttctgccccgagagttggtaatgttcagatctcagtctcactgaatttttaatgccgagcttaatacactcaatgaactcattatagctgagaaacgagttctaaatcacaggcttcattcataaccaaaattgaatcacactcagggtattttaccccatttggggtatcgcatttttaaaacattgatacagccagtgggtatatgtaaacagtgattccggggcacagattcaaacacctttagcaataagcaactattcaacagtatgcaactaattcaataaaatatatattgaatatgtgctacgtgcgaagccctaggcaaaacacagtcagcaaaataatttgtggacctactttaatgaagtttacagtctaacaggaaataaaaagatagccaagtattcaaaatggcgatgaagattatgaagggaaaatgcagagtgccatgataacatagaacaagggtatttaacctattcttgagggctgggatagacatcttgagaaagatgagttcaaaagccttattaaaaatgtatacccttagacctagtaactagacttcaagtaatctgtcctaaactgatgatcaaagatgtggaaaaaattcatgtacattgattttttcccctcaagttctatctattgcagtgatatattgggtcctgtataactgtaaggcattggttagataaataactagatagcttgccagtgaaatatagaagtacttaaaatggtttctgtaaaaaattgataatacccagcactttgggaggccgaggcgggtggatcatgaggtcaggagatcgagaccatcctggctaacaaggtgaaaccccgtctctactaaaaatacaaaaaaaaaaattagccgggcgcggtggcgggcacctgtagtcccagctactcgggaggctgaggcaggagaatggcgtgaacccgggaagcggagcttgcagtgagccgagattgcgccactgcagtccgcagtcccacctgggcgacagagcgagactccgtctcaaaaaaaaaaaaaaaaaaaaaaaaaaaaaaaaaaattgataatagcatgagaaaatgttcataatctaatactatatttaaaagtaggatgtaaaattatttgtgcagtatcattaaattacattttaaaacgttaacaactagaagcagatacatctgggatattggttatgagaggttttcattttcttttcttaccataaataaatattatttattttattgaaattgtgcttttaagaatgctatagaaaattcaaaaggaggacaggtgcagtggctcatgcctgtaatcccagcactttgggaggccgaggcaggtggatcacctgaggtcaggagttcgaaacctgaccagtatggtgaaaccccgtctctactaaaaaatacaaaaagtagccaggcatggtggcatgtgcctgtagtcccagctgctcaggaggctgagacaggagaattgcttgaacctgggaagcagaggttgcagtgagccaagattgcacgagtgcgctccagcctgggcaacagaacgagactctgtctcaaaaaaaaaaaaaaaaaaggaaaaagaaaagaaaattcagaagggattttgtagctaataacaaatagaaacaaatgtgataaaaggacttgtatttactccttgttatttcctttgaatctgtataagaattgacaaaggcacatgtaggttcccagagttaggttattggaacagtaaggattagttgacagaactgatgatgtttcacttgaagaagagaaattttaggagacatgacagttattatcaaatatgtaaagagttattgtatggattggaaagtagacctgatctgtttcttcagacagtttccaagtttccttggcatggaattttctttctccctttccttctctttcccatcatcttacccatttttccctttccttattgtgtactctggggagatctgtaacaaaatagggaaaataagaaaaaaagagtgatctgagtcatgcagatatagtccccatttccattcctctacttgactcctccatacccaaccatttgaaaggtagaatcctgaatgtctgtctcatctcctcacactttctagagaaatgatgcagaaacttggagtctggattttttttctaaaatacagatggattcttctttcaatcttttatttatccaaagaccttggtctttctctacaagggtcaaagtgaaaagaaacaataaaaaggggggcagttatgtgtatgcaccacaagaggccctttcatttcttgtctgatatttaggttgttagaaataaaaactctccaaaatcctcagtggaactatgtgcttatttctgagataggagagcaaagaaataagttttgactgtgtattccattgaactgtggtcctggaagaaataaaaccctgcataaaaacagaaatatttcaggcagcccctgagcatgcaaaagaatgcaaccacagaactccaactaggaacttaaaccctcgagcctgcagtttctgtctagtagttccttatacctttctcccatatgtcctctggaatttttaaccccacagttaataccttcttcctagaagctatgcccctccaccaggtaagggatgctgatttatcccagtttgaagctctgaattcattcctcatcaaaggcaattatatctggaagttagcaactggaataacatttaacattgtctctggagttcacatcccagaattcaacttctgtatccaccacttactagctgtgtgatgtagagccattcggaacatcactcagaggctgtttcctcatctgtattgtaagaattgttgtgaagattaaatgagataatacaggcaaagcttgtagcatagtttctggctaattgtaagttctcaaaatacgttagctataatttttttttctaatacatgaccatttctgtagtagtgtaaacacaattctatactctagatatattatggggtagatagatttatgcagccttgcctgggactaaccactatttttgaacaatgattgttttatttttttattattttataatgtattctgggatccaaaatactgagttaaaaacaacatttttataaccagtcaaattgataagggaggcagctgtatgtgttatttcactctcatttaatggaatttagtgaaatttgatttctatcccagaatgacataggccaagtccaccagggagcatattaagttaactgtgcaactgtgagattatgagtgcaaacaaattatttgttctcattgtttctagttctatactaaatttggagggtatatgcttagtattcattcctttagaagtttctagcaaatatctagactctcaaaaatagttgacagtcaaccatccaaatatgtggaattttctttgtcaccatagcaaagcaagggcatttgaggtttataagcacctaagtcacgtggacccatagccttcctattggagaaataaggaaaagcactctttttccagcccaaatgcctgcctcgaatgccaagaggcaagaaccttgcaggaagtttaaaaagaggtgatgtttggcacgtgctgggctatttcagtgggaattacttcatagtgtggcatacaccggcctgtttgaaagggcaaaataaagaagtgtgttatgtgatacatctttgtgttttcctttcaaaaacttgaaggtgatatcactttggtctcttcttccttatcatgattgatgtacacacttgactttccattgaaaatctggcaggatgaaggaaggacagcacttcctacttttgtcgtgttctatctcctttgaggaaaacaaactgtgtttattggtttcctcttctaagaaactgtcctcttttgttaagccttgctgttctgcgagctctgtaccttcttaacagcactgcactgcctagtttccgacgcttaaatcttccttacttccttgttatcgttagcttcttgtaaagtcttaacacttaagctaagggagcatgtggtcagcagttatacaggaagtcccaatatagaattgtctcttggatgtgactctgtcattctgaaggccatggtatccatttcctggtcatttctcctgacctgccacctaaaagaactgtgctgaactcctatattctagttcgtgtccttcctgagcaattgattaacgtcccaagtttagcagcatatttagccaaccttctttccatctggggcagaccgggttgaaaatcaagtgagaggaatttatataataacattacaactatttagctgtttctagtatctttaccaaaagaagggtatttcaaagataatctttccagaatcccattctgaaagatcctttggtgtcctcaccccctgactgggtgagagtttactgaagaggtgttcacataaggaacagttttgcagaaggtactttgagattagttttggtaatagatttagaatctgaaggctaaactgctgtgtctgtgtctatacttgaaatgaaaactatgctagttaatcaactggtggtttgcgtggtcagttctgtaagagatgtggcctacaaattcttttctgtctctgatacctgaaattctttcttatgctaaatgtcagataaagccgtatttccacttaagaaagctcctgaaaaactgaagtttttctgttaatttcatggcttcatttctttaagagctagagagagaaggagaaagttatttgctatgtatgtgtgtgtacatgtgcatgtatgtgcatgtcttctttttttattgggtagaaaggaagattctgccctttctttgttaacctctttaacgtttcattttctgacctgctgccttatttctaaatcatcctgaaaatcacagcaacccctggtgggtaaaatgagcttaaaaaatttcaaatgtatttataatttctacctgccacgtttgcctgctatttgatgctggcctctgcaagtgagattaactgtatttcaagcaagcaagtttctcctgcctggcatgattgaaaaccaaaagttagccatgtttgtcatgctgctttgaccttcacttaggaatattgcttttgctgagaaaaaatgatgcacatgcatgtggaaccctacttaacagttgctgagcttagtgtagtccaacactgtcatggttacctgtccctgtgactaccttagcatgcgagatgtggttccaactctttcttatttttaagtaaaaagttcacatcttgaaatgtcaaattatttagcatcataaattatagaattttggtttgaaatcttagatgaacctcatttaaatgatatattatttcattccctttggctatttgattcaaatgattccatgcttaattaactgagatacttaaggaaaaatgaatattatagcagttatttgtggataagtagcagaaattgaaagataatttcaaaatgatttttctacctaaactaatgtgcatgagatatgttctggaatttaaataattatgcaaaatccaaagtaccttgctatattttatgtattctccaagtaacacagttcatgtcttatgatgaagtccttgctaagacagagtttctttttcagcttttccctacaataatttccattttcttcttactgcattttcattcaaccagtatgtactgaatcttagtcaaggctctgcaacatgaacttccagagatgaagctagaagcttcatctgaagatgtgtcctgtcttcaaggagcttctagcccataaagaaaagaagagtgataagtggatcaaatgagcaaataaattgttacagggattcaaagtatgtcaggaaccaagaaaaccttcaagaacatgacagcatttgaaaaagagacttgagaattgaataaatttcaagatgcagagccacatgggcaaaagaaatactctcttcagttactcagagattagaaagtactaaagtacaataagaccgtaagcagcccagtttgacagattaccgaacaggagactaagatgagaagtagtgctattttgaataagtttggaggggaaaaaagatgttgggatatctattaagagcttattgtaattcactagagggtaccagtaaggagcttgggacctggaatccgtcacacctgggttgagccttgactctatcacttattgattaaatggccttgatgaagttatctccctgagcctccattcctcttctgtaacacagggactagactagtgtctacccaagagactagttgttaggattaaatgagatgcatgtaaaatgcttacattgggccacagagaatgggatttaacaaatattccttgttattataaccattgctcatttgaatgagagatattaagtgcacagattagattttcccacctgttaagaatggagagaagaaaatattgtggtagaaaactttggttttggcaactggtagatgtgggagtgaaggagtgagaaatatcaataattccaaagtttttaatttggctgtgttgtgatattattacttgttgcaggagaaaacaatttttattatcctagagttttatgactttcatgaatcccaagctgttttatgggccagtgagcctcggcatttttcttcccctactctctactctcattccaaactcttcatctttgaaagggaggacactcctctcctcccttttatctcaaaactccttaagatatctacttataggtcatttgcttgggcaaagcttccttgaacccccaagtctagtttatggaaccttacgcagctttccatccatattaagggttcacctcagcatgcgcccgaatcacacaatattataatttctccaatagaccttaagaactataaagaaatagtccttaagatgccacatttgggaatctcatggcctggatgtgaatccctgctttgcaatttcatttagcctttcagtgtctcaatttcctcatttgttaaaaatgaggataaaagcaacacctaccttgtagggttgtgtgagaattaactgtgtgcagctgttgacgcacagtgagtgccaaatcatattaatccttgttatttcctgtgcctagagcatagtgtatgctcagtggatatttgttgactgaatgaatgaaagctacgcattactaaagttggtgatatagaaggctgggaaacgtattactaaatgagccattactgctagtctgtatctagtctgcattcagtatattattatcctgtacaattcttttaaaccaaattaaaaaaatatatgcagggattttctctgagcaatagcgatttctgatttacagctgcgtgccacaatgagggttaggatagttttccatgtaaatgacagcttcagtggtttaagttaccatgatgacatttgcacaatctagttgtacagtttacttgtaaagacatatgagagccataagtatcatgttataatttgaaatgttagcggtatttttacagtatcgtgttaaagtattttaaatgcttcaatttgggctgcaataatttgttagaacaatggttctcagagtgtggtctcaggctagtagtcttggcatcacttggggatttggtaagcatgcagattgccaggctccctccacacctactgaaccagaaattctggaggtgggcttagaaatctgtattgtaacaagccttccagataattctggtgctcactcaagtttgagaaccattggaatagtggtttcattataaagaacatgaagcctgtaggataacttagtggctattgctgactagcttcagtgatcaaattttcaactttatgtctcctgtgaaaaatgtcttgttctgggaaaaatattctgtgaaattttttaagcccagttgagttgtgcctttttggctatgtgcccctcattttggcaaagggccagtgctgagtgcaatgcagttacccaactcaattacccctgattcatttaggcaaactcaattgtacttgactttctcaggtccaactcgattgtgctttaaaatttccacactcaatttgattgtgctcaaaattttttatgtgccaccttgtaacttgtagattcagacacatatcacaggaggtacttttgagagacttggaatattgggttgttggtatttgtttgcagttatacccatttcccttcttcctttcctcttatcacctctattggaggctttagggtaagatatgttccattgaccccattacatggacaatattccagcatccacccttttactatggttggactcaagttagagatatcacagattctaggaaagtgatccttaaactgtcacaaagcaactgtgcttagtttccatttatctcattttaaagatgaaagtgaggtacagaaacactgccccttaccagcatttacatcgtcaaaatcagaaatacgactgggtgtggtggctcatgcctgtaatcccatcacttcaggaggctgaggttggtggattgcttgaacccaggagtttgagaccaggctggacaacatggtgaaaccccatctctacaaaaaaaaaaaaaaattagccaggcatggtggcacacacctgtagtcccagccacttggtaggctgaggcaggaggatcatctgagcctagagaagtagaggctgtagtgaaccaagatcatgccactgcatctagcctgggcaacagagtgagaccctgtctcaaaaaacaaagtcagaaatagcttttaagtaagacttccacctcactgaggtaaatgctgtaccttctctcacttgtgcaatgtgctcagagactgggtccttaatcatggccagctttttgaatgtgctcaatagcccacaaggccaagggattaatagtcatttgctgctccctaagaagtacttatatctggaagaattctactgaactattgtcagcaaaatctagtcttgataaaataggtgatgataaatgctgtggttcagcattattaaaacagatggaggaagtgcggggctattttgctgggttgtatggcttccaggtgtcagaatgtaaatacttaatggcttttatcacaagatgggttttgttggagattggaaggtagtggaaggaggagtgttctatgttgtaaagatctcatgacatttcagaaaactggggcctaaatacgttgtcttgcaaagttaacagtgaagagctatgagatttggcctcattttcatggtgcatgacatatgtcttattagtggcgactgtggctatgattatgcttctggagactggagaaaaagaattttctgaatttatatatttgaacagctcggaaaaagtcatattgtgaccaaccacctactatatcttatcatccagttagccaaatgttaccagtaatttaggccagctgttgatttggagcaagctggataagaagttggttacaaaacttaggggacaaccttgatttgcttaattgcctccatgcctgtgatcagtacatttgttaaggtacatttggtgtaaggtaaggaaatgtgttcattttgtaaaggatctttaaagattagggaaaaaaatactaccttaattgatggtggttgacttttccagctgttatcaaagtaaataccacacatgtgaaattgccactacagtccatctcattttgagagtatagttagaagtctgaacatgtttcatctgcctggttttccaggaaaatgtgtgatctttatcattaaagaatatcagcttaagatcacctttttttttttttttccctaagggctggtaaaacagagatagacacttaaataacaatctgttgctacttacttcttctcctgccctgtccccaaagattctctgggcaatgacttttaaatatgttctcattatttttaatgagtgtgcagaacatatgacacataacgcaacagtagataggtgcccttttactgaacctgtcggatacaatcaaacatcgcaggggttaagatgcatttttctttaagatactataattatttaaattaagatgttcaagtacacatcacatactattcaattcttgctgctgcctaaatgatgccccaccacagtcccagctctctctttaaaaagaatgttttatcccaaatgttaaaaagaccaaagaacatttaatattgttatgtctctttaagtttacacttcttaaaatctgtcccggatggcaggatattcaattataaacgagttcaatgatgtttccttgccactgattgagttatatgaaggacttctatcacctagtctttccgtaattaatcctttgcatttcttagaggtttagcactgccccccacacaccaaaaaaaggattgtttaacggcttgaaatgttgtttcaattttcttatatttcttctttctcccctttaccttcctccttttctttccattcttgcttctgacctcccatcgtacctttctggaactaagtaacactctatgtgtttctcaattatatagaacttatttacttctacttcacatgaaaatgccaggtggtggtggacataatagtacattacattaaattacattaaatgccattgaagatggcagtgatggcagtagaatagagaaagatatcagctctgagaacagcaaagctgcctatgctatgcattcgtcccataaatattggagcctatggttcccggcttatggaaatgcctgccttagcactctgcaggtaagttacagactttccacatgacttgaaagagctggctttcacccttctctccttcccagcagctatatatttcatctttagacccttgacttcccactggaggagaaaaacaaacagaaacaaatcaacagaaaagcaaacaaacaaaaaacagcacaacagaaaaacggccacccaaaacatcttagccatgatttactttcactccatctctctgaaatgaaatgttctcttctatgataatcaaagaaaggttgatgttcagaagaattgccatcttccacctctctttcccttttttctgggtccacattggagatgacaggaatcaattgttcagcaagtatttactgaacacctactattcccagtttagctgatcaaatatttattgaatgtttatttttgctagatgctgttccatgcagtgggtattctaaaatgtactaaaacatgattctttaactccaggagttcatagataatgctaagtggtattagagaaacaatataagaatatagcatggtacctgtcagtagggaaagctaatgaaagaaaaatagttgcacaagtttcaggaagaggttaaggggctaataaggacataaaagttataaaaaggaagaaattaaagttctttaaagtcaaaagactttaaaagtcaaaggactttaaaatcatgaaagatttcgtttatgaggtgggactctggtcaggccctagatagattcgaagaagcaagaagagaaaaaagttccagaaatatggacaaataatgaataacgaacatctttccgaaggcaggaaagaaaactgcagaaaaggaaggaaaggaacagaaaggaacatttttgttagagtgacatgttgttggctacttatgctatcatttaaagtcggtaacaagaccacatttttttaaaaacccatcagatgtgaatttaaaatcgaactaatgccctcctttataagttctatgttttagttatctcttgctatttaacttaactacccaccactttaagagttaaaattatgttttattatttctcgcagttctgtgggttgtgtgacttcttcccctgccagtttcgtttagacttatgcatggagctgcattgaaccagagagtctactgggcgggaaggcccagaatggccttccttacacgtgtctgtcagttggtactctaatagctgttgggtgggacaccatggtcctccttcatgtgccctcccaccctccaaaaggctagttcagtgtccttacatggcattctccaagacaacaaaagcagaagatgtagggctcataagtcttaactttggaagttgcactgtgacttctgcttcatccttttggtcaaaacaaggtcaagtcacaaggccagacaagatcccagggatggaggaatagattcctttcaggatggaaagagcaccaaatcacatttcaaggagatataattcatggagtccgatagggaagtgggagtgtgcactgttctatagccgaataagtattggtcagggatggaagattcaagttatcagcccaggactgtcagtagatggttgagttttgaatggtcgtttaatttcttgagtcttaattccgttcatgaatttcttattgggaaatcttttcccaataattcttattcttattttcccataaattcttgtttttatgcaaatacagtgttgaagatacagagtaggccaggcatgctcctttcccctacattgctgtttagcagcgtttttacctaaaacattgtggctcttgacatatacgtgcatttctctcttatgctggacaccagtctccctagatgaagaatgtgctttcccctcccgttcttctcccacctcacatagagaattactcttttagacatctacaatctgaattggcattgaagaatagaagtttagttgtatagatgttgataaactaaattttagtatttaaatgctgaaattatcaaaaaagtaatttgacaataaagagggagaagaattttttttatctgtaaaaggaggaaattgaactgaattgtcttttaagattctttcctattccaaaataacctctaagtttctgtgcatcaaatcttggcatgacactcaatacagacagtgcccaaattatgaaagatctgtatatatgaatgggaatgggctgcatgaattctcttcttagtgtttgtttgttccatacttcagaatgtctggggaacatttgacctagagattaccttaagtaaatgtagagctaacagattgccaacagatatctttctcatggctacctcttcgacccctgccatggcaacgcttgttgccatagtagtaggcacagatggagcccttcctccaatcctctactgatgccaccactgctgtgggtagcataagggacttcactcccatagccagctcagagggaagtgtgatccttcattcctgaattggaggtttcagtgtattctcccatagaacatggttaactataacccatccaatagaatgcaaattattacttactagtatgttttggagataccatggagtaaacaagcactcttggctaagagagaaatgtagccaaaatttatcagtattttttttttttaagaaaaacaaaggctcaacgtgcaggcaccaagtttacagacaaacttatggcatcagcctgttttctaactagaaattgccttgcctgtacccacacccacagtcattgtctacttaaagcttgtttccattacacattaaaatgaatgaattacaaacattattcattaaggttttggccacctttaataaaaaaaacctctgggttctggattcttctattagaaaaatatgactatgtcaacactagcaacttgttggaaactgggcgtatattttcagtgtaattattaatgcaatcacctcaattcctctttggtattaggttgcaaataaattatataaataagtattaatgcaattattaacttgataattttatgtactatgtaggcatgcaaggaaattaaacaaagatgaaggctgctacatttgttcatgtttgggatatacataacagtgacttattctctatatcataaagagatagaagtgtactagatagaactttgtcttcagctgtataactgagtatgattgtaaaaaaaaaaactgagtatgattttcatggtggttaagttaataacatgtcactattatttgtgcccttctaaaacagaaaccaaataaatcatgtgtgtcctaactggaaagaaagtaaaggcaaaaagctgcaaacaagctagtggcttacttattaagaagccaagcttttgctgtcagatagcagttcagaggttcctctttaacctgtagggtttcttgcagaaaagaatactgatcgcatgtgaatgtcttacttccttcacaaacctttgaaaatatttcccaaagattgcgttgcctctgctcttagctcaatagctctcaagggagttggcatctcttatcagaagcacacagccaggccaggggcagccggcacattgagaggccagggcggagtaatggccaaggccaccgggcaggtagtgaaaggcccctcgctgtgttaaacaaatgcagtttccttcctggcttccgctggagctaattttgtttttcacttctcttctggtatatgaacaataaggatgtataaggccattctgcctgtgaggagatgtgcattagattatcataaatccacagataaaaagcacagtggtcaatgagaacaggcattcttggatgaaataaaaggtttaattgaaagtgtggtcccaggggagacagatgattgagcgtggtattgagtagacattaattaccatagtccagagagtgaaaaaaaaaaaaaaaaaggaagaccgttcctttttttttttttttttttaaagtttccaaatctgtttctctttgagagaatatgggagatcatcctaataggatgttaggaaaacaaaatgagtcttgcttatacacagtattcttagaatactattaatgtttcttaagaagtagcagttgatttttctaatagatatttttgttcgaagttagagatctagacaaagtacaatgtgtactgttatgctgaataatggttttaaaagatatatgcatattgaattataacacattagtaaatgatttgtacttattcataaatctagaatttttcattctttggttatatctctcagcatttttttggtaggctgagattttcttctacaatttagcagaaaaaaatgaagtcgaaaaggcatctgaacatacagtcttcattaaatattaggccactagttttgcattgctgaaatatggctgcctttataaatcatacatgtttgtttagctagtgccctacttttgatgtggctaaaattatgggaagaactctacatccaccgggataacggatggtgtcaagaactgccttaacaagaaaataattggtcaggtgtctcttttaacagtcattagcatatttgaattatgagtttggttcttctttcgggtcaaatagagtataaaagtattctgaattatctgtacctaatgtgcaacggttttgaaaggacaaaaactgggagactgaatatattaagagtatgttactttgtgcttgcttacaaactgcttcccaattccgttatttaagaagaaaaaataaaaaaataaaagcaccaccaactgtcagagcaacttttagttggcttttcagttttatttagaacaaatgaatttgctccctgagtgaatttaaacttttcaatcaattgtttagatgttgatgtagacatagtcttagttttaaatgtgaaaaattgctttttttggtttaatttgaacagggtagttgccaaatagcaccagctgtcataataaagtagaagtgaatgacagatttactccaccccatatcaaaactcagaagtggatatggtgatcaaatgagccaaagtaaatgtaagatcttagaaacatttgcaagctattttcttgcatagctcagcccttcatgtgtatcaaagtgcaaacaggttacggttatgcttagcactattatggcaatggaaaaaggggaatcactttgttactgtagatatgccaaatatattatctaatgttccaaaataccatttgatgatggtgatggtggttatagtgaatcttgtttttaccaaatacactaccagtctataagatggtattataaagtattgaaactagaagcttaattagcagtttatgaactgttttttaattttaatgagaacgtggcacatactgagctacaacggaagaaataactgcaggagcacttgttgacaatgttctttaaaaaatatgtaccatacacttgttcttaggcatggcgttgggataagggacagtggcataaacataaaaatggagtggtctctgttgcccttaaagtccttaaagatgtacataataataaataaccatgatataacgtgattagtgctatgcttttattatgtatagagtgttttgaagacctagatgagagccacaaacagcaggtgacaattaagatgggatttgataggtaagagtttgctagtgggtggcaaagcagggtaaagagagagcataagttttaggtggagagaatcccatttaaatagttaaagaaggtatatgtaacatttgattaattccagtttcctttactaaacatgataaaaagtttaggtgagaggtgttgaaaactatgattttggtagataagatgaaagacatagtagtcgcttttgggagggaacttaaatacaatttcaaagaggtattgtggcagagaagtgtcaacaaaacatgtatgaagtcatcgcataacgaatacttactagatgcatacattctgctggatgctaaacaggaatcaaagttgaattaaacataatttctgcccttgatgagatcacagtggtatagcagagttaagatagacaggcaaccaggcacagtggctcacgcctgtaatcccaacactttgggaggccgaggtgggcggatcaagaggtcaggagtttgagaccaacctggtcaacatggtgaaaccccgtctctactaaaaatacaaaaattagccaggcgtggtggtgcgtgcctgtaatcccagctactcaggaagctgacgcaggagaatcgtttgaacccgggaggcagaggttgcagtgagccgagatcacgccattgcactccagcctgggtgacaggatgagacttcggtctcaaaaaataaataaataaataaataaataaataagataggcaagctggcaaataattgtaagaaagtgatgcgaatcatcagaatgggaaaacataagtgaaatgggagctgcgagaagggcatattgttcctgtgctgataaggtcagggaatagttaaaagaagaggtagcttatgtgctgagacataaagcatattttgaaatattgtgcaaagaattcttaattccattaccccttcattgtgaaatttcttttcagttgaatattatgtcagcacttgatatatacacacatgaaatgtgtttttttccttatgtatgatttcattaagtatcgtaaaaattgtgggtttgcgccatcagggaaatgattgactaaaaagattcatccacttgtggtgcttcgatgagtctttctttttcatgtatcagcaagtaaaaacggggctgtgatggattaatttgaaaaaattaattccttaggcatgaactgaactgagatagtacttgtttagtctttgaagcatacttaactttgttggaaaattaagatccattagttcagggaagaaagaagtcctgctcaacctacatccagcaaaatattgattggaagtgtgctgaacttttaaacttcttgtaattacacactgattttacaggaattaaggccatagaaattgctcccttacccttgtcctgcttttctatacatataacagcacgggagaggaacacttggaagatgaatactgaggaagagtaatgtgaaataaaagacaatattcagtagcccgagccagtattttagggctctggagccacctgaacaatccccttcaagaacctggcatgaacagtgcagggatatgcaggaagaattttcctgaatctaggctatgtatttccctacttcaggaaaatctcacaaaccaagatgctactctgaggttcagagcctagaagcaatatatgtgtcaaatagaaaatgtgatacctaagagaagggaaagatgtgattcagagaaatataaattctataatatatcattaacccttgataggtcccatgtgttccaccctcctccccctaaaaatggcatccagttggtggatgggattattagtttttattctttactttcaaattgcagcattatatagctttggcatagccccatggtgtttggagagtactttccaaccataggctgtggacttggccatgcgaattcatttggccaataagatgttagcagatatcacgtgagcaaattcttgaaaggttattttgttttttcttccttttatcatgtgataaatatacttcaggcatgtggtggtccaaggaagatgggagatatgtggagcagacgtatacctaattcatagcttggaggcaagcctacatgagcctagcatatatcagccaaacctcagccaacctgtagatatatgagccagctataaatgctttattgtgcatatcataatttggggatgatttgttatgcagcatttgtgtgacagtagctgactgataaattccttcacttttccttatgaattaattctgggtagatttcccctctcccttcaatttgtttgtagtatgatgataggaagatatattcacattttaattttaatggatttgtcatcttctataagacctaagtgacttcttattttatagtcagttgtatctgacaattttaacagagtaattgatttaattattaagataaaaggcaaattatatgtttttatctacaaatgacatgttgtagatatggtaagaactttttcattaaaatagtaaacatgtactgtgaattttaagtggttgttacccactgagatttctcaatctctacttggaatttcgaattatttatcattaacagcatactaaaggggattggtatccagcaggaatcacattagatgcaattcaaacgtgagagaaaaggatggggtaaaaagggctatgcttttattgtttgattttcttagaagctttaaccaacgaaaagaaactccccgctcatgcccctacaaaaatactgcctcttttcgaggctgtggtagtattgttactacattatagcataatttaataaatgttactccctgagccttaaagtgaaatacattcactgggtcctctaaggaaaatgaagatgattgagatgtaatccctgcctttaaaatccttgagttgggaagaaagctatattatctttattaagagagttattgtaccctaaataacggcacatatacctaaacttgaggtggctgtgtagaacactctcaaatttctactctactggtttaagattatattttttaactatggcacttcctaagatctcagtgaaaatatccagtaactaattgtctttctgtacagaaacttcccaatccaaccctccgccgcccccgcaaaaaaaaaagagaaaagaaatttctcatatggaaatgaaacatcatttatccatttatggaataaagacaagactcaattctacaaatttcagaacgtacctgctgctctgcatctttaaaagccagcatgaggcagtactccacttttgtgatactctgtttttaatactaattgtgaaatatgtcatttacacagaagtgtgatgtagaaataatggaactggaaggtttaatcatgcagctctgtggcatctctcagaccttgctggtgacctacaaggtatctctgtcctctgctcctttccctctagcccattctcccccatgttctctaaggcaccattgctttaagtgtatgctagggaaaatttctacggcatgctccgtgtaaagttgttttcatggccagggaagttaggaaaccctgcatactctgtctccctctcaaagactctgaatatgttttaactttaaaaatagcctccaagaagtcaaaaaaaaaaaaaaaaacaccttttcccccagattttttcatcatagacaccctcattctctccccatatgcgatggctgagagcctgtatattagacattggattgatccaagttttagagggagccagtttggttgccttcgttggtttctgaagccagccctaaatgggcacagccttgggccagacctcctggggaagcgccagcagcctgtggattgactgtccatagcgaagggcacctgcacatcagtcggtgccacccttgcttcctgggtgcaagtctcatctgtggatacagcaggcaccgtagcccatgtactcactttaatgagatgctctgtactgtcatttatgtttcattcttgtccttgatgttgtgctatcttttaaagatgttacatgcaggtagcctggcatcaaagaatttgtgatagcaaagatattggaagtatcttcctaagggcccagcttcccaaatgggctacttctcaggatcaggcccattatgctcccttttaaggttattaaattgttacatcaggctgggtgcggtggctcacccctgtaatcccagcattttgggaggccgaggtgggcggatcatgaggtcaggagatcgagaccatcctggctaacacggcaaaaccccgtctctactaaaaatacaaaaacatttatctgggcgtggtggcgggcgcctgtagtcccagctactcgggaggctgaggcaggagaatggcgtgaacccgggaggcggagcttgcagtgagccgagatagcgccactgcactccagcctgggcgacagagcgagactccgcctcaaaaaaaaaaattgttacatcatattgtttgttcctgaatcttatgttcatataaaaggacacattctttttttattttttgtttttttgtttttaagatggagtctcactctgttgcccagggtggaatgcagtggagcgatctcagctcagtgcatccttcgcctcccgggttggagcgattctcctgcctcagcttcctgagtagctgggattataggacccggctaattttttgtatttttagtaggaatggggttttgccatgttggccaggctggtctcgaactcctgacctcaagtgttctgcctgccttggcctcccaaagtcctgggattacaagcatgagccaccgtgcctggccacagtcatgtattttaatcactaaattattgcatgtaaaatataatacttaagacaggtctaatcaggtttctctaatctacttttaacagaaagaagtaaaaacaaaacaaaacgtcctattgttcctcaatataaacaaagcaagttgtagttgtataatttcatattgtctgaattataaaatttctatttgttatttttcatgacacaaaatattatattcatttctttaatctttatctggaaagaaaaaacttccttgtgtcactaaacattgaattttctgatctttcaaggttatatactatattcgggggagagggttactgtaggaatcttaaatctgacttgctttacttttgttagttttaatctctgacttaatattatattaaggtacaatattacattaaggtactgactaaatattacattgaacaggcaatatggaatggccattttctgatttttattttctagtattagattaatcctttacttaaagaaaattggtttttggtaagttgagtcagagatcggctcttgcttttagtagtttcctccctctaccccctttcatggggatgggtttttaaaaacatgaaaaaaaatgtctgaattataaagaatgtctagaattgtctcactcatatctgtcgtcgaaaattatttcaaaggaatagatacagatttcaggaagtcacataaggacgtatatttaagatagtcacattattggactaactataacctatatcttaaaagttttcttttactgaaagtaaataccagagctggttacaccgagctctgtgaaactcttctcttatttattgcaacgttaacttacatttttcctttctttatgagtgacgtaatattgaattttgagttaactctcaacaaattagagtacaattcagatgtgtgtgggttttctaatatatatcagagatcatagggctatacagacaatacagacatacatagtctatattctaatttatttttgttgtctatagctagacaatatagagtatatataatattgtctgtattctaatgtattttgccctctagactatatagtccatattgtctatctatctatatattctattttctatctatagtctatcatctatattgtctatctatatagtctgtgttgtttagagggtgaaatactttaaaagatcatctacatacttgtaaatcaccaagattacatcagcagtagtaagggaaatgtcctttactatttagtataataaaaatgatcctccttagatcacctttttctttgacatgtgcctgctcatctctcatctttttcttttctttaccctcagaaaagtacaattgaaaataaaatgcctccctgctgttgaaatgagtctctgatccctactctaggatgatatccacattctgaattttatataatccaattggccaaaaacctttcatgcttataatagctacccagtgcttcttcagaagattaaataatttcagaaaattaagtgtcttgcaggtgtcttatcctttcattgttgtgaaaatttatttagctgtaacaaaagttttgtcaccttaaatttcttagaatttacttaggcaaaagttaacaatggataagcttattataaaatatcctggcagaattgccagatatggcttttgctttatatattttaaaagttattctttttttaaaaaaaaaaagctcttttgtttgagttttggtaattgacaaaatgattgcatgtgaaacataattcttacataaagtaagctgctcacaacacagactaattacacatttgggaggcaaggcaaagacatccagaggttgctcgtgctgagccaagagcacagcatttaatgaaatgagggccataaaaggttcagcatggatgctttcaggtctgagctgggcttctgggaaattggatgttggccctgtggactggtggattcccctgggctttgaaaggctgggttattaccacttgcatgcgtgaatcaggcactgctttgcagtacaagacatttgtgattccagagatggccttatttggaacactcttaaggtaatagtatggatgtctccccagtcatccatcttccttcctctctttcttcctctcatgccaagtaattacttttgatatttgttttctaaaaaatggttagtatatctagcgaggcctgaccaggtagactcttcagtttcctctttccgattcttaaacccatgttggccaggctggtctcaaactcctgacctcaagtcatctccccgcctcggcttctgaaagtcctgggattacaggcatgagccactgtgccttgccccatcctggattcctatataagtaaaaggaaacattttatatatgtaccaataagtttgttttctaccacccgtcctcctctgttcatcccacagagatcatacttcctctggaaaattagctgccatgtaactagaaatataacaattacaggattctccagcagttcattctgaccaactaagtgttcagtcatgaacctgtggatctaacactttttcatcttaattgtgctgaagtatctcctattttctccactcagagatatctggcatccctcacagtaaaaactgccaccccttcctgggacttggaaacatatgaacaggcagcaatgcagcctgttgctaaaacaccttctgggccctggttgctttgaatttgactgcatttgccaattgttgattcagggcagtagttcttaattggaagtgattttgaccccaggtaacatttggcaatgtctgaaagcattttaattgtcacagcttggggaagggggtactgctaacgtctggtgggtagtagccaaggacttggtcaaatatcaggcactgcattggacagacacccacaacaaaaaattatcaggcttcaaatatcagttgtgccaaggtcaaaaaagcctaagttgaaggttctgtatgaccagccctgggcaggtgctgggcattaggcctacacctatgcaggggaggcattagagcatccattctgggcctggctctgggaatctcaaggacagagcctctagtggcaaagaataacaagtaatgaaaagatttaaaactaaatgaaattcacaagatttcccttactacgccagccaggctctgtgtgtgtgtgtgtgtgtgtgtgtgtgtgtgtgtgtgtgtgcacacacgcttgaaatctgtgagtggaaagagctgttgcctgaaagatggaaaccaggagaatccgaggtctagatgtgccactgcttgggggttcgtcatatcactaaggtctggcatttagggcacttggtagtactttatacccatttccattttgctacaaaatgctgtctggcaagatttgagtttaattttgagagttactggttgaaccaggattcttggagggaggcattcagcatattgatttttttaatgttagataaagggacatttatttctaacagaggaaatggctgtgttaactactgtaatggtttcctttaccatttgggaagtttgctattattagagggcactaattatggcttaagcctggtacagcataagaaagatataaaacataactgtacttgggtggagaatgtaaatggcatagtgtcttactgtcattgtagaaatctgtcctggaatttcttgagggtcaaatcatggaatggacaaaagttgagacacaaggatacagtatagtatggcagtgaagagtctgacagttgaactcacagagtagaatggtggttacaggcacagaggaggaggagagtggggaaatgttggtcaaaagacacaatctcagttaggaggaataagttcaagaggtgtatcctactacatagtgactatagttaataacattgtagtttatacttgaaaatctctaggagagtagaatttaagtgttctcaacacacacacatacaaattcgtaagaatataaggtaatgcatatgttaattagctcaatttagctattccacaatgtatacatagtttaaaacaccatgctgtactccataaatatatataattttgttttgtcatgatttctgttcttttacatttgctgaggagtgctttacttccaactatgtggtcaattttggaataagtgtgatatggtgctgagaagaatgtgtattctgttgatttggggtggagagttctatagatgtctattaggtctgtttggtgcagagctgagttcaactcctggatatccttgttaactttctgtctcattgatctgtctagtgttgacagcagggtgttaaagtctcccattattactgtgtgggggtctaagtctctttgtaggtccctaaggacttgctttatgaatctgggtgctcctgtattgggtgcatatatatttaggatagttacctcttcttgtggaattgatccctttaccattatgtaatgaccttctttgtctcttttgaactttgttggtttaaagtctgttttatcagagactaggattgcaacccctgcttttttgtttgtttgtttgtttgttttccatttgcttggtagatcttcctccatcccattattttgagcctatttgtgtctctgcatgtgagatgggtctcctgatgtgtcttgactcttcatccaatttaccagtctgtcttttaattggggcatttagccaatttacatttaaggttaatattgttatgtgtgaatttgatcctgtcattatgatgttagctggatattttgcccattagttgatgcagtttcttcctagcctggatggtctttacaatttagcatgtttttgcagtggctggtaccagttgttcctttccatgtttagtgcttccttcaggagctgttgtaaggcaggcccggtagtgacaaaatctctcagcatttgcttctccgtaaaggattttatttctccttcacttatgaagcttagtttggcaggatatgaaattctgggttgaaaattcttttctttaagaatgttgaatattgggccttactctcttctagcctttacagtttctgccaagagatcagctgttagtctgatgggcttccctttgtgggtaacctgacctttctctggctgcccttaacattttttccttcatttcaaccttggtgaatctgacagttatgtgttttggagttgctcttctcaaggagtatctttgtggcgttctctgtatttcctgaatttgaatgttggcctgccttgctaggttggggaagttctcctgggtaacatcctgaagagtgttttccaacttggttccattctccctgtcactttcaggtataccaatcagacacagagttggtcttttcacatagtcccatatttcttggaggctttgttcatttctttttactcttttttctctaaacttctcgcttcatttcattcatttgatcttcaatcactgataccctttcttccacttgatcgaatcggctactgaagcttgtgcatgtgtcacgtagttctcttgccatggttttcagctccatcgggtcatttaaggtcttctttatactgtttattctagttagccattcgtctaatcttttttcaaggtttttagcttcctcgcaatgggttcgaatatcctcctttagctcggagaagtttgttattaccgatctcctgaagcctacttctgtcaacttgtcagagtcattctttgtccagctttgttctcttgctggtgaggagctgcgatcctttggaggagaagaggtgctctggtttttagaattttcagcttttctgctctgttttttccccatctttgtggttttatctacctttggtctttgatgatggtgacctacagatggggttttggtgtggatgtcctttttgttgatgttgctcctattccgttctgtttgttggttttccttctaacactcaggacgctcagctgcaggtctgttagagtttgctggtggtccactccagaccctgtttgcctgggtatcaccagcagaggctgcagatcagcaaatattgcagaacagcaaacgttgctgcctgatccttcctctggaagcttcatctcagaggggcacccggctgtatgaggtgtcagtcagcccctactgggaggtgtctcccagttaggctacttgggggtcagggacccacttgaagaggcagtctgtctgttctcagatctcaaactccatgctgagagaaccactgctctcttcatagctcaattggaaaggcagaaatcacccgtcttctgtgtcactcatgctgggagctgtagactggagctgttcctatgtgaccatcttggaacaaaatggaagaacattccatgctcatggataggaagaatcaatatcatgaaaatggccatactgcccaaggtaatttatagattcaatgccatccccatcaagctacaaatgactttcttcacagaattggaaaaaactactttaaagttcatatggaaccaaaaaagagcccacattgccaagacaatcctaaccaaaaagaacaaagctagaggcatcacgctacctgacttcaaactttactacaaggctacagtaaccaaaacagcatggtactggtaccaaaacagagatatacaccaatggaacagaacagagccctcagaaataataccatacatccgtaaccatctgatcttcaacaaacctgacaaaaacaagaaatggggaaaggattccctatttaataaatggtgctgggaaaactggctagccatatgtagaaagctgaaactggatcccttccttacatcttgtacaaaaattaattcaagatggattaaagacttaaatgttagacctaaaagcataaaaaccctagaagaaaacctacgcaatatcattcaggacataggcatgggcaaggacttcatgaataaaacaccaaaagcaatggcaacaaaagccaaaatagacaaatgagatctaattaaactaaagagcttctgcacagcaaaagaaactaccatcagagtgaacaggcaacctacagaatgggagaaaatttttgcaatctacccatctgacaaagggctaatatccagaatctacaaagaacttaaactaatttacaagaaaaaaacaagcaaccccatccaaaagtgggtgaaggatatgaaaaaacacttctcaaaagaagacatttatgtagccaacagacacatgaaaacatgctcatcatcactggccatcagagaaatgcaaatcaaaaccaccatgagacaccatctcacaccaattagaatgacaatcattaaaaagtcaggaaacaacaggtgctggagaggatgtggagaaatagggacacttttacactgttgtgggactgtaaactagttcaaacattgtggaagacagtgtggcgattcctcaaggatctagaactagaaatactatttgacccatcaatcccattactgggtatatacccaaaggattataaatcatgctactataaagacacatgcacacatatgtttattgcggcactattcacaatagcaaagacttggaaccaacccaaatgtccatcaatgacagactggattaagaaaacatggcacatatacactatggaatactatgcatccataaaaaaggatgagttcatgtcctttgtaggaacatggatgaagctggaaaccatcattctgagcaaactatcgcaaggacagaaaaccacacaccgcatgttctcactcataggtgggaattgaacaatgagaacagttggacacagggtggggaacttcacacccaggcctgttgtggggtgggggcctgggggagggatagcattaggagaaatacctaatgtaaatgacaaattaatgggtgcagcacaccaacatggcacatgtatacatatgtaacaaacctgcacattgtgcacatgtactctagaacttaaagtataataataataaatttcatttcaaaaaaaaaaacaaatttaggttattcttatttcagaatatgagctcactcacccacacagatgctagttcttgaattttgtttgtactaaatgaaaaacaacttattggttggttgacacatttaccccactggggcctgaattcagccccttttaggagggacagtttcagaatatgccatgaggtgtctgcggtgtagatccatgctctctgcaaataggggcagcggctctatagctgagtcctttcccagactcctttaagaaatttcaacaggctttcacagagctatgcctgctccaaaatatacattgacataataaaccacaatggatttaagtgtttaaagtcagaaatacacttttaaaaataagtacttcagttggccagtggagcagtaatacctggatgctaaattgaatttgtttagaataaaccacagagtaaactttaaaaaaaatgaaaataaaaaaattttgatttgtcaattaaaatatacatttataaagaaaaaataataaaacactttccacatcatagtttatctatagaaaatgtgtcaccttccacaatggttgaactagtttacagtccgacaaatattgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataagtgtcttcctttgagaagtgtctgttcatgtccttcgcccactttttgatggggttgtttgtttttttcttgggtaatgtacccaaaggactataaatcatgctgctataaagacacatgcacacgtatgtttattgcggcactattcacaatagcaaagacttggaaccaacccaaatgtccaacagtgatagactggattaagaaaatgtggcacatatacaccatggaatactatgcagccataaaaaatgatgagttaatgtcctttgtagggacatggatgaaattggaaatcatcattctcagtaaactatcgcaaggacaaaaaaccaaacaccacatgttctcactcataggtgggaattgaacaatgagaacacatggacacaggaaggggaacatcacactctggggactgttgtggggtgggcgggggggggaggaatagcattaggagatatacctaatgctaaatgacgagttaatgggtgcagcacaccagcatggcacatgtatacatatgtaactaacctgcacattgtgcacatgtaccctaaaacttaaagtataataataataaaatttaaaaaaaaagaaaatgtgtcaccttaaaattgtatacttttgttgaaaatggatattgaataatgtcaaacatgaaaatgcagcagaccactcagaagtattcactagaggaaaagataaaaaaaaaaagagagtctgacataggaaccacactgtgcttgagccccacaaagcttccacattccaagtcttctgggctgtaaacatggcgtttatttgctgtgcacctcagtttcctcatctgtggaatggacatgacaataaacctcacaggtttgttgtgaagcataagtgtattaatatgtgtaaagtactcagaaatgaagtagtcaatcattgttagcctctagtatattgtttctgttgtattcttgaatctcagatgtcagagacttaaaaaaaattttcaaaagaaaagataatgataatgcaacctgatttctattttgcttctaccacttaaataataaatgataagtgttagtgcaaagagtggttgtcagtcttgctaagaattaaatataattgccaaaagaggaatgatttaatcataaaatgaagtgatttgaaggtattactaaagcaaaattagttcttgtctctttgtctctgatagacaaaagccagagaacctttctagtttttctcttgaaatggtgttcacaaacttacagtaggatggtttttctttaatttgcactttaattcagtggaactttattagactgaaattaagcaaatcccagagaggcctggaaacataaatggttttgaaatgttatggattctaaattgggcattttgaaagacaaaggtgaaggctaatagtttacatttagtacgaaactctggcattccaatggaaattggaatcaaataatgggatttgttttttaggtaataatataatgagttagctgaaagagctaacttgtaatagatttattaagccataaagtttcatttctttgaacaacatattgtcaaaatcttcacagacaacttcacttataagaaaattaaatgaaagaactatttctttaaaagttagctgtggattttctctatttggggaggggttgaaaatgccgcgtcaatggatctggctgtgatccgacctcttaatcctgttttaattatgggttctttgctacttctgattttatagttatatgtgactgacattcagacattcatagtaattttttaaatatgtaattttacataagagtcccttcaatgtgaccttaagatgggagtctctagatataattatagagaggaaggaaccgacctagaatgagttgatcatttccaggagtatctcattgtcagatttttcagttgaacactgtggcagtttcacatttctacaagcttgagaggaatgcagaagggagacccacaaagatgctcatgtggacagcacttgtctgttcccactgctgtatatttgaaaacactggggaccaaatatgattaaccacatacttctccctggagacctgaaccctaaatatgcctttttccaccatactctgtgtttcttgagaccagtatgcttgcggctaggtgtcatttatcaaatatgacatgaatgtttgttgtgcataatcatttttgtttaggtttaaaaatttaatggcagtgagttatactacctgaagatgcaggctgaaagcatgagttttgacaaagtgaaatttcatttgatgatatccattataaatcgtttttctctaactttaaagtaacatctcatttttactgtgtcttattaacaaactttaccaatagtgttgtttccatagtaaatgatatgttttaaattatatatgccccatattttcctgaaattttaagacgtttctacactaaactctgttccttcatctgtaaagtgaagatgttaagactccattatctctaagatctcttctgatacccagggcaccctaagtctaatgtccagccttttttattatggagaatatcttagtaaatttccaaaggcttgcgaggtgtttcagattgcatcgctctgacttgccaaacgatcctctctattgaccattaccgaatagtattccctgaaacctcttcccctgctccatggatgtgactgtggctccttgtggagagctaaacccagcctttgcctgccaggagccgattacagctgtgagaggtccagtcatcctgtcctactgattgcatctgtgtctggtcatctgagagagtgaaatattaatctgctttcttctcttcactcttttcatgtgtattcccctaacagaaaggagaacctgactgctgtgcactctctctggagacaagcgagcagctcacctttgagatccccctgaatgattcaggttctgctggcctcggggtgagcttaaaagggaacaaatccagagaaactggaacagacttggggatttttatcaaatccatcattcatggaggcgctgcttttaaggtgggtaggaatgacatttgtacatcctttgagaaggcacttggagatgtgactgttgtacttagagactgaatggagaaagtgtctgaagacttgaggccactgagactttcccgccagatacaaaaaatatatgtgtgaacagatctgggaaataactggctgctgtttttgtaccttaactggttatttttacttcttagagttacctctaaaaacccaacatgattcacattcttttttgcatactttttattactgcaataggattcctctggatttgtaaactgacaagagttgagcctaaaagtacacgatcagaaaaacaaaactaaaaacaagtaaacataaaggcagcaaataagacagttgtgcttgcaagaatgaaagctcagtggagcctgagagtgattgtagtataaattaaaggccatttatcacattttatacacttgaagaaaaccatggtgcccagaatgcatatttccttttgtatacttagagaagcttagttttctaggtttccagaaaaagaaggaagatcatgcttcagtcctttcacgttgaggtgagtatagtgtactggttagctagatggccggtgttcaagtccagctcagtccttgctagctgtatggaaatgtaggcaagggtcttgaccagctgtctcccatttcctcaccggtagaatggtgataataaataataactacttcataggtttccaggattaaatcacacaatgtgatgaaaacaataaagtgatgatagaggaaggatacacgtttgcacctcttgccaccctcattattatctcacaccgtgcaaggagacttcttgagtttgaattctgccttacctactctctccctgtgcatgtaggtaagctgctcagccttgacatgcctcagtttcctcatttgtgaaattagcagtgcctggttcctcatgctgctgttaagactaaaagagacaatatgtgtcaagtgcttagcacagtgcctgtcaccagctgctgataaatgttagccatctgaaaataatcgtgatatgaataatgtctatcctctcccacagcaaagccaagaaggccccgttacactcaacagagcacccctgcacctagaattctggctttgttgaagcaactgtcgtctcacacttacccttccacttttgtttcagactagatgtggagataatgcctttttcactgggaaataaatgtactttggacagacacctcttcagtttactccttggtttagttagcttttgtcgcataataaatagtcataatttttcagtaatatacacatcaataagcctttatttttctcatagctctgtgtgggggagctggggtttgggtaggattctgattcaggctggtgtctcttgatcccactgtaactctgcagatctgagtgtgctgcacttctttctcctgctccttggatcagcaggctagctggcgcatgtccctctcatgcctcgagctgtcagagggccagcggcagtgggtgaatccgcgggctccaagctagcacactgtcaccccacacataggccactggtcaaagcaagtcatatggctgagtccaaggttgagcagtagaaaacacactccagccacgatgaagttatggcaaagatgtagatacagagaagggtaaagaattgagtcccatcactccatctataaaactggctcagaaatacataagcaggagcaaaagcgaaatagtagtaatagcaacaacaacaatagcaatgaacatttattgtgcttagtatatgctggacactaggataggtgttttatatgggttatctaactttattcacatttacattggattattttcagtccattttatcaaagtggaaattacagattagaccctttagtgcctttcctgtggtcagatagccaggaattactttaagatttgaatccaggcagtctgactccagaacctgcgttatgctgcactgaaatgaagctcttccatatgatccattcatgttcctagagagcagggcctgttcgcctggaggtgtcttgtatggtgctatcatccttagccaagccatctaggtttgaggatgagttcttggtcatgtttgtggataccagcttgaaattagtcttcttattcctaatgacagctctatttgtagaatttactccaagtaaaattgaaactgagatgacttttcggaaattaaaagcaaacatcttagcttttttatgggcaataacttaagctcaagcagatattggcgagcaggtttaatatgtatatccatgtttgtgtaagtgagcatctccttacctaagcagtttctaacagtcctgtttcttgcagaaagatttcactttccatttatgtaaatttctttcctgacactggtctgctgagtcagacaatcacaccattaaaaaccactggacagcatatttatagctgatcttaaacagtaagaggcatcagtcatgaacttagccttcttgtgaatgtttagtatccatttgtcttgtttaccttttgcagtgtaaagggtagaggcctgagatttgttcacaaaaaatctgattaaccaggggaaaaaaaagtatttttccattctcctactgttgttccagtaatccactgttacgcctcggaaaattgccacccattctatgattcaggattctgtcttaggaaaattgttttgagactttgttcctgtccctgttgagaggatacacatgtaacagactacagtgtctctggggcagaggagagatcagcactgggaacatctttgtctcagcatttggccctaggtttttacccggaatcaacaaaataatctttcaaccagagcacaatctttttctcctcgcccttcataccactaattagttctcaaggtgtttttccctttagggaaggtggattttttgaaaactaaactactttgaaagatatgaccaaattcttcctgtgcattctgtgtgctggattctcctgggggcttccattggtctaaacaaagataggctacttcttgccagatgtaaaacccctgaatacctcgactctaattgagggcattgctttgttttgttttgttttattttgttttccttaattctcagtctactgctttctgtcatgtcatctcttgtttgaattatttctaatagaggatgtaaatctctatttggaaacaagagcagccagctactctaggacgccctcttggaagtgagtccctgactcattctaaaaaccaacagaacaataattctaccctgctcagaattatccaaatgcttaatctcaacttgatatttaacttcaagtctgtacattaagaaataaagcccagaaactcttctgtgcatgcatcaggctgcaccacttttgattacaggctgttttgtcatacggagctcttcataggcccctctgaagcataacttgtagctatgcctcttagtgtactatatggccattgaccataacagcggaatattgcttcttagagtattgatgccaatgtgcctaagcactagcatgcattacatgtttgtggtttcatttagttactgtctttcttcctgggcgtttgcccctgacatacagtgtagttgcttctagaactaaaatatactaaatacaagcatatatgtcaactgcttctgaaagaattatgagcagaatgaagttacgacatccatgagaatgattttctaaaatgttgcttttgtggttggaatttatgtggtagtgctgttgctgttcaataaaaagaagtatcagctctgttgcagttagaaaaaatacctttccctaaatccacatcaaaatgtccctaaatccacatcaaaatttgcgttttattttgtccaggaaagcacaaatgaagtctaaatgatccgtctgaagatgttagatatttttatgttcatttgctaaacattttaaattcattttgagatcagtggtttttctttgctttgcttttcatgtaccatattaactgaaaatttttagtaaaaatttttacatctatggactacacttccttaagttgcttgttttgctaccctaaagaattactttaaaaatgtatacataactagaatagtgctttctttaaagttaggtaagatattgtaagaacacactgtagtgagaataaaagtcccatgaagtctgttgtaccagttctgaatggtgtttttgacttcactatgctgactttgggagtggtatgtctcctactgaaactttgacctagtaaggtaagaattcaaatttacaggaatttttgctaaaggaagaatgtcgtatatcaggtagattgtttaggggctgctaaatagagagaatacatttaagactatcagttattctctagagaattaattagccaggtttgtgcttaataaattctcttgatgatgaagaaattaagtgaaagaaaaatgcctgacatggctaattgtaaatgtatgcactcagaatatgaaatagacataattgaagtaatttgattcttgtgtgcttaggaaatttgggattctccttctgaaggatgcaggatttcataatctgcactgtttagtaatgggcaaaagaaagaatttggaccaatacaagcaatcatgatatttttaaatgactaaactctaaatttttggagagaaaatgcacatctctagaatatccagaaacatggcgcttgatcctgaatctccatgtctcattgtcatgtgagacatttaacagcatccaaactacttaactccagtaggagctcccagcgtgactaatttccacccccatctctgccggtatctataaatcatgtgatagatctataattaatgaattcaaaggaagataaaagggacagctttttaaggaaaactaatgttaaatgatttcttcaactggccatttttcttaaaatttataatgttttctactggtgggagaaccttgaggatccttactggtagtcagtgacttctaagctgttacctctggcaaaaggaccagataatgtgagaatgtcaaaatgctattgaaactcctcaaatgtaagaagccaaacactaacattttatttctaaccacaaagatgtgatacattttaaggactttaaaagcaggaactttgcctggaaatatacataaattcataatcactatatatccaataagaatttgaccttaaaaaaggaagttattaatttaagcctaggaaaaatacattttagctaattttccgttttaaaaaaatctgaaaatgttagcatatgttaattcacatagtcaggcttatttatgaattttctaccataggaactattaaaatgtaatataacattacttttaaaatctcaaagtagctggcacagtaatgggcacctgtattttcaactaagcaggaggatcacttgagctcaggagttccagactgtaatgcagtataatcgtgcctgtgaatagtcactgtgctctaggcctgggcaacacagcgagaccccatctctttttttaaaaaatcccataattccagcatctatcattgttttttcttgctgatctttatcacttttgcatttttatttcatgaatggaaatgcaaacaggaaataaatttacatgtacactatactgaataaaattttggaatgctacaacattttgatgtgtattttggactccgtgattgtctcagtgggcttgaaaaaatttaagggttgatattcctaatgaaaaaggaaattataatctacaaaagttgatatagcatggtaatgatgctttggctctgaaaatagtaactttcccctgaaaagctatattcgtcttcattatgggtacctataggccatatatatgtatacacacacacacacacacacacacacgtaagaccagtcactaggaaaatggacacaaaccagaatgctcaaataaaactctgaccacagtatgaactctgcatacatatacacacgtttttgttctagcattctggttgtacccatttttatagtgactggttttaagcaatctcagtataagcaagtgccaagtgcataaaaaccaccaccaagaagtaaatcaataagataagtatgttgaaatggcttccgaaattctaacctagttaggcattcatgcaaattattcttaattcatatataacatatatgctttaacaagcttctttttaatctggttttctaggccaaagtaaattaagagcagaaaatcaggaaggagataggaaaggatggagaagaaactggaatgacaggaaagaaaaaagtgtaaaacaagcacagaatgttattattgtatggtacaccagagaatatttctgatggtttgaagtcagtatttctcaaactttcttgcagaagaaattataagattcaatgtggccatagtaaaggccataagttgcagtatatctgtttatgccccatatttttccagaatgattttaaaatgaaaagatttataatacattttgaaagcattatttcagaatggtttatgcatatgttaactcctatagtcaggcttattacaataagcctgaccaacatggtgaaaccccatctctgctaaaaatacaaaaactagccaggcatgatggtacgcacctgtaatcccagctacttgggaggctgaggcaggagaattgcttgaaccagggaggcggaggttgcaatgagccgagatcataccactgcactccagccggagcaacaagagggagagactctgtctcaaaaataaataaataaataaataaataaataaataaataaataaataaataaaagcttcatatgcccacaggtgatttgctgctgggacttcattggtttgttacatagaaatggagtgaggttcttaagacaataactgaattacataaatttaaattttacaatttctgaacaagtagagataggggcagtatacagaacgtaatcaaactttttttttcttttttggaattctgaaggttctctgaatatgccctggcatattcaagacagcttaggttcgtgactctctcatagttacaatttgtagatgaaacttaacaccaggaccaaaacacctgactgacttaatttagcaagcacttcttgaacatttagagtgagttagacaacagtgtatagtggactagacaccgcatacttaaaattacccattctataatctaggaaggtagtaacacaatacattaaatatataaaaaacactaatatgataagagctatgataggcaaatgtgagaagtatcgtgggtgttgagatgatgaagcatttaattctgtctggggagaaaactatgaaaggaaggcaattgcaaggcttgcttggggtgaggagtaagtagactttgaagaggtgagcaggaatgcaaagggcattttgggtagaagaaagaatatgggcaaagtcaccaaggtatgtacaccaaagtacagtctgttgtgcctggaaaatagaggtcttatttgggaagaatggacctcttcacataagctgaaatgatgtgaaacatgtagtagcttttttgttttaacaactgtactttaaaaatcttgattcattcttgcccttccattgcaattgtttttaaatgaaggtaaatgatttcaatctggaatacaaggttcttttcttagtttagggttttgggttttttggggggtttgatttgttttttcaaaaaatgcagtagacagatgttgtcatagagtgattgtagggccatgagaaggattcgttgaagataattctctccctgaatcaggtgccatcttgcctggggtccagccctattccagggaacatctgctctgcaacctgaagtcaagctttggggtttgggacctgggagttgataatatcccaggaggccgtaccaagggccccgttagaagcatgcagaggcagaagccaacatctggtcatgattaatcctctcaacaccctggactaatgtggactggccttgggccacagccagctacccctgggaaagccagcccactttctcatgcttctctcatattcttcagtggctagttcagttctttgccttggctttcttacttttcctctgtattcattagaattttagaggtaacagggcagttgaggggagggtttaacaaaaaatttgccaagccaggtggattaagccacacaacattgccagtaatcatggcagaggaagtacccaggcaccagtgaatataccacaggggatgaactacaaggtcattgcaccccccagcaatcataaataagctttagaggacacatggagtagcctacagcatacataacgacccctcactccaaagaattatctggcccaaatgtacaattgtggaaagaccctggtgtaaatattttttttttcaaaaatgagtatctgtagcttttattagattctcaaaggagtctaagaacccataaaggctaaaaatcactagcagattgtttgaaaacatgggctgcagagtgacccagacctagttcacatctgcttttagaaacatgacttgtaacaattcatttaacctctctgactgcaatttcttcttttataaaatgggggcagcaatctcaaatatacagggtttctataaggagtaaattgtctgctacatgtaaagggtttagcatgatgcacagagtagaaactctttgtcattaatatagtgcctttaataatctctaaaagtctgaatgtagaagcaacgtagcataaaggattcatgtcattaacctgagagatgaggagacctggctatgaccataccctttgacaagtcacttaatttctctgagccttcatctttacatctcctaaatagcagagagtagcatttatatcacagggttgctgtaagaaatgaatgggcaaatatatgcaaaagacatgctcaaggactagcctacattaggtgttcagtaaaagggagatgtcatactcaaaggtcttgtctcctggtcctctgtgcgtcctactgtgataggaccagctaaagctgatgagattgaaaccatgccaggacatggagaagacctaacctcataccaggttttttcgttctaaagtgcactgaagaagttacattttgtctttactctgtcctcctgattctttttaatatgttttccttccctttgggaatttcctttactcctttctagcttgaggatggagttggttatggggggatgccagaagcggggaacataattgaagtatttttgcttaggagtctgatgggagtaatagaggaagaaaaaggggtgagaaagggagagagagagagagagagagagagagagagagtgtgtgtgtgtgaatattgcaagcataacccaggtgaaataaatatcctagaattaccaagcaacatccttgaatatttgaattcatttatgtaaagtcaattgaaagttaatattctcatgcctaaatatttactagaatttaatattaattttaaaaaccataaaaagctgattgtctttgtccaaattattccaaagcaaatgggacatacacaattttgagagagatttgatgagtttttgaataatgagctcctcattgaatcaacttcattttaggtcaagactggacatagacgtgcatgtatggatgtctagctaagtaggtagacagccttttttttttttttttccctcctctgggttgctctgccatgcccctgcacagtttcctgtctccatatcttctgttgtgtgtcttgattttatattgtcttcccttccaggagatatctggtagcatattgtcctctctggttctgaaagtcttttttttcttgaagcattacccctttaggggcttgtcattgtcatctatgtagaatatagaatggtttggtgaatagggacgctgtggaattcagaacttgggctgttctgttccaattctgaccttaactagctgaacaagtctaatatctgtggaagtgccttttcctaataggtgttcgataaatggtttctcatcctctttgggcatcccattattcatctgtaaacggaagaggttggatgagatgacctctaaggacccttccagctctaaattcagtgattatattctaaatgttaggacaacatggtgcttactggcatcgccattaatgaaattacacatcatttatcttataaagaaaaagcacacaccaataacaacagaccagccaagcctgacagtgagagtgtgtggatttttattgcacccacaactctctggtgatgcttgtgatgaatgtgaatgtctttgaaaaaaaatttcagctgccctgaggtgacctgaactgtctttttgtttgggacttggttacaggaaacatgccctacttcagtgtcattctgcatgcttgagatttagaatgtaactgaaaataaaaaaataaaaaataaaaagtttgtgcttagtaactgttgatagattttaccaaaagttctcctatcttcttgtctgttatctacctcttcactctgacgttgtctcatacttcacagaaaaggttcacaagagattaccaggtgggatctcactcatatttccttccctccatctctagaggttcccataaagcttccatctttatcttgtttcttcctgtcgtagcagatgaggtgtcctgccaagacaaagcactgcaaaatctcaacatttcctgttaacctcatttcctgttaacaggactaggaccaggaactggattcaactcttctgcttcctcctcctctttaaaaaccacacatcagtctccagtcatcctaaaacgatttttagtaacaagattcagcccaatggttctcctttcttatatgacaatagagcagaaatatttctccagttatatctcacatcacataacgaaaccattcagggtgtttttgttgttccccccaccctttttttttttttttggagatggagtttcgctattgttgcccaggttggagtgcagtggcgccatcttgcctcactgcaacctccgcctcctcggttcaagcgattctcctgcctcagcctcccgagtagctgggattacaggcatgcaccaccgcgcccagctaattttgtattttaagtagagacggggtttctccatgttggtcagactggtctcgaactcctgacctcaggggatccgcccacctcggcctcccagagtgctggggttacaggtgtgagccaccgtgcccagcccgtcatatcccatttcatgtagccttatgcttttttgtgcctcactcaaaattggataacagaaatgaagagatttctttcttgtttggcctttcctgtaaatctcatttccagacttgcttcaaattagggtaaaggttaagtgaaatgggaaaacaagaggaaggcaggggacattaagctctgaggaggcggtccacttaaacggtttacatctctgacttgacgcctttgtctattgatcccattaccctgccatctccatttcttccccgagtgggtgtgtcctcctatgggcggcccctgcaatcccacgtggctaacaccctctccagcaggcggcgtgggcagtgtgtcttcaccagggcattggctctggggaacagcagctctcaccatgccctcccttttctccactatcagcagagggacttcctcgggccatctgctactgcattagtccgagtttaacgacccgtctgcacagtttccctcccaaagctgtctggttggtttctattgttcattgtgtgtgtctggctatctcatttcttttttttttcttttactttttttttcttttacatttcattctgttaatttgaccacaaatcccagatacttctcaccactagaactctttaatattttcctttccctatttttgtgttgtgcagttgtagtctagagacaagaaacaaagggaattgtcgtggaagaactaaagagtcaagattcatgggaacctttgactcactttcgtggcctggaacaagttacattttgtgcctcagtttccttttctgtaaaatgtttctgaaaatataaatcttaaattcttaggttctgtgagaatcactagaggtaatttatggaagaattctctgtaagggtaaactgttacacacctgctgttaattctgttgactttattagcagcagcagcagcagcagcatgataacattcgtaatcacagctgtgctttatagcaagcactttctacctgagtgtagaataggtagagagcatatcccctgagtctggctgtcaacatttcaagcatctttgctcctgggctgcctttggggaaatgcactgtggtcccttcaagttctgttctaggcagagcaggcatcccagtgtgtcagccactgatctaggcctctgcttatgagggacttctggctggagatggtcagtgcctcattcactcaaaagtgaatgagaccacagtctgggctgtgtattcatatgccgaggttctttgtgctttgtagtaagtggtatttcttcctgaagatgctggttgaaagtactcattcatcagagcctctttgaaaaaaccttgacaattctttttgtcaagcttttccaccagaaaatatcagggcgaactggcccttttctacacacctctgtgttctttggcagacgagcaactttgtggttgtgttagacaaaattatgtggttgtttttttttagtactgttcagtagagctagcaatgatatcaggagatacattactactgtcaagcacacagcatttatgcatgatgcctctttgtgcctgaaaaggcaaattctcctttcaagagttgtgactacctcctttggtttccaaacccccttcccttgagtcaacaacatggtctccgccagagcaaatggcagaatcaggtcagattagcatgcttgccaaagatttaggtaagaggcattatacaaatgtctaaattattgcagctcaggactctaagatttctaaaaaatactttcacacaattcattatcactggtatttgtgactatttgataagctccagagcctttttctgccatggaaaataaatcacttctaacagctaggttttctttttttctttttttcatttttaaacttgaacttttccccaaaacgccacatgtcatcaccatacttttctctgttgaatattgttttcctttcttctgccttaggatggtcgtctgcgaatgaatgaccagctgattgcagttaatggggaatctcttttgggaaagtccaaccacgaagctatggaaacacttaggcggtcaatgtccatggagggaaacatccgagggatgatccagttggtgattctgaggaggccagagagaccaatggaggtgatgcaaatcttgattctcctcagccagttgcccaaattgccaccagaatatgcagacttccattcctagtatggcagctagattcatatcgagaaaatatgccccagaagggctttgatgggaaacaggtggttgtgtattttaggtataatagaaaggtgtaaaaatgtgcatataaagtaagtcatttatcagatgtaacaggtctataatttctagttttttcccccagaaattccaagagctctgaacttgttcataaacatctttatatacttttttggttgatatgctagcagtgtccataccttagaaagtgtctaatcacatgtgtacaatgtttaatgtggagatcattgtaatgcagtcagctctctgtattctcttccataatctgcatataaataatgcagacctgagacttaactaatttaacatttgatttattaaacaagctgcttgctcatgttattaaataaatgggagtcttgttttttgaaatcttttattattttttataagttttttaaaatatcaagaatattttcacttacacatggagtctaagtgtatgatagctttaataataatattcctaacattatacatataaacataaaaatacctaaaacattattttctcttatatgaagaataattattaaatgctcataaaataattttagaaaaagctaagaagaaaaagttaatagtactgaaagtttagaaaaacatcagcaaatcacacattttgtcatatcaggatattctctaaggccaaattgtgtttgtgtaataaaataatatacaaaatttaaaaaactatttaaaaagctaatataaagtactagttttaataaagagttcagcgtaataattgaaaaatgaaagctttatcaagttaatcaagagttaatggtagtggggctcattgtagttaaaagcttcagctctggagtttcgaattgcttgggtttcaatcctagatttgctatttcctggctatgtaagtacatacataatttagtgcttggtattcatagatgacagatattgctgtctgttttatcccttaatgtgtccttggtttccgcatgtagtagatgcttgataaatattgagtgaatgaaaatgtcacatctgagacttacttcatctcagagagtaaacttgagtagtaaagttatatactctatcttactttattctattatcagctacgggcaaggagtagctataccttttatgctctcctttatataagctcgcagatgttaaataaatttaaattggccaattactggagactaaatataatgaacttattttcaacatttgtgtctgcttaagtgacagtgttccataaatatttaatgggctttacttatgtacctagttataacacccttatctgccacttcctgccctgagagaattggccccatctggtttaggatagttcttactctagagccctaggactccatggaacccgtttattggagagagttgaaaggatggactgcgaacgcctgagtcatcccttctgtgcatctgcatatcagatctcccttaagactttttaaacaaagatacctcaactaatagaagagtctagaaaaaactgctgtagcataacatacctgtgcagatagcaaaagttaaaaaagaaatgactatggttctaaaagagttagtagatgacagcagataggcgttatatattttggctcatcgagttggcacactttactatttgcattcccctttactgcaggtattttcattttaattctcacactctgggtagattggcgttattccatcagaagaaagtatgaaactctcatttgttgcccgccatcagaagtgccatgttaatgtagatcaccagggaattgatcaagaataagaactgggtcaaaaagcaatttctatgaggacgtttaaacaagatccatttttagtttccctaatatttacatgctttccatggggaatgagcaggcacttgactctcggctactgagcatctctgcggtacccatgaagattaaagagcattgtttcttataaagacagaagactaatgtacagtttatctttattaaattgaaaaaaattgcaactgtttgatcttcaaatctgtgtttcactgtgtcagagcatattttgtgtgctcatgtttttgctgtattctctggtggaacagcacttgccctccagtacaataaaaagtatccataacctagaaaaaggtctcagcactgttgatacattcaggcaaatcaattagttagatttgccaggaataccaaaatggttgcttgaacattatattgatatctcaaaaattgaagaagctacttaagaaaagtcaaaatatatagttgttgggatttttcccgcattacccagatgtacaagatatgtaaacagttttgatgaggaccttgtgaagaatacataatgagcccttgattgaatcaaaattgttttaaacagaaacatatttttcaaaggatgagcttgaggttcaattgtaattctatttgagcctagagacttggtattaaaaaatgggttatgacctgattttgtttttcctttccccaaaacatttccctccctgctgccagctcatcgtggcaaaagcagaatatgtttaaaaatccattatattttttattggctgggacactaatggagggctctgcgacggctctattttacaggctgaatactttaattaggctggttactgatcagttgttgggatatcgattgtgtcatttatcaaagagctggggaagcagaaaaaaattttttgttcttgttgttattgttaaatcaaagcacaaggctgagcaaagcaagccctagctctctttcctgctgcagctccagctttaatttaggactagcttacctcctataccaggctcagtttgactagcagttcagaagaaagggtaatacactgggtgtgggaaaagtgttacaagccttgacaaaaagctaaaggaccttcagcagctgaaaacattttaattattaagaatgcataaatggaatgttttagatattttgtgtgactagctcaacactgaatttttataaccaaagaggaaaatataaatccaatgctttgttttagccaaatgctatactcagaagagctctgggaatcagatgggtgctgctgtttgtggtacattcttctcacaaatggtcaagggaacagccatgagatggcttccaaatcatttacctccttaaaatctgttattgagacaaataatacgaacaagagcataccctaattctctttgctccaacctttttggaaaaaaaaatagttaagagttctctatcatcagcctcctccaataattccttcttcagcacctgtggaagatggatcgtaggggtgttactctggatacagcagttttcagaaaactgtgaatgtgtttacagactgtaaaaatcaaaataggaaggggaaatatagggggggaaccctcaggagaactgctgtctggcgtcacagcggtttgatttagctcctggccaaagacctagtatctgcacagagacacactggtggtatttcagaggcgaacctgcttgaattctgacttgtcctagagcatatgcacttaggcgcagagagagagaggaaccagctggttggcagagaaacacccttggcatgaactgtattcttgtgttgacactgccacaagctgtattccccagatggaagaaaatttgaaagaagccagttataagtgggaaaagagaataataaagttaatcctcttttgtgttggctatcagcactcctaatccttagcaccacagtgtcagtactttttattttagactcaaagatgttttcactgatagggccattttgagtttccacagttgaggacttaagtgtaatagactcttgaaagactattcatacagcgatcattctttcactttgcttcaactgaccaagttggaacatattaaaaatgcaaatgtaatttttacttttatctcttaggatcctgcagagtgtggggcattttccaagccatgctttgagaactgtcaaaatgctgtaaccacctctaggcgaaatgataatagtatcctgcatccacttggcacttgcagtccacaagacaaacagaaaggtaagagtctattcattttatccactgcaaatggagtgagaaaacacaaaagtgtctttttatctaaaaaaaaaaaaaaagagtaaaggggagttaattagactaagtgcagactttgttactcggagtcacaaacactgagagagttgggggagagctgactcagaacttgtgaatcagattcctggcaatgtctctagtttaagtgacactttctgtgcttgctgccccaaacatggagggttatatataaaacaaacgatcactggagaatcaaagatggcaaactgttatttttaagctcttctaatactggaagttaccaagtataaataaataactaccaaaatttaaaaatgtatggatttataatccataaaatggtcatagcgtgattcacagatgatcctcgattctaatatgagtatgataaatgggtgaatatcctaacctgaaaccatctcgtgatggttggaatgttcttgttattgtcttgctacactgttttgccttattatctaatgtggatcccatttctagctgactccagatgtaaaaaaatctgggttttcctctttgtcttttaaaaaatatacttcaggtcaccaagaaaattgttttatctccctgtatctcttttctttaataaaatgaattttttattacaaaaacaatacatattcattgcagaaaatttagagaaaagaaataaaaagaaaatttaattttacttatacttctatcaaagatcctaatcagtaacattttatgtatatctttcaggactttttaatgaaaatattttatacaaaaaatgaaataatgaaatgtatgtaatgtttaggaaatttctttttaaaattaatagcacattatatgcctcttagtcattgaatattcttctacaatatcacattcagtagttgcatagtgtcttttgaaggtaagtaccatatattatgtaatcagtccctatattttgaacacttaagtgttatcataatttaactatgtggaaagaagttccaagctgtgaaattactccatcataacatacttgtaaatctgaggtggctctagaattaaattatctcattagaatgggatgttgttttttccacagaattcctccattttagcaagagtagtagcaacagctgctatcatttattaagtgtttactgtctgttagatactgtgttgagcaatttgcctgcagactcaaagtggataatgttatcttcattttacaaatgaaggtctagaaagtcagtaaataatttactcacaaatgcatatttgatacatgcacagtctggattcaattcctgtctccctgtcctcagtttgtcttccaaaccacagcatgggtctgacttatattggtctattgaaactattggagtcctttcacctactgagaatgcccattagaagctgactttagaccgggcacagtggctcacgcctgtaatcccagcactttgggaggccgaggcaggcagatcacctaaggtcggaagttcgagaccagccagcccaacatggcaaaatcccatctgtactaaaaaaaaaaaaaaaaaaaaaaaaaaaaaaaaaaattagtctgatgtgatagcacatgcctgtaatcccagctactatggggggggaaaaaaaaaagaagaagctgactttacttagtatacagataaaaaaaaaatactcagtatgtcttttctcatcttaaagaaattatggtggcaggcacctgtagtcccagctactcgggaggctgaggcaggagaatggtgtaaacccaggaggcggagcttgcagtgagccaagatcgtgccactgtactctgggcgacagagcaaggagactctgtttcaaagaaaaaaaagaaattaaaaattttcttgacagaacaagattgccttctgaaatcttaaattgcagtagcaaaagagcctgggaaaggaatggcaagttttctgcaaaataaaacagtcttctttctaccttatgatcacgaatgtggacatttgtattaaaatatctagatttcatgtaacttgattggcatttaattctctagcaacgtgtggcccagtgtctgtctaagtctagagtttaattcctagttacaccagtgacatctaaatgaacactaagtaccttttgtttttaatgtctataaaatacagttatgtgccacataatgacattttggtcaacaacagaccacatatatcatggtggtcccataagattttaatggagctgaaaaattcctaatgctatactataatttttatcatcattttagagtacacttctacttattttttaaaaaaggtaactgtaaacagcctcaggcagttcctttaggaggtatccagaagaaggcattgttaccataggaaatgacagctctgtgcctgttactgcccctgaagaccttccagtgggataagatatgaagggggaagacagtaatattgatgatcctgaccctatctaggcctaggctaatgtgtgtttgtgtctcaggttttaccaaaaaagtttaaaaggttaaaagaaaaagtataatagaaaaagcttatagaataaagatataaagaaaaaatatgtttctacagctgtacaatgtgtttgtgttttaagctgttattaaaaagattcaaaaagttaaattaaaatttataaagtaacaaagttactgagattgaagaaagaaaatattttttagaaatgtagtgtagcctaagtgccttgtgtctgtaatgtctatagtagtgtacagtagtgttttaggccttcagatttactcatcctcactcactgactcacccagagcaactgccagtcctgcaagctccattcatggtaagtgtcctatgcaggtgtaccaatttttatcttttatactggattttcactgtagcttttctgtttacatacacaaataccattgtgttgtaattgcctgtagtattcagtaaatgctatacaggattgtagcctaggagcaataggctataccacagagcttaccagagtaagctaatccttctaggtttgagtaagtacactatgatgttgatgcaaggacaaaattgcctaacgaagcttttctcagaatatatcctccttaagtgacacaagatgtattttctgaagacattgagatacttaagtaaatggaataatatctctgcaaagaatagcaaaggctaaactaatgaaaccatagaagtagttaatgtgtaaggatacatccagaaaacaaaaaataagaaaatccactccaagtgcatgctaaaaaatacaatacaataatcatttggtttggaatttcaatagaatgttcagactttgtatatcttctgtacaaatagagtcctttgggcacaagtggcctcagacaaccactgggagattttgtctcttcttttcttcccaggacgtagatttagttagaacaatttttacatcagtgaaaaaaatatataaattaactatctacaagtttcctgtttctctttcttccaaagtgactccattaaacattattttttcaaaagtagagaaaatctattattatattttctttgtggatctgtgctaccatactagattataaaatttaggcctatcaaaacacagacttattacattttcattgttagaggccagtagatgaaattttcttactttttatgtaagtctattgatttagagaccaaaaaattatagcagaatatataaacatgatgctataaaagagtatcatggccatcacgtctttgtaatattaatggcattttatatttagggaactattgggagttcctgagtttcagatccatgtcaggtggtaacaggccactaaggcttataaaacctgaatgttgattgccactaccagtttttttaaggatcttctttagaaaaacaagattaacttgacaaaatgtaatgtctagtgaggagaggagctgttacagccaaaacattggcttttttttttttctttcctttttcctttcctttgtatatttaagaatccaatgttgatattctgtgttccatttatttttgtaataatagtacataccacccacagttcttggtttttattttttttattcctgtcaagctgttacacagaaaaaaggcatttttagaactaatgtttatagaaatcgtaataccagaaaattcacatttgtactgaagaattgctagcaatgccggtagtgaaataagtgtggtgcttcaagatggtaatagggatggaggctgtgtcccaggggcttcctataaaatcctgttaagcatttgaatggtaatgaaatgcaccaacactgtattttctgaggaatcttgctggcagatcttaccctgggccgaggaatagcctcatgcagtttgcctctggttagcattacctctcatttcactgcacttgtctcccctatatagctcttttcctgcttctcctttttcagctcaagtgcactcctgtcttaggcacccactgcccccaaatctgcccagcatcacccactgggttaggcctttcatctccatctcaaatcaaatgtggtggttctgtgacctgtctctctggatccgtattccctggggtcctctgagacacatcatagtagaattatttctaatgtgtatctttctggggaccagcatgtatctacccctctatagcatgtaaagcactacgtctggaatgactatccaagattgaattatacgtttcaatttggctaatgtttattggatacctccattgtgcagaatacactatcaggagtggtgaatgcagtagtattattgtccttaagaatagtctgaagcaggagtcaaaaaactttgtccttaaagtgcaagatagtaaatatttcaggttttggactgtaggtctctgtcatcactcaattctgccatcgtagagcagaagcactcatggacaatacataaacaaataggcatggctattcagtaaaactttatttgcaaaggcaggtggcaagctggttttggaccagggccatagcttgctgacctgttgtctaaagttacaatctcttttactcattcttttctgatgtggccttggtaggatagatcccacaacacaaataacaacaaaagatgataattaaaaagaagagccatttggccatcaatgaagtaatgactacagggagtgctgtgtcaacatttacaggcatagatatatacgaaatgaccatcaagaagactgtacctcgtacactcaatgaaatccagaaatattattataggagataagagttccagacttttacactgaaacaagggcttaacaaaggtgtctgggcccagaagaaaataaaaattccttacagcatctgaatatgttgtttaaaaaatgtaacaaggggccgggtgtggtggcttacgcctgtaatcccagcactttgggaggccaaggcaggcagatcacgaggtcaggagatcaagatcatcctggctaacacagtgaaatcccttctctacttaaaatacaaaaaattagctgggcttggtggcaggtgcctgtagtcccagctacgcgggaggctgaggcaggagaatggcttgaacccgggaggcggagtttgcagtgagccaagatcgcaccactgcactccagcctgggtgacagagtgagactctgtctcaaaaaaagaaaaaaaaaaaagtaacaaggatagagagtcaacaaataagatacttacctcaacaaacaaggtacttacctctacaccgatcaccactttaaaaaaaaacactgaaaaacacataaacacataaagaacgataaatggttcacatgagtgtaataaaaattaaatttaatgattgtaataaaactagctagagaagagactgtagaagacatggaaaaacgagaaagaggaacacgaggagaaagttatctacagtctagtaaaagaaatagacatagataaatagataatagcttgatagaacaataaatacatacatagttcattgcaaaagtggcatttgataaatgctatccaagaattactttacataatattaagtaatagataaacctaaagtgtcactggatagataaagacagtgaaagtctatttcctggtcctgtcactgcacaatgaggtttggcagctgtgctccatgcagtgattacaggacctaggctccttccactggtggctgggcacctcgtcacctggctttcaggtgatgtagatggggaaaggaagagagagtgaggaagctgcaccctctcataaccactgagactgggaatgacatttatcatagcagcccacattccatttgcaagaactagtctagggacaaagaggccctagcaatggtgtccagccgtatgcccaggaagagaggaagagcacggatagagtgggcactggtcttcttggccactgttataaaagtgacagatccttggcaacagcgaaggcttcatagtaaaagtgatatttgggtggaccttgggagaagggtaggattttgacaggtagagtaggttttgcagttacataagcaaagatactgaggcaggaacacccaggggtgttggcagggaatggtaagctaacgggtaatgggagataaagttgtttgccaggatcatagacctttattccgtaggcaatgtgtgcagctgaagtgattttgagcaacaagttacatgatcacaaatacgttcaccatcactgtggaagatggactgagaggttgaggatagaagatgagagccaacagaaaggaagttgtcccaggatgtccattgtccccaatttacattacagtccttctgttctgtttctcttagcaagtcttgaatgcctgactgctgccaccactaacaaatcaatgggcccctagggttggaggtggtgcaggggcacagtgcaggcgctgcctttgtgcttctttccccctggtcacctacttagcaggtctgcttcaagcttcatccccaggggcatgtcagctgtgctacaactacctccacatcagtctagtgcctggggcagagcttggagcaagtccttgccttgtgtatttctcagggttctgcagagaaacagaaccaagttgtgtgtgtgtgtgtgtgtgtgtgtgtgtgtgtgtgtgtgtgtgaacagatttatgataaggaattggctcacatggccatggagacaggcacatcccaggatctgcaggatgagtcagcaagctggggttgcagaagagttgatggtgcagattgagtctgaaggccggagaaccagaaaagctggtggcgtggtttcagtctgaagacaaacgggcttgagactcaggaagaactgatgtttccgtttgggtctgaagatagaaaaaagccaatgtcccatgtcaaagtcactcagtcggggaattctctcttattcaggagagaggcaatcttttttgttctattcatgccttcacgtgattagacaaggcccaccccattagaggggacagtctacttatttaaatgtgaatcttgtttaaaaacaccctcacagaaactcccagaataatatctaggtaccctgtggcccagtgagattgacatataaaattaaccatcatatccagcacgtggacaagccaaagcaggttttatcaccaacagcagttctcaagggtagagatatttgtcccttattctgtcattcagggacaaatcaggtacatatcttatcaaatatgtcactgtaatagatacaagtagaacttacaatctatggaataataatcctctgtttacttaacagtatgcatttacaaatcactgcttaaatataatttagtttggcccggcgcggtggctcacgcctgtaatcccagcactttgggaggcggagatgagtggatcatgaggtcaggagatcaagaccatcctggctaacacggtgaaaccccatctctactaaaaatacaaaaaattagccaggcgtggtggcgagcgcctgtagttccagctattcgggaggctgaggcaggagaatggcgtgaacccaggaggcagagcttgcagtgagccaagatcgtgccactgcactccagcctgggtggcagagcgagactccatctcaaaaataataataataataaatatatacacacacacacacatatatatatatataaataaaatttaattctcatattcctccagtaaaggtattcttgttgccacttgatggctttaaaaactgaggcttggagaagttgagtaatttgccaagttcacacagcagtagggttggaaacatggcagtcttgctccaaaaaccatgcactttaccacgatgttatataatgcttttcatacactagggaatatggttagtaattatgagcattcaatgaaataatatacaaggcttaatataatgtctgctgtataataagatctcaacaaccttacttgttagttgtggtgatattagagatacatgtctattcttatagtacagaacaaactggaaaagtatacatttttagtagatgggaaaaccaggatttagacccctgtcttttccttataaggccttaaactcagatgtctccattatggcacagatagaaaaaaagagcgcacgtttgtgtgtttgtgtgtgtgtgtgtgtgtgtttatctccactatgtctaaatggtggacagatatactatatcgtgattttttaaaagaagtttttgctactgaagcaaatgctttaatcaccatataatccagagtattcactatagagacttgtttacaaaaatattaaggcataaaacagatgactttgttaatcttccacaaatcacaggtaatgagtatgtgtcagccttttgttggtgggaaaaggtagtcaagatctgtggagtgggtttgctaggggttgcctgcaggtcaccagtgtaaaaacatattagcaggcttagatttcctcatacaagcagtattcattctcataaggatccttcagttctgtatgagaacttatttatttcagggctggtttatgtgttggctaaaactgcgtctgagagagatactgaaaccaaaccaggcatcgaatggttctgcttccactttatacagcttcatttgttctttgtttataggtctattgctgcccaatgacggatgggccgagagtgaagttccaccttctccaacaccacattctgctctgggattgggcctcgaagattacagccacaggtattgataaaatgatgtatcgtaaatgctccttgttattgtttttctgggagaacacagcaaccttattcagcaaacttattttaactctatttctttctggaatggaaatcttatagtatctataattcctttccagcgaaagcttcagtgaaagtttctcatagctaatagcttagattgggcatattttgcttcctggtatttgttaagattcaccttaaattattaaaatatttaagaaaatggttgaactttcatttacaaatttaaaaactagagccatggagctcaaagaaaagtgacatgggaaggtataaaacaaaactgagaaaataggaagcttatgggtttttattagtaattggcaaaccctagaggtattttaaaaatagatgttccaagaaagttaatggaatctaaaaattaaagcaacaccatatataatctaaaatattgaagagggtacccaatattatatccattctgtaatagaaactaaaaaaatcaataatttttagaatcacacaagaatgagagagatttactaagcatacatactatttgacaaggggaattcatagattttgttcttctgatgagttttaaaaatcattaaattgtccctttgctattttctatatttactatggctgttagaaactgtgtattttattccattctgtgtcccatgataatcctgtgaaatttcttcatttttcttgcagcaatgctagtgtcattcctattatgttttttaatacagtctgctaaaaataaagcagcatgccttagagtatagctaactgtattaggtggaagctcacctatatttagctatctctgattcttatacttttgaagtcagttatcttgctaactacagtttcgtgaactagattgataatcataataatattctagatcaatgtctctaggggtttcataaaagaaaatgtggacctatttaattttgtccattcatttccattgcctgcctcgattctgaattgaaaatgacaatttggtggcataaaaaaagccatttaaaacataatttcatttgttctaccttactgtttatcctgtatatatgtgcaaaatgtttgggatggtgcaaagctgaatcagatataaaccctgtcttcaggaagctggtaggctgacaggtaggctcatgggacgactggaacacaagggttccaagtgatatttaccagaaggtatagataaaatgctctgagcatctgaggcagaggagaatgcctccagataaaggaatcagggaaaatactatggtaaaagtgtcatttgagctgaaccctaactcatgaatagcaggtggacatgagatgagcccaggaagaaagggcatttcgggagggaagagcagcagaagaaacagcatagagacgggagagtaaattgaattgtacaaggtggagctgatcagccagatgataaagcccagagtgcaagaataaggtatgcagacttcatttggtagatagtcaatcttattgcagggttttcgcaggtaatacacagaatgaaacctgggttttttgtgtgtgtataacatggattgggtgaatggaagaggtttgatatcccctggaagccaggactctttggataccttttagggcaactgcagtcagaggtactgagcatctgtgcaggggaggctagagagaagcactcagatgagaaaccttcaagggagagaggtggttcagagatcacctgggatttagcaactgtctttttggcttcaaagtctccacggatttctttccttcccttttctgcaaagccattcctttgtgaattggggagagaaaaaagtttatattgctcctcgctgctgtaaatcttcattacatggtatgaactagtaacttccatcttcttttcacgtcttccttcctagtcccgtgtgttttaggcctctgttctcacttctttattagaactgctctcttaatcatcaacggtaatctcctttcagtcaaaagtatgacgttgtcttagacttcattcttcttttccactctgcagtatttggttattaagtcatttattcacttactcatccattcaaaagtatttctggagctctgagccagacactgtagaaagaactcaaatggattggaaagcatccctgcctgcaagaaatgcagcgtcctcttagagacagacacgcagataattaggatgcagccagctaagcattagatacaaaatgcaatgggagcctagaggaagaagccactaactttgcctggagttgtcaagtaagttttcacaggagagcagtgtttaagcagtttcttggaaaacggaagaaagctctctagacagagaagtggcgggaagggcaatttaggttaaggaaaccagggatgggaaagaatgcagagtgtgttcagtgtggctaaagcttgtggtatctcagggaagaatcaatgggaagggcattgtctgtcctgctccatgggtgccatgcttctccggagagcagtggagaagcattgaagcgctttgagcctggagatgacagtatcaggcagagcagtttcagtgatggagggtggagggaatggcagaagccgccatagacaaggaggctgctccgacttgggactagcaagagaagagcagggcctggatggagggatcagaagcatgggtggagaagaaagggcagagatattttaaaaatggaaggaacaagtcttaagccttgaaactctcccctcctaggatcgtgtgacctgcaccatcctgcaagctgctgcgttgcctaggtgaccagcagcagcaggggttggatgtgtgaaacttgggatggaggaaggactggaagggagccaggaggattgagcaagaaaggctctcctgccttctgcctttcaaaaaaaaaaaaaaaaaaaaggaaaagccctctcaaaggaaaaaagggtgttggagggatgaggctaatcttgtaaaagagaaaactgctatggcgtgaggaaagaaaaacaaatttgatcaaacttaatgcctgtacaaaatgaaatcaggaaattgctcaacctatttttactattatgcaatgattattacagaaaagtttataatatgtgggtctaagtaataaataaatataaaggaaataaacttactgtgagatctcaggcagagttgaagctaaatcagcagcagacagaatatatcgaatattattaacagtttagacaacattgggctattccccacatgttcatattctctttctctctctctctctgtctgtttcttcatgcacatacctgaaactactctcactcatagaagccaattgttgaagtccatctgtggacacctgagacttcagacatcatggtttttgtcttgcctctcaaaatcttcatcccccaccttttcacctcagacagttcttgaacattcattgttggctcttatacatcttttacattcctggtttgtcaccatagtcaaacactggcatatgtttcatgctacccttacttattcattaggcagcataatttgacgttgagtatcgtttctatttggtagattctctggtcgttcatgctgaaaacacggcctttatctaagacatgtctttggcctgctgtcaacttccagcttccaacagccttcactgcagcccactcagccatgagcacatgctaactcccttcaaaattaaaatgttgtatttcatagttaatcattgtgtcaccctcttaatgcaaacactcgagatatgtagcgtaaagttacaaaccgttttactagtctaacttacatgtctaaaatattttcacatgaactaactcaatacggcactcactcattattctggtgctctatatgcccacattggctctaatcctatgacttatattacactcacttgcctccttaatatccatcaatctgatatcagccttatttgccttatttccattttgtaccgcagcaaagggggggcccttttatgaaacgttttcaaagtgtacacttggtcacaatcaaaatgatggtaacatatatgtgtatgtatatagatagatatgtagatatctcattatgatcaatttaaaggacataatcagatgtgtacataagagcatttgttacattcatatgtacagtgcagccttttatttctttgatccttcttgattatatgccaacatttgtataaaagttcactttattagacagatcctagcttgatgttactgcatcgagtgtcattgccaccttactttttaaacggggattgggatcattgctacctaagagtctgggaaaatttgagctcttattcctaatttgtgaattaacacctggcttaagaggataaactaagacaatgagtcaggttcaccaacacattgttcagttgggtagattctcagtctgccttgagcagagcactttaaatgcaatctgatctatgttttaatgagggtcctacacctcctccctggaggctttcactgctttgattaaggatttagttttctattattgcatgatgtgcaccattctattgaaacaaaaagcaaacctaaaatgtaagccacatagtaaaaggtgagcaagtcttcactaaaagtgaaaggcttgatttttgcggattcgggatcagcaacaacctgtgtcccaggctggccaccatttcagccagatcttctggctctggtcccagctttgcccctggccagctgtgtgacctggcaatgccaactctcctctttgagcctcagggtcttatctgagagatgaggtgacctttaatcccttctggctcttaaactttttgattctatgaaggccatgagtctttctgacactaaacccacatcatcacaacagatcaaaggatggaaaacttaagtgcaaataaaggtcgaataacacatttaaaggcaagtgcttccaaacaccaagactcaggggaaagctcatgtttgcagtagtgtctcagaattcttctataaaatgggctgaaaaaatgaaagtattgctattaggccaggctagtgtcaataacactaagtgggtccaggatttttgttcacaattggcatattttgtcattactagataccatatctaatacactttatatatcaatggcttcgtgtattgagaatgtacccagacaccaggaaagaaatagaaaaaaaaaaaaaaaaggctacataaccctaaagagaggatttaaacttcttgagaaatttttatgaaaacatgtgaaatctcttcattggcaaatgccttaggccctcattcgaagaccatactaacctacagaaataaagaaaaggattcttaatagctcaggttgatcaagctcttactgtgtgctaggtacttttctcaatatataacgtaacttacgtatcttacaaaaattttaaagagtcataaattctattcttatccattttatggatgaggaaactgaggccactcaccctgacattttcctacaggggccactctcctaaccatcaaaccacatcacccttctaaatagaaagagaaaagggctcctagtcacagacttgctgagagtctgacaaaaacagagatgtcaaagaaactgtaaaaagcacaggtaatgggaaaaactcagaaatttatagtgttttgggaagcaaaagtaggacattttactgatctgcttatttgttaacttacctaatttatctgtttctatagcacatactctgtaccagaccctaatgtccttactttacaaatcttcactcattctattctctcaacaaccttgtgaggtagagagtgtaattttactcattttatacataaggaaattgaagcccagagaggtccagtaagtctcttagttgacactgctagtaagtaccggagccaggatttagagtgggccagacacaccacagtgctgtgctggttgatgggtacttcctttctgggggagggtggaggagatgaggtctacctttgtcacccaagctggagggaagaggtgcaatcttagctcactgcagcctcaaactcctagactcaagtgatcctccagcctcagactcccaagtaactgggactacaggtgcatgccaccacacctggctaaacaggtacttccttaatttacccacggcattataaaaagggaggttcatttattcatttggcaatactattattgctgcatactaattttaatattgcttgaaagcagtattgaatatggagggatgatgagtttcaagaaaagattaaacttattttggtatttcaggtcgagattctcttgtacattttagaaggattttctttcaaaacagttatttttgctattgttttgttgtttatagtatcaaactccaactgtttgaaaaacccaacatcaatactttagattttgtaaggatacatgatttggattttcactatatttgggattagaatagcaattataatgagatgagccaccatatttactttccaaacagatgagagtgccaaggtaagaaaatggctataatttagtttattaaaattatataaatttatttctaaaacaagaactaagtcattgtctgtaattctcttatgtaataccctctatcctcaagcaaaataaataaaatattcagcagaaggaaagttatttgagattgcctacaagtactaagaaaactataatgggcatttgatgtatcttgtgtcttaattgtcaactgtgctcttcctattatttccttttggcacttttggtgagcagactgtctgcttagtgttaacattagttttaggaaaaagacctaaataaagtagaaaaccaaactcctacaggcatcagtcattcaacaggatggttttctctaaaggatacaaccctttcacttgtgttttaaaataggcatagcttagtccacagaaatcccttaacctgcttttgggctctgctaatatccagtgacatcttttgaagtgctagtgttttccaggccctctttacccacttaaagttatatagtgtacagcaggatcccaattagcagaaatcagtgaagagtaaaacacgatattgcccagagaatattttatttaaattgtacagtgtgataaaatacatgaaaacagagttgctacatctcataaaagaaacctgagatttaagaattagttgaaaatatgtggttgggagctgcgcagagtgatgagtggctgtgttcaaaatgagaactgcttcctcattttttaaaagattttattctaaacctaaatacaacatatggcttccttccacagctctggggtggattcagcagtatattttccagatcagcacatcaacttcagatctgtgacaccggccaggcagcctgaatcaattaatttgaaagcctcgaagagcatggaccttggtaagcaagggtgaggtgacatccaggtcagctctccagcctcagcccatttatcttcccaaatgtcctggttttgtttcttcaactcaaacctcagggaacaaggtctgcagaagcctggaggaagggataatggccatcccaccttcctatctcttcgcacatttaattgtaattacccactttgtgaaacaaagagaagtgatttatttttacaaagtgatctataaactatcctcccatcatagatgacaaaaatgattccttctggaggatctgaattccagaggcatctttatctcatccatctgcctttgcatttgcaccctcgcttctgccagggcatttccactctgtgcgggcatacctgttgcagagcctgggaaaatcatgtggttcaaagcatcctttgccttagtgcttcacttccttctattcttctccatgtgtgatggatagagatggcatcagtgcagaagattcagctttttaaatgcccatccccaaatcctgtgacactggaggggaaaagggtctcttgggcgtgccacactgagggtgtcaaggtaccctgtgtccatgcctgaacaacctcactgaggttctgagcaccatggggaacttcgtggtgactgttgggtgccagggcagagcaagggcccctgttaactgtgttctgaaagccttgggacatctcagataccctagagcatcactgccctcccatgggctcttagagagaacaccattagagaaaagtatggatacaataaattctcagcaaaatatccattgcctcatgaatgcttggaggccaagctttgcaattgttttttctcaaggcatattatatatttctttagtaacaacgagaaaatagaataatcaaaagtgcgtgctccaccaaacgatctgataaatagtgcttttctgttactcacttacaggagttcagaaaaatgttcagtcatgatgaaacaagagaaattgattctattttgtataaattaactaaatgactgggatgcatttgctgtaatcgcctgtagtgagagacagatagaaaccttaacaaggaagctgtcttgagcactggtcagaaagagtattttctcaagcgtgaacctttgacaaaccaaaggaataatttgtgacagtgacataggttattactaattatttaaagagcagttcattttcatagagtgcttgataaacatttcctgttctgtcttcccaatttctctgtaaagaagatgaatggatcaaaactgctcttatttttgaggagagaaatatatttgttttcctcatttaattaaagcagccactattatgtttctaaaaagaaaaaacagcacccattttaaattaagagagaaaaaatattatgaaacctgtaaaaaataaaaccaaagacatgtgcagaatcaatatttttgtttacattttaattttattattattattatttttattttgagatggagtctcgctctgtcacccaggatggagtgcagtagtgcgatctcggctcactgcaacctccgccccctgggttcaagtgattctcctacctcagcctcgcaagtagcttggattacaggtgtctgccaccacgccaggctaattttttttttttttttttttgtatttttagtagagatggggtttctccatgttggccggggtgttctcgaactcctgacctcaagtgatccacccaccttggcctcccaaagtgctgggattacaggcgtgagccaccgcatccagccgttttgtttacatttttattaccaaaaactgttttttgagttttctcttctaaactgaaatagtcctagcaaaatatatgtagttagccgtcattctttgcatttttttatacatatgccataaatgacaacgataatagtaaggtttattcattttacaaaattggtcaggttacgagctattttcttcaggaccctagtaccaaactaaaagcattggctaaaatgcaccatgcagtggaaatactcaacagcatgctgtaaaaacaagtttagagtaatcatcaaactttgctcctttccaagaagtaccaggctaaagccaacagtctttcagaaggccctgagagtcagcattctagtaccattttgatcccttctccccagaacagtcaagtcagggagcctaacaaatgtgttagccttctcaatatgaaattcacttaggtgataccgcaatggtaaacatttgaaagtgtcttttctgtttcattagaggaatagactattcgttttccatttatagcactaggccaatgtaagagattaatttatttgctcaaaaagtaggtgactatgtttataggaataatcctagcaggatcttgattctttaaagcgttttaacattctttaaaacgtcttaataagtagcctatttaggatgaatacacaattcatgatgtctatttttgacctggaaaaccagcattttcatatggttcaaaatttaaaaaaaaaaccttctatttgttacataattaatttatattggctatttctcactttataaagtctgtaggaatcttcaaaggctgatggatcctatcagtagccttgtttttgtttcatatttgctactaagaccaaactagtattttaacttgcatgttaatgagtcattgttcatctgctcaagctattttaaaggtgagtggcttccatttacttattttcacttatattttcaaagacagacaattccaattaagaaaaaataaagcctccttattcccatcccttttacctattcatcagacacaaatatagtctaaaatgtgagtgctcctagaaagcactagttgcttccccatctatgtacatgtccacatcacatatcatttctttataatagttgcatagtgttacattcattaatcttcatttacagcttactttactcttccccttttaatggaatgtgggcttcattggcagttcttttgttgttgttttggtgggtttttgagtcgtttgtgtttaagattttgcaatttgtttatttatagcctttgccacgttaccatttgttaattttgtcctctttcatttataaaatattgttacatgggatgcaagtgatttttttgcaacccattatttgtctttttagtttgattgtgatatttctcatcataaaaaaggtttcagtcttattctcaaatattttcatcatttcttcttttgtgacatttgggttatatgtttatctcattttcctctggtacttttagaggctttaaaaatatttaggactctatcatatatttttatccatggggtatgagatggaagaattttctcacataaataagcaaattattaataacatgtattgacttctccgttctttccctattaatttgaaatttagtcacattgaatagtaaatttgcacacatagatgtgtgggtttctagacatactattctgttgatatattagtccatctcatgtcagcatcaccccatttaaattatcttgctattatgtcttgttttgattacttacaggataatcttcctttaatttttcttcctttgtgaaattactttggctcttcatatgtactcattctcctgcatggactgtacaatcagctaatcaaaatgagtttaaagatgaaacaggaatgcttccactgtggggggggggtgtgtgtgtgtgtgtgtgtgtgtgtgtgtgtgtgtgtgtgtgagagagagagagagagagcatgcacattaattataatgtttgctattggcttctgatggaaacatttgatcaagctacataagtttctttgcattcctaacttcctaaaagttttttgattaaatcatttattttttttaatcaagaatgaatgtttaattttagtaagtgattttaaggcccttactggctgataatgtggattttgttctttattctattagtgaaataaaagtgagttaattaatagattccccaatattaaatcttcgattctttttcaatgactctaaatttttctctttacttgcaaaaatgtttattgattaactacagatatgtatattaaacacttcttgagatggttaacacattatatgctctaaaatgtaggtgtacaactctgataacaattttactcagtgtcattaattcctatatatacattataagtataatgtatatgtagcccttttgaggctgctttgccttgggattttgtggatacttttactggcatgcatgtggtcacatttaaatcagaacagaaatgattaacatgataaataaaaggaaatttgtttttaaataattgcatgtagtcatgctaattcaaaggggttagggtgtcacttaagagactggagagtggatacttctgggttttggagaaaatcaatcttttcctactaattgtagacttttccctatttatttaaattaccagaattactgtgttcagtctggactcctttaatttgttcataattgagcttgtgtgggtgttgagttggaagctctcaggagctgaataacacagctgcctctttggcctttggcatagggttttcccccaaagagctgcccttgttggcagtatgccaggaagttacattcaaagactttttgatgaggcataaaaatctttaatttccaggcttggtgttttatgaccccataatactgtttgagaattagtctgaattattcaaaagatagcacttcagtttgttggccccctttgttgacctactctgtagccccattcagagttaagtttaaaatgctgtttctcacaagatactgtttttagagttttctatcctgtttcacattggcctcccacgcccatttcagaagggtgttctataacacagtttggagaaggctaagggcagtgcaaatggaagatgctggccagctgccctgttcagtaagaggaaatgagcttaaagtgatgcatgaggcattcagacgaaattttaggaagtttcctgacaatgaagattgttaacattccatgtctcatagtcttttaagaaagagcatgtgtcctgaaaaactctccctaaaatcaagacgataaataggttggctgacttcctttcaagattagtgattcaccagttttattttctgttagttacttgctctaatttttttaaattaggaaatgtttttagacacccacaattgaagtaatttataagccaactgagttctcacatctacaaaggtaaatatttgagatacattttgaatatgaaaccttttatatatgtcagatattcctcttagacagtacatttctagtatcagctcaaagatgagcatgaaaaaagccccattctactgctctaatactttctttttaagattatattcatatagtgaggtacttctatatgaattattgataataaagactgaatacataggataatttttataaaattgtatattctaataagtgtgatgctggtttgtattaatatataaaatatattttactatttttatttatatccatggatttcttttattgtccaccaataagtagtacctctgaatatagttaaaagctgaattggatattactgtttgggatacaactttgacttaaagaaaagaacctgttttgtaaagaaaaattaatggtaatattgtaagaaagtgtctatttgtataatagacaagtatacaaagatgaagtcagctatatactttaagctctagtaagtcaaaataaaggaattatagagaatgttctttcattaagtaaatgtttattaagtgcctactgtgtgccgggaagtgcattaaacactggagatgtggtaaataaatgaaagaaatggtgcttgctgcctgtacctagattagaaccccaacaggaaagaaaagctcaagagttaaggaaaaactaccaaaaggaaattctgacattatgataacttatctcagggaggaagaaagggaagaggcatctgaagacactcatgtggctgcctcaagaactcactgataacctcggctatgtagaaaagaggaagagagaagcaaatgattaaaatatatacatatatgtacatttttactgtgtgtgtatatacacatacacacacacacacatatatatacacacgcacacacgcacacacgtagtaaaaatctgaaataatatatgcaggaagaggtaaacagctgcatgagaggagacttgcaaaacctagtaaaagttagacagccaagctatttttaaagcatgaaaaagaaagtgtgcgaggtggcccattgttttaaacccctgctagatgtcaggtggaaagcaaagccactcagttcctgtgttagtattatcctcatacataggagagaatgatggtcaaaccaaaaaagcatggctgccaggcaatggaaaactagacaatttacatccctgtgcactaaaaggcttgtgattataaagtggccgtccctgatcatcagaaattatgaagagtaggcctcacactggaagacaaggaagcaaatgatcaattttcagaaagataatgaattccagaaacaactggtaatctcaatgctgatcatcagatttccatgtttgtgaaattaaaaaaaaaaaaatgtggtggtcaccagcaatctcaatggagtccttgaaataactggtgtctcctttcctttttgatgggatttctaaactgctaagtcaggaaaatgttttacatataggttatgttgatgtttataaaagtatttccatttgttttcttattgagacttatgggtcaaattacatacagaggtagacacagcattaaaatgtcccttcctgaaatgtgctaattaatgtctcattgtcaccttggagaaaattaaataacatataccataaaacgacatctttattgtgttctgataaaactcaacagaatttgatgaagattggatataggtaatttggcacatatctaacttaatatttgtatacttccctgtctgttatacaaagcaaacagacctctttcagtcttagttaatttttctttacaaaacaggattttttccttaaagtcaaagaagagtaaagaaggaaaaggcactcttcacaaattttcaagaaataccgtcttagagaattgggtgatagattgacagaattagcattcagatgatttctccagaattgaagaagatagaatttaataaagaatgatgcattcattcaacaaggatttattgacacttactgtatgccaggcaacatcccaggtaaataagacaaaggctgcagtcttacagtgttttcattctcgttatgtaaacagatggtaaagatgtatacagtgaataaataataaaatttcacatgatagagattcaaatagaaatgttttttcctaaagccaaattcaggtagagagaatgactgaggggacgtgaaggtattttagatgggatagtgaatgataaaggttatgtcctaaagtcaggttaaaaaagattaattgtataagtgtaggatttacgagagtggggatagtaactattgaagtaatcccctggttcttagctgcttgcctgacacggccatccccagagctagttctgtgttttcagatcaaaggagaaaacagctccactttattctggcctggtcataacacatttacagttccatattcaattatgggtacaatattttaataactacaaagacagtatagaatgcaatccagatattggtgagaggcctagaaaccatgtttagtaaaaaacagttgaaagaataaagatattatgcctgaaagagagatgatttgagtcataggagagctctcctcaaatattttcatgcaaatattgaaagactcacatatgtttaaaattaatcagtaccccagatacatcaagcaatgataatcacatcagaagatacatcacatttacaagttttgaaatcgaaaaggataacagtgatggaaaacggaattctggtttatggcatgtttggtatgaaaggaaaaatatataaattaaaacagctcctgaagactgaaaagagaagcagaactcaccaaaattatgagaaagagaccatcatatatttttcagtgtttgacaagggatacaggttctttttattttttgttagagtattttaatatgattatgtcattaaaacatattatagggccgggcacagtggcttacacctgtaatcccagccctttggggggccaaggcgggcagatcacctgaggtcgggagttcgagaccagcctgaccaacatggagaaaccctgtctctactaaaaatacaaaattagctgggcgtggtggcccatgcctgtaatcccagctacttgggaggctgaggcaggagaatcgcttgaacctgggaggtggagtttgcggtgagcggagatcacgccattgcactccagcctgggcaacgagagtgaaactccatctcaaaaaataaataaataaaacgtattataatgtatatagttatatgttttaactacataactgtattataatatgtacacagattataacactgtgtacatattacacagaatataattgtagtgagatgaatagatgaaaagttgaatttagagaacctacctgtcagaactcaggctgaattcttagacatctctagtggtaaaagacttcagatagtttccagcacctccatccacggcaggcctctttcaaaacattaagaaaaccaacatttggattaaccaaaatttaacatgtaattatattttagatgattgctacatttaaagtgaattatagactattagtagtagtaactgaaatgtagaaatatagatcactataatataacttgatcaatatttcagatgtagcggaataaggcagattctgtttaaaattcattaaaataaccatttgagttggaagcaaaggtgtaaaaatggttctctatgtcaaggacatgcttttcatatccctgtaagtctctatctatcctttcctcctgctgtatttttgcattccctaggaaacatactttcaagaagaatttgactttgtattcattcttactactattaattggaaaacaatatcttttgtgtaggaattgtacttttataatgcttcatatgtttctagacttgtctaaaagttgtggcaaatgccaggccatccctgtcatacccctcccatgactaaatgctcacaaatgccataaacttagctgcactcttttataagttattgaatgagtgaataagaggtacaactttctcaaatgcccccatctgaaacaggaaaacattcggagtaaggatcatccctcttacataaaaacacttaacctaatgcctagaacatccctaatgcctagggatttggtggtgtcattagtaatagtagcagtcatggagagggtagtgttggtagtataattagaaatgagcttctacatctcctacaagtttttcttataattagtagtggacttgaacagtcaatataagtaaattctcctaaagttaagtattatgaaatgctgggagaaaagttaacctgtggatttcataggtatatccttaagtcaataatggggccacaaatggtctcaaatgttgccaggcagtttttcactgagtgtattttctcaagctgggggcatgtttaatggaatatgtagttaatttaaaatgtcactgtctctaagagaaatgtaagactctatttccccagaagagatacaaaaaaactataaagtttagaaaaccttaaccaatgatattctgccagtaacaaacccacgcagatttttactaaattgacctctgtgtacttagaacattgtctgtgctctgattagaaattttggtcaatggaaaaactgccctattctttaaaatttaaatattctgggctcctcttaaaacttggattagaacatgaagtgctttcttctttttattttgtactgaggctctgtatctaggattctaagccttttttttttcactttttatttttttactatacttttactttttactttttatttttttactatacttttactttttactttttatttttttactatactatactgggatacatgtggagaacatgcaggtttgttaaataggcacacacgtgccatggtggtttgctcacccatcaacccatcatctacattaggtatttctcctaagactatccctcccctatgctcccaccccccaacaggccctggtgtgtgatgttcctctccctgtgtccatgtgttctcattgttcaactgccacttatgagtgagaacatgcggtatttagttttctgttcctgtgttagtttgctgagaatgatggtttccagcttcatccatgtccctgcaaagttcatgaactcatacttttttatggctgcatagtattccatggtgcatgtgtgccacattttcttaatccagtctatccttgatgggcatttggattggttccaagtctttgctattgtgaatagtgccgcaataaacatacgtgtacatgtctcttcagagtagcatgatttataatcctttgggtatatacccagtaatgggatggctgggtcaaatggtatttctggttctggatccttgaggaatcaccacactgtcttccacaatggctgaactaatttatactcccaccaacaatgtaaaagtattcctatttctccacatcttctccagcatctgttgtttcctgactttttaatgattgccattctaactggcatgagatggtatctcattgtggttttgatttgcatttgtctaatgatcagtgatgatgagcttttcttcatatgtttgttggctgcataaatgtcttcttttgagaagtgtctgttcatatccttcacccactttttgatggggttgttttttacttgtaaatttgtttaagttccttgtagattctggatattagccctttgtcagatggatagattgcaaaaatttgttcccattctgtaggttgcctgttcactctgatgatagtttcttttgctgtgcagaagctctttaatttaattagatcccatttgtcaattttggcttttgttgccattgcttttggtgttttagacatgaagtctttgcccatgcctgtgagctgaatggtattgcctaggtgttcttctagggtttttatggttttaggcattatttttaagtctttaatccatcttgagttaatttttgtaaaaaatataaggaaggagtccagtttcagttttctgcgtgtggctagcaattttcccaacaccatttattaaatagggaatcctttccccattgcttgtttttgtcaggtctgtcatagatcagatggttgtagatgtgtgatgttatttctgaggtctctattctgttccattggtctatatatctgttttggtaccagtaccatgctgtttttgttactgtagccttgtagtatagtttgaagtcaggtagcatgatgcccccagctttgttctttttgcttagggctgtcttggctatatgggctcctttttggttccatatgaaatttaaagtagcttttcctaattctgtgaagaaagtcaatggtagcttgatggggatagcattaaatctataaattactttgggcagtatggccattttcactatattgattcttcctatccctaagcatggaatgtttttccatttgtttgtttcccctcttatttccttgagcagtggtttgtagttctccttgaagaggtccttcacatcccttgtaagttggattcctaggtattttattccctttgtagcaattgtgaatgggagttcactcatgatttggctctctgtctgttactggtgtataggaatgcttgtgatttttgcacattgattttgtatctggagactttgctgaatttgcttatcagcttaaggggattttgggctgagacgatggggttttctaaatatacagtcatatcatctgcaaacagagataatttgacttcctgtcttcttagttcaataccctttatttttttctcttgcctgattgccctggccagaacttccaatactatgttaaataggagtggtgagagagggcatccttgtcttgtgccagttttcaaagggaatgcttccagcttatgcccattcagtgtgatattagctgtgggtttgtcataaatcgtttttattattttgagatacattccatcaatacctagtttattgagactttttagcctgaagcagtgttgaattttattaaaggccttttctgcatctgttgagataatcatgtggtttttgtcattggttccgtttatgtgaaggattacattaattgatttgcgtatgttgaaccagccttgcatcccagggatgaagccaacttgatcatggtggataagctttttgatgtgctgctggatttggtttgccagtattttattgaggatttttgcatcgatgttcttcagggatattggcctgaaattttcttctttggttgtgcctctgccaggctttggtatcaggatgatgctggcctcataacatgagttagggaggattccctctttttctattgtttggaatagtttcagaaggaatggtatcagctcctctttgtacctctggtagagttcggctgtgactttgtctggtcctgggcttttttttggttagtaggctattaattactgcctcaatttcataaagacagatatgaactttttcttatcacttgcttttgtttcctaaaccattgttcatatttaaatgaaattctgtgttcctttttttttttcttttttttttttattatactttaagttttagggtacatgtgcacattgtgcaggttagttacacatgtatacatgtgccctgctggtgcactgcacccaccaactcgtcatctagcattaggtatatctcccgatgctatccctcccccctcccccaaccccacaacagtccccagagtgtgatattccccttcctgtgtccatgtgatctcattgttcaagtcccacctatgagtgagaatatgtggtgtttggttttctgttcttgcgatagtttaccgagaatgatgatttccaatttcatccatgtccctacaaaggacatgaactcatcattttttatggctgcatagtattccatggtgtatatgtgccacattttcttaatccagtctatcattattggacatttggcttggttccaagtctttgctattgtgaataatgccgcaataaacatacgtgtgcatgtgtctttatagcagcatgctttatagtcctttgggtatatacccagtaatgggatggctgggtcaaatggtataataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcggcaccacaccacacctattccaaaattgaccacatacttggaagtaaagctctcctcagcaaatgtaaaagaacacaaattataacaaactatctctcagaccacagtgcaatcaaactagaactcaggattaagaatctcactcaaaaccgctcaactacatggaaactgaacaacctgctcctgaatgactactgggtatataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagcaataactaaaatcagagcagaactgaaggaaatagagacacaaaaaacccttcaaaaaattaatgaatccaagagctggttttttgaaaggatcaacaaaattgatagaccgctagcaagactaataaagaaaaaaagagagatgaatcaaatagatgcgataaaaaatgataaaggggatatcaccaccgatcccacagaaatacaaactaccatcagagaatactacaaacacctctacacaaataaactagaaaatctagaagaaatggatacattcctcgacacatacaatctcccaagactaaaccaggaagaagttgaatctctgaatagaccaataacaggagctgaaattgtggcgataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccgaagccaggcagagacacaaccaaaaaagagaattttagaccaatatccttgataaacattgatgcaaaaatcctcaataaaatactggcaaaacgaatccagcggcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggcattgatgggacgtatttcaaaataataagagctatctatgacagacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgatcgtatatctagaaaaccccattgtctcaggccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgggaaggacctcttcaaggagaactacaaaccactgctcaatgaaataaaagaggatacaaacaaatggaagaacattccatgctcatgggtaggaacaatcaatatcgtgaaaatggccatactgcccagggtaatttacagattcaatgccatccccatcaagctaccaaagcctttcttcacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagcggaaactggatcccttccttacaccttatacaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagacaaaattgacaaatgggatctaattaatctgtgttcctttttaaagaacttttgttttcatataagaacatcttcctaaaagtatgaagctaaggatgcttattcaaagaatggaacaaaatacttaagttctccttgcaaatatgaaccaaatccattttagttttttgaagtgagaatttcattagttgaaaatgttatatataatgtgcaattaaatatacaattaataattaaaatatacaattaaataattaaaaatatatgatataaatataggttaaatgaagtttagcagtttcataattatcccttctgaatattttgaatgataaaatttgttattggcaatactttatgaagtgattaaagacactgtaaggagagacaactatctgatttttagatgcagtagttgcagtttgttctttaaaaagcaaaatataaaaaaaaattagaatgaatgaataaggcctagtatttgatagtatgacagagtgactatagtcaataatgatttaattgtacattttaaaataactaaaggattactggattgtttgtaacgcaaaggataaatgtttaaggggatgataccccactttccatgatggattattatgcattgtatgcctaggtcagaacatctcatgtatcccataaatatatacacctactaagtacacacaaaaatacaaaataaaaaattatcttaagggataaaacagggccagtcatggtggctcatgcctataatctcagcactttgagaggctgcgttgggaggatcgtttcaccctgggagtttgagaccagcctcagcaacaaagcaagaccccatctctacaaaaaaaattttaaaaataaataaaattttttaaaaaataaaataaaaagaaaatcagctttagtcttacatatttttattctcttatatacctacctgtgttcttatattctaatttttctcaagtgattgtaccaaacatatttctttaaatttgtattaaaaacagtctaacctaaacattgttctctggatctttacttctacaacattatcttttagttgtaaagtttactctggaataaatgtagcgtgattcacttgactaatattatactctttgccataaaagttgtttccaattcttcacttctagaaacaggaatgcattgagcctgctagtacatcaacctttgtaaacaatcatgattatgttatcattataatttctatacgtgtactccccagccagatgatgtattaaagatatgaggcttttgattcatatgaccagttgccctgcagaaaagcagttttgctcgtatcagcagtatatggaagaatctgggtgtcatcatttttttttcatttttgccagtgttataggcttaaaaaggttattttattttacttttaaaatcacttctgtggttaaacctctcccagctgtttgactgtatgttttctattgtgaatgatctgagcatttcctttataaggctgaaaatttctaaagtaaatatcactttttggaattaaaatgttactctacattaaagatcaaatttcagcccttgctcacaggggaaaatagatactttgctttcatttaaatgttaccctctctgaagtacatgctaatgaatacatttgtgtctttcattaagtgttcagaaaaatgtttaactaaacatgaggcagaggcagaattcagatttatttatgataaaactgcttaatctgggtcaagtcaattaatctttctaaaaataatttatttttggtttttcatcagaaccccagaagccaatatacttgacatacagcagtgctggctgctttagagcatattagtacaaagactggcatcaccataaacacctactctgcttttataagactgaaaagtgcttgaaaatacaatttcagctccatgtgaatgtatgtatccatacatacaatagatgtatggatgcgaaagtcatccatacatctattccctccttccttcattcatcatttattgggtgcactgtctatgccaggtaatgttccaaatatttgagacatatcagtgacaacagacagtatcttatttctgtagcttacctttctttagtggaaatactctcatgaacaaagtttgagcgatgaggtaaataaacgataataacgcaataagtgaataaagttgctggaaagatatccagtaggacaaacataacactacaaattgtggaaagaggaaacatgactggaaaggctagtgtttcaatacccacttggtttctagtgttcataagaaaaggtaactagcaacactatccaatgaaggtataaaaattaaagtgaaaattaaaatagagatcaaattggaaactgactaatcaagactgatggttttaagtgggctgggaataagctaatctgtcctctgctgatccaggaactaactggcataatccccagtccccaaacgcttcagaattgtcttgaaagaattgtgagagcctgaaaaggtttcagcttggaattccttaaaagtaaaacaagggggtaccaatgaattggagaacatttagcatgttttcaaaatttggaataaattatcatagcacccaaattgaaggaaaaatgagttccattagaatttttttattttcagctttaataaataagtagatgtcaggtaaatgatctcagtgctttctctgtacccagaaaggccagagggaaatcttaggtgcccagtcctctcacttgaggctaatagtaccaccttatcaaagattgaagaatatatttgttaatataaacagtattcacaaaaatgtcagtgaaactaacagattggcggttttagtagtgactttaatgataaaagtctcggaaatgctgacaaagttaaacaggcttcttaaatacgggattgctcacaaccattagtgcatgttttgtacgtttccaggcttcaagaatcttcaggatgtaataaatgcagcatttcccaaactcatttgatcacagaaactttgagtacagactatctcataggtctcatcctttgaggaatgtccttagcaaagaagatgtgagtttgcttgtgagatttaaaggtgatgtgcaacagccagagtagggtgaggaaggattgccaacaagctgggacacgtggagcaatgctgtgaagtggggtgtaacctgagagagaatctccagggcagagaagtgtccacagccactaagcaagtaggaattaactgcagagcagcaagaatgaacagggctgtaatcaactaagcatacattaaccatggacggtgatgatagaatgtaactgacagcactgcaatatgcctccaaaagaatggcaaaagaatggtaaagataacctctgatgttactgattatctgtggccagaaacctttgactctcttttacatatggtaaaaagatcaagccctaatatttaagcttcagtgcctattaatctagaatatgaagattaaaaagaggaaaagcattagtagtaactgtaatcttcatagctgtatgtcaggcatagtttttttgcacagcaattccatcgccattttacagatggggcaatcagggcttaaagatgttgacttatataagatatctcagctagtaaatggtggggccaggatttgaactcaggcacatttaactttgatggttgggcttcagaccattatggctgtttcaaataaggcttgtcagtttcccagtcttaactcaaaaacagacgacctattctctctccactcttttttaaattctgtctttcattcaggacccattcaaatcttgccttctctaggggactgtcattttttttttccagctccttttctgaattcctaaagcagtaactattggttattcaacttcacaagtaattaagaaaattgagatactatatcttagcacagaatggcatactcctttgatattcttttgagtgagcattttttttcccattccaatcaggttataagcttctacaggtgatactgtatacttcttgggcacctcccttcaccacttagcatgtgtaggtgcccactaaatccaagatgaatgagtgaatgaatagtgttggagcaatctggctgcaatctcagaaaccccgtggaccacgatgattgatttggctcatcttactatctgggcaggttcccttttcctacatcaaaagattgaataaataaaagtagaaacaaatgattaaatgacaagtgaataaaagtgcaaattaatggtttgtttgagtaggaaaatagaatgaggataaaggtagcccagaacatagcaccatacgctcatattcacttacctggttttgtccacttaaaaggaaagtgtttgggaaaggctgataaaaatgaacgtatttaaggaaggaaccaaacacaggaaataaagaaggtcaaaggcttcaatttcattaaataaagaagaatgaaagcagttgtttaaaacttgaagaaaagggctgtgtgctttatttcctaattggaggaatctatgaataaattaggcaatcacttgacataattggtttaggtcatgtgaattcacttgcaccacaagagagggtaaattagatcaaattgtttgtggcccctcctagtcttctgttcattacaggcattcttttttccttttgtattcctctgtatcttccttttaggttttttgtttgttttttaatctcaagaagtatgtgtttttatttatattattttaatgtataagatgtttttccttttggttgcagaacagagtagaagataatattcctgtaataaaaaaatttgtgtgcttcttatttattaatcccattttgattttttcataaaactgtttgcacaaaaataacgtagtctgtacataaacacagtgccatgggaattatattcaaaacatgcttgaactgcttgcttttacctgaagcaacatgaaattgaattacattagtatagagcaatttggttgcatgtcacttgtggcaaatattgtgtaagctgaatatttagagattttgttcaccttgggtcacacagtattagttgtcacgaaaaataccccaaggtgataccaaaaaaaaaaaaaaatcctgactcaaagaagacaattgactcaaaataaattgagaatattccattccaaatggtttaaacacttggtacagacccaatgtagcttcataatttatgcaaatttttatctgcaaagcaatttttgtatttaggtttaatcaaagagcttaataatgcaagtacaatctatttactgtcacctcatatgctaagacaactgagaaacattaaaaggccctacgttcgcatgacccagtttgtacagtagccagcataacttcttgatgttgatggatatgtgagttaactctaaaatgggctaaattaactaacccattagatatctaaatgtgtatccctttaaaaaatagtacttacttaaagggcttatccgtgaccaagctataatttagagatgttgttatattgaaaatgtggtcacaaagtcatttaagggcaagaatttctaaaggcggctcagtctaattgtccaccccactgggaaaactgatgatatgcttcgtcattaatggattgggaatatcatatctgtaaaagaagttaatagccttaaattgttgtttaatatgttattaccatgcacttttctaggtgtgttttagaaggttcattttaaaaataaaatgctggtgtgtaagagaaatacttggagaagcttatttcaatgaaaagagaaaaatttgtttaagttggagaagatatttactatggataatatatgtaaaaccaagaagtgatcctaagagttcactttggattacattgttcttttttttttttaattcagcaacatcctgtaaagttacttgatttggaaatgccaacattcttaaaataggattaagagacactgctttaataatcgctccctattatccacatgttctttgtcattcaagagaataaaggaataattagaaaatacttgacaaaagattaacatccttaacatatgaagagctcttataaattatgggaaaacaaatatttcaattcggaattggaaaagtatatgacaattcacaaagggcaaaagaaatttatttgggacataaatatgaaatatattcaacctcacaagtaattaagaaaattgagatattatattggcaaacattggcaaatgctgaaatatatatgttccagtggtacagaacatgcttgttggccatttaaatgaatgctgctttctgtaaggcagagtggtaattatataggcaccttaacactattttcatcttctacccagtaattctatttctaaaaattatcctaccaaaaaaataaaagacttgaccaagatggaatataaaaattttccctatagttaattttccagcaataagagaattagtgaaattatataatattaatctaatctatataatacactattatgcaactaatagaaatcttcagaatgcttcatgaaataaaaaatgttaatggtaaaatgccagttaaaaaaagcagagtatacaattatagtagtgtgtatgtgtgtgtgtatgtatatatataatcatgtacgatgtagtaacatttcagtcaactgcagactgcatattagtcccatgagcttataacagtctatgtttactatatcttttctatgtttagatttgtttagaaacacagatacttaccattaggttgaaattgcctatagtattcactatagtaacgtgctctatgggttaacagcataggtaccataggctaggccatatagcctaggtgtgtagcaggctaaaccatcgaggtttgtggaagtacgtgttatgatgttcacacaatgatgaaactgcctagcaatgcatttctcagaacctatctcagtcatctagtgacgcatggcttataaatcaaagaagaaagtttggcaaaatgttaatattgactttctcttagtggaagttacgtgtataatttttactttattttttatatgtttctgtatatttcaaatctttaccacaaatatgtattacacatataataaaatcaattggcagtataaaactaattttaaaatagaataaaaaagcagaagcctgttcatggtaaaaagaaatgcagatatttaactacaaaaaggacaaaaggggtatgaagtatgtttaatgcttacttcgtatcattgaggacttatcacctggaaagacaaataagaatatttatggggcagaatgatgacatgtttgttaagaggttttaggtcaacacagaacagtactctttatcagttaaaatagcattagctacgagcacattccactgcaatgctcagggatccgtaccaaactgttgttgtaagcaggagttcatttgtcttatgtaatgtgaagcctgaataaggccaatccagggtctccgtgaaggtaccagaggcctaggctccttctcctcttcactctgccactcttgactttctggctctcgcacccatatttgtcactgtggagtgtacagatggcttctatgtcttcagcaatcacatccatgtttcaggcaaaaaaaaaaagtaacagaaggcaaaagggtacgccaacattcttccctaattcaggaaatccagtatcagctaagaagtgctgtccagcaaacttctactcttattcattggccaggactatcacatgtcacatactgtctagccagaaagtagctagggaaaacagggttgtaggtggcattggatcagtcaagctacatgtctgccatagccacccagtgtgtctgtaagtttctggtcactgcatgtgtgcagaagtgcacagacagcctcattagttaggcagaatttctgagttgctttagatcttagtcctgagagactattattttaattttgttttgacagaattgtagaataagtagaaaaatgataagagagcaatgtcctgattctctgtccactgccaaagtcaagcttggccaattatatttaagctggaacagaggataagaagtgagagttgcttgagagaatcatagtaccatcttcaaacagagaagctagtgaaggaacaagatgcaggaaggagacacccagagagaagaataaccagagaagctagtgaaggaacaagatgcaggaaggagacacccagagagaaaaatataacaacaaattactattttttcttaatgtctctaacctactggttttaaattttatatatatacacacatacatatatatatacacacatacatatacacatatatgtatgtgtgtatatatgtgtgtagataagtatatatgtatatatatgtgtgcatgtatatatgtgtgtatatatgtatatgtgtgtgtatatatgtgtgtatatgtgtgtgtgtgtgtgtgtgtgtgtatatatatatatatatatatatatatttttttttttatttttttgagatggtctctcgctctgtcacccaggctgcagtgcaatggtacaatggctcactgcaacctccacctcctgggttcaagcgattcttctgcctcaacctcctgagtagctgggattacagacgtgcttcacaatgctcagctaatttttgtatttttaatagaggtggggtttcaccatgttggtcaggctggtctcgaactcctgaccccatgatccacccaccttggcttctcaaagtgctaggattacaagacatgagccaccacgcccagcccaaattttctatttttatgtcctaaattgttgaagcaattcttctgatcgaaacaggcaagggttttatttttcttatgagtcactataggcacaaggcctagagcctataagctttacaaaaacctactgaagtatgtgagatatgaacaaaattattggctgtaatgtatgaacataaatccaagtgtgaaattaataaatgtttatccctgaaatggaagcttatgccaattttagtaattattacacttagaatttattattttaaaaaatatcaattgcaaaaaggttacacttttggtttttttacaactcaaaagaatttctaagtatgcagagagattgctaaaaaaatcagtcaatctataattaactcataggcaaataattgtaaatagattttgtaaatctctttcaaatttttacagcaaaaattttatttaatgtaggagggggatggggaggaagagagagtagcaggagagaacacactatgggtacagcccattgcttttaccttttccctccctttattatttgcctctgagatgtccaaagaaatctctggtcttaggaaaaaaagattttaaaaattactgcctgtggctgggcatggtggctcatggctgtaatccaagcactttgggaggctgaagtgggcagatcacctgaggtcaggaattcaagaccagcctgcccaacatggtgaaactccatctccactaaaaatacaaaaatcagctgggtgtggtggcacgtgcctgtaattccagctactcgggaggctgaagcaggagaattgcttgaatctgagaggcggaagttacggtgagctgagattgcaccactgcactacagcctgggggacaaagggagactctgtttaaaaaaaaaaaaaaatgctgcctgtgaggtcactctggactctgggtctagccactgtctgtttgtccagttaatgttttctattagctcaactttgttcgagattcttaatataactcaatactttccaaaaagctagcagatatttaatatgtatgtgtaatcgccttttctgcagaaaggagcgtgatttaagtgagctcatctaatagatcagtataaaataccagatgagttcactagagtgtgtgaagaactttgtgcatcccatttaagtgaatggttgtgtgctctgaaatgaagagacagcacataaacccccaaagttaataaactctaataaacaatgaatctggatgacaacttttcaaaatctattacacagtagtagccctggttttgcacagtttgcatattaaacagatgatagtagattctgggcagaaatatagacagtattatgtacttcaattcgtgccagaagagaaattttttgatagcacttattgtagccaagaacaaagcagctatacaatccccagccagaaaccaggtgccaaaattaattcatgcaagaataaaatgggttggcaccttatggtaaagtcataagctcttgaggaaatgcacaggaaagttctgggtagcttgagttactacgtctttatggttacttccattctgggctggctcattaactttgcaataagaaataccatggaatgatcagaaaatgttttcacccagccaggaaatctcacaaccacaggcaaaagtgccatgaagagagcagacatggttttcagtaatgtaagccctgcacatgatttggatatagcaggcttacttgtcacgtttgtaggagccacataacttggtaggttagcaaatcacactggatgacagaatcaggattcaaaaaggtctcaacagggagaactgttgagccgcaattcagaagattaaatttaatagggatgaatgtaaattcctgtatttgggttcaaaaaaggaagcaactgcttcctgccttactcccatccaatttattttccacgctgcagcctgggtgatcattttaaaacacaaatctgatcatgtcacttccttgctaaaaatcccttaacaacatcccattgccctgaggatgaagacagaactcattaatgtggtttttgagattctctatgactggccccttcctttctcttccgcctgttctctctccaggctccctctcacactgagcaccccagccaaatggaagatcttagggttcctcattttaggctgcttttaggttctcatgttttctttgcccgaaacacatcttcccaatttcctatacatttccagaaaagcccaatccatgggctactgttaggtgcctcattaccaactttcaaggttctctgaccagccttttatttaacaaatatgtattgagtgcctactacatttcagacatgttctaggctccagagataaaacagtgaacaaagtaaagctcatgtccacgtgaagcttatgttttcttggggaagatgccaggcagtaccaagtcttttgaagaaaaatggagaatgataagaagataatgatggacagtcagggttgggaggcctgctttacatagggtggcgatgggaggacctctctgataagatgacatttttggagataagatcaaaggaggtcagtgaactttgtggctatctgtgagaatagcaccacagtatggaaaagagcatgttccaaaaccttgaggaggggcatggtttgcgtgtcctaggacttgtggtgaggctggattgggtgaagtaccctgatccagggcagagctgtgcagatgatattggaggggctgctgcactcagcccaggcagggcttggaagctgtggaagcctttggattttcttctaaatgtggttggaagctaactgggaggctttaagcaaggggctattataataagatttttgttttggtttggttttagtttttaaataattacagtagctttgttgtggaaaatagaccatagggactaaatgcagagtcccacagattagtcaagagatgttacatctgtcaaggtgagagctggaggtagctttggccaggtaggtttgctagcacttactccactctttgtgattacttgtgtgttagaagccctgccagtgcagggctcaggactaccttgctccttttacaacctcagtgcctagcatggtgcccgatgtaccaccggctctccgtaaacattcatcggatggagatgatctggtttaacggcagttagtacgaaaaacgacttcaggatttttagctgactgcacacagttgatgagccagcagtagcccggttcagctgccaggaaagctaatgctgtcttaggtggcattaaaaactttggtgagggtgtcagtgaaagggagatgtgggtcctagggtgctccatgctgtttatgctacactggactgttggcctgatcctacactactttttcccttgtatcttctttctaataatggcatatttcaatcacgaggccacacactttggattcatctgtggttctttctgttgcttcattaccatgtacaaacaataaattctctatgatatcacctagcactgtctctctctctctgtctgtctgtctccgtctctgtcttatttttcccttttcccctgctctgacacaatgccaacagtagtccatgcctgtcttggtaaaagtttccaggtgcgtgagactctaaacaacttattataactcttatttctgagagtatcaacaattatttttaaaaacattatatgctggacacatagaggggaacaacacactctggggcctattggagggtggagggtaggaggagggagaggatcaggaaaaataactaatgggtactaggcttaatatttgggtgatgaaataatctgttcaacagacctctattacacaagtatacctaggtaacaaacctctacatgcgcctctgaacttaaaagttgaaaaaaaaatcccagtaattttctcatgaaaaatacccagaaagttaatgaactattagaccttccaatataaaaaaaaaaaaagaaacacatatgctgtttcatataggttggtatgaaattctactttagtagatagtgttaagtagtagaaatatgtagttctttatggcaaagtcattagcaaaatcttctcaaagtcacacagtagaaggaatttgtgctttgaagtcaggaacccttcagatccctgctgttccacgtacaaactttatgtcataacccttcttagcctaagttccctcctctgtgaaatgaagataataaaacccaactcaaagagtttttgtaaggattaaatgagataacacatattgaaatgcttaccatgatttctgacacatgctaaattggtaataagttttcatttccttcctatctgttaaaaaaggggtcactagacaatgtgaaaacatacattataaatagtggaaacagaggtgtgttttccatcagttaatagtgaataatggccgtttgccttaaggtagcctgtgccccttttattgatggtttaatgaatatcaatttcttgctgatagcagaaatatttgtcaaaggtctgagaatcatgaaagcttttacaatttgagtggtaaacatagtccatccctgacagattccagaaatgagcagagaatgaggtttcctaggagcaatcttgcacaaatagtcttttctctgtgtcaggtgggaaaaaaaaaagatggagcagagacttcatagtatcgttgtaaactgtaactgtttattttgtaaagatgagtaaaatgctatctttgccttcattgaggttgtccataaatcagtgtagtacagagtagaaagtggtacgtattcttggaggaaatgctaaagtgttctgaggcaggatcgggagcagagatggagagaatattctaggaagtacaggtcccagaaggagtaacagtgcagcatctaaacatgtgagatcagcggcattttcaacaagagataaacacaaatgagaaaaaaacaggaatcactctatgtgacttgaagatgaatagaggataatataatggaaaaggtaaaaagggtacaaatctgggatacaaagataaagagaatattattcataggcagtgaaatattagtgaaggtttggagtagcttagaaaaattatgaaagtgatgtttagcatggatgaatgttgatgtggtaaataagatgagtagtagagttacagagacagaggtgggtcaagagcaagttggaggcaattgcaaaaattcagccatggaataacaaaagccataggtccaggtatgagaattcttgaaaggaagacctgacggctgactggctgtgactgctgctcatgaagacagcatgtatgttgtcaggacaggagaataaccctgagcctagatatggtttcttttcagtctgcccactcagctgctttctttttatggtcctgtattcaaaaaaaccaaccaaccaaccaaccaaccaaataaaacttgcctgttctcagcaatgatttcataatatccttatgtaggaaagaagtaagtgatgagacctccaaaggatattgtcctcagccactgatcacattcttagcttagtgttcttccattatgtttccttttaattttgtagttatgtgataagtatatatttatggggtacatgagatgttttgatacaggtgtacaatgcatactaatcacatcagagtaaatggggtgtccatcacatcaagcatttatcctgtcattgtattacaaacaatccaattatactattttagtcattccggaggctgaggcaggagaaatggcatgaacccaggaggtggagcttacagtgagccaagatcacaccactgcactccagcctgggtgacagagtgagactccatctcaaaaaaaaaaaaagaaaataaatgggccaggcacggtggctcacacctgtaatcccagcactttgggaggctgaggcaggcggatcatgaggtcaggagattgagaccatcctggagaacatggttgaaaccccgtctctactaaaaatacaaaaaaattagccgggcatggtggcaggtgcctgtagtcccagctactcgggaggctgaggcaggagaatggtgtgagcccaggaggtggagcttgcagtgagcggagacagcaccactgcactccagcctgggccacagagcgagactccgtctcaaaaaaaaaaaaaaaaaagaaagaaagaaagaaaaagaaaaagaaaaaaaaagtacaataaattattgttgactgtagtcaccctgttatgctatcaaatactagatcttattctgactatatttttgtgcccattcatcattcccacttccccaccgccactccccagaagccccccgcccccaaccccccagcacacactagccttcccaacccctctggttatcatcattctattctctatctccatgacttcagttgttttaatttttagatcccacaaaaaaagtgagaacattcaaagtttgcctttctgtgcctggcttatttcatttaacataatgacctccagttccatccatttgttggaaaagatagaatctcattcttttttatggctgaatagtacctgatttttttttcttttctcataattttttattccatgggtcgaaagaaaaagaaagagataattatttttgccaacctggaactggccattcaagccaacatgcttgaaactttcttttatcttccataaccatatttttttcctattttttattatactttaagttctagggtacatgtagtacctgattatttatatgtacattttctttattcattcctctgttgatggacaattaggtagcttccaaatcttggctattgtgaatagtgctgcaataaacatgggagtgaagatatctctttgatatactgatttccttgcttttgggtatatacatagcagtaggattgctggatcatatgggagctctatattgagttttttaaggaacctccaaaccattttccataatagttgtactaatttacattcccaccaacagtgtttgagggttcccttttctccacatccttgccagcatttgttattgcctgtcttttggatgaaagccattttaactggggtgagatgacatctcactatagttttgacttgcatttctctgatgatcaatgatgttgagcaccttttactatacctgtttgccatttttatgtcttgagaaatatctgtgcagatattttgtccatttttaaaatcagatttttagatttttttcctctggagttgtttgagctctttatgtatactgtttaataatccattttcagatggtatattagtctgttctcactcacactgttttaaagaactacctgagactgggtaatttatgaagaaaagaagtttaattaactcatagttctgcaggctgtacaagaagcatgactgagtggcctcaagaaacttacaatcatggcagaaggcaaaggggaagcaagcacatctttacatgtcagaccaggataaagagagaaaaggggaaagtgccgcacacttttaaacaatcagatctcatgagagctcactaactatcatgagaacaaacagcaagggggaaatccacccccatgatcaaattacctcccaccaggtcctttccccaacatttggaattacaattaaacatgagatgtgggtggagacacagagacaaaccatatcagatgggtagtttgcaaatattttcacccattctgtggattgtctcttcactttgttcactgtttcttttgctgagaagcagctttttttgttttgttttatgagacgaattctcattctgtcacccaggctagagtgcaatggcacgatctcaagagtctcgttgtgtcacccaggccagagtgcagtggcacaatctctgctcactgcaagctccgcctcccgggttcacaccattctcctgcctcagcctcccgagtagctgggactacaggtgcctgccaccacgcccggctaattttttgtgtttttagtagagacgaggtttcatcgtgttagccaggatggtctcgatctcctgatcttgtgatccgcccgccttggcctcccaagttctgggatcacaggcatgagccaccacgcccggccaaaaaagctttttaatttgatgtgatcccatttgcccatgtttgcagttggttgcttgtacttgtggagtattactcaagaaatcgttgccgagtctaatgtcctggagcatttccctgatgttttcttgtagtagtttcatggtttggggttttatatgtaagtatttaatccatgtagatttgatttttttttatatggtgagagataagagtctagtttcattctcctgcatatgaatatccagttttcccagtaccgtttattgaagagactgttctttccccagtgtatgttcttggcttatttgtcaaaaataagttcattgtggatatatggatttctttctagtttctctgttctgtcccattaatctatgactctagttttatgccaggatcatgctgttctgattactttagctgtgtagtataatttgaagtcaggtaatgtgattcctctagttttgttcagtttgctcaggatggctttggctattctgggccttttgtgatatgacatagattttaggattgtctttttttctgtttctgtgaagaatagccaaagccattctttcttaattgatccactggtcattcaggagtgtattggttaatttccatgtgtttatatttagttttcaaaatttatgtctttactgatgtatagttttattacattgtagtcagagaatatactcgatataatttcagggttttttttttgcatattttaagacttgttttgtagtctaatgtgtggtctacccttcagaatgatctacgtgcttaggagaagaatgtgtattctgcagccattgtgggaaatgttctatgaacatctatttagtccatttggtctataatagtgagattaaatctgatgtttgttgatttttctgtctcgatgatctgtccaatgctgaaagtgaagtgttgaagtctccagccattattgtattgggatctctctgcctctttagctttagtaatatttgcttcatttatctgggtgttccagtgttggatgcatatacatttataattgctatatccttttgctgaattgagccctttatcattatatagtgaccttctttgtctcttttcataatttttgccctgaaatctattttgcctgatggaaatatacctactcctgctcttttttagtttccactgggatgggatatctttttttatctatttattttcaatctatgtctgtcttcttaggtgaagtgtatttcttataggcaacagattattgcatctttttttttaaatctattcagccactctgtgtctattgattagagaatgtagtccacttacaatcaattttgttattgataagtaaggtcttactcttgccattttgttatttgttttctggttgttttgtggtcttctcatccttctttcattccttcctatcttacttttagtgacagtgattttctctggtggtatgatttaatttctttctttttcttttttgtatatccgttgtatgtttttgatttgaggttaccatgaggcttccaaatactatcttataacccactattttaaactgatgacaacactgactgcataaagaaacaaactaataaacaggcaaaaagaagactaatgaaaattctgcactttaacttcatcctcctgctttttaacttttgattgtttctgtttatatcttattgtactgtgtatgtcttaaaaagttgttgtagttagtatttttgatcagtttatattttagtctttctgctcaaggtaagagtagtttacatggcacaattacaatgttttaatattctgtgtttttctatgtacttaacattactagtgagttttgtaccttcaaataatatctcattgttcatcaatgtccttttctttcagattgaagaactccctttagcatttcttgtaggacacatctggtgtagatgaaatccctcaggttttgtttgggaaaatctttatttctccttcacgtttgaaggatatttatgccagatatactattctagaataaaaagcgttctttttttccttcagcagtttaaatatatcctgtcactctctcatggcctgtagggtttccactgagaagtctgctgcaacacttactggagctccattgtttattatttgtttcttttctcttgctgcttttgggatcctttctgtatctttgacatttgaggatttgcttattacttgtcttgaggtagtcttatttggggtaaatttgcttggtgttctatatctttctcttggtttgggaaattatctgttacgatccctttgagtaaaaaaatttaccctttgggtaaatcccttttacccctgtctctctctctgcctcctctttaaggccaataactcttagatttgctcttttgaggctgttttctagatcttgtaggtgtgcttcattgtttttttattctttttattctctgactgtcttttcaaatagcctggcttcaagctcactgattctttcttttgcttgatcagttctgctgttaagagaatctcatgcattctacactatgtcaattacatttttcaactccagaatttctgtttgattctttttaattatttcagtctccttgttaaatttatctgataggagtctgaatgacttctctttgttaccttgaatttcactgagtttcctcaaaacagctattttgaattctgtatctgaaaggtcacttatgtctgtctctctgggtttgggtcacttgtgccttatttagttcgtttggtgaagtcatgttttcctggatggtcttgaggcttgtgattgtttatcattgtctcaacattgaagagttaggtatttattgtagtctttgcagtctgggcttgttgtacccatccttcttgggaaggttttaaatcggttcttggggtcatcaattccacgctttggctcttcaagggaattgagtgttgtgaccttaatcttcggcccctgcaaccataactgcattagggggcaccccaagcccagtaatgctgtgactcttacagacttgtagaggtgccatgttggtggtcttggataagatctgggagaattaattccctgaaattaccaggtagtgactctgctctcttcccttattttcccccaaacacataaagcctctctctgtgtgctgagccacctagaaccggtgtagggctgacacaagcaccctgtggccactacgactaccactggtactgtttggggtcagacctgaaggcagcacagcactgggtctctccctaggctcacagtaaccactgcctggctaccacctacatttgcttaggacactagagctccgcaataagcaggtggtaaagccacccaggcttgtgtccttcccttcaggacagcaaggtccccctggcctcgagtgagtccacagatgccgtccaggagccagggcctagagtcagaaaccttagatgtctacctggtgctccattttcttgagtctgagctggcaccaagccccacttttccctcttctttccacaagcagaggactctctccccacagccaccaccaccacgtccatggcaagtactgcctgtctaccactgatgctcattccaggtctaaggactcttcagtcagctcatggtgaatgctgccaggcctgggactctctcttcagggcagtgggctctcctctggcccagggcagatccagagatgctgtctaagagccaaagtgtggaattggtgatcccaagaacccgctttgtgctctataccactacggctgagctggtacctaaggtgcaagaccaagtccctctccttttctcaagcaggagaccctctccgtagccaccatagttgggaatgtgctgggccataccataagttagcatgtctctgagtctcacccaagacccatggcaagtactgcctggctactgctgctaattattcaggacccacattttctttagtcagcaagtgatgaatcctaccaggtctgggttctccccttcaaagctgcgagtttccttctggcagagtgtgtgtctggaaatgtcatccaggagctaaagcctagaatgggggccccaggactctgcccagtgccccctactgtggtagagctaggattcaagttgcaagatgaagtcctcttaactcttccctcttttctcctctagcagaaggcaggagtctctcctggagccgtgagctgcactgcctggggttgggggaggagtggtgcaagcactgcattagccgcccaacggctgtctcactaggttattaccccccaagtccacttactccaagcccagcacagcatcaagacttgcccagtaattgcagtccttagggcctagactacctttcaagtctgtttaggaccccagagcgctttagcctgcagtgccaaggcttggcagaactcaggttctgactgctgggatgggcaatttccctctggctagggctggtctgagtgctccctccatggactctggctgtgttctgcctggtgttgctttccaccatgacagggtggaaagcactgagttccagtgcaaagtctccaatcactatgctctccctccccaaggtgcacagattctgtctgtaccatgtgtcttcttcaggggagtggaggacgtgggagtggtggtgtcagcaaatcaagactgtctttcctatccccttcagtgcctttttcagtgatatgaagtaaaagtggttactgtgatcactcacctgatttttggttcttatgaaggggctttttcatgtgtctagtagttcaattcggtgtgcttgtggggaggattatcagtggaagcttctatttggctctcttactcctcattacgttttaagacttaagtggtcttagggccattggttgtatgatttagaaggctgtagttataagaataaagatgtttcatatgttaagtagattaactatttttttttttttttgagacaaggtctcactctgttgcccagtctggagtacagtggtgcaatcatggctcactgcagcctcgacctcctgggctcaagcagtcctcccaccttagcctcttgagtagctgggaccacaggcacataacaccatgcccaactaatttttgtattttttttttttttttgtagagatggggttttgccatgttgcccaggctggtgtcaaacttctggactcaagtgatccacctaccttggcctcccaaagtactggtattacagatgtgaaccactgcacccagccagattcactatttttaaacttatttctggaaaattaataccatactatgaagcttgatgtaaaattaatatcacagttttcagttattgagtctaagaaatggagctatgagtcagggaaagcaagggggttagagtgtacagagaaacataccagagaagagagatctgcatagcgtgaactccacgtatagttggagggttttccttaagtattgcacagagtattcatcagagcatgcatgtagggaactaccaaggctaggccaaaaggattcaagaagcagtacccagagcacactcaagagtgagaccaatgtttgttcccacccacaagattggagaaaatatctcataatccgtaggacattggataaggtatgcaagaggccattgcctctgttgtacagcacaatcagcatagagtaaatgctgctatagtcctgcctagcagatcataaaggcaagactcaagaggatcactctttccaagtaactatattccaatgacattttaaaaaattacaggaagggctaagcacagtggctcatgcctgtaattccaacatttggggaggcaaaggtgggaggattgcttgaggccgagagtttgagaccagcctgggcgatatagtgaaacccctacgcacacacacagagtgtaaatattagccaagcatagtggcacacactgtagtcctagctacttgggaggcttgaggccaggagttcaaggttgtagtaaactgtgattgtgccactgtactccaacttgggtagcagagccagatcttatctgtaaaaaagttttaaatacaaaaagtgtatttaaaattacaggaatatatatgacacaaaaaggtaaaatttctaatatctggaatccaataaaatattaatatgcatgtaaagaaataagacatataataaggaaaaaaattagttaaaaccagaactgacacagatgttagaattagcagacaaagacatttaaattattatagttgtatttaatacattcaaaagccaaaggaaaattgatcatattaagtatagctatggaagatataaaagaagacccaaatcaaatttctagaaaagaaaagtttaatatctgagatgtaaaatactctggatgagagtaacagcaaattagacattgcaggaaaccagacaagtgaatatgaatacacacagtagaaatatacaaactgaaaggaaaaagacacacagaattgaacagtgaattgtggggcaacttcaggtggtttcagatacatgtaattggattcaccaaatgagagaaaaacagggacagagaaaaaatatctgagaaaacaatggtcaacatgttttcgaatgtaatgaaatctggaaactcaaattcatgaatctcaaatgaacctctaagtacagacacaaaaaatgaggaaaccacaccaaggcacattataaacaatttgctgaaatcatggttaaagagaacatctaaaaaacaggacgacacatttcatacagagaaaaaaagaggaacagcagcagatttctcacaggaaaaatacaaaggtgtcatcgtgtaacagtatctttaaaatattgaaagaaaaatactattcaactagaattctttaactagcaaaaatatttttctaaaacaaagaattttccagaaatacaaaagttgaaagagtaaatcaccaacaggtacactatatgacatgttaaaggaaggctttctggtagaagaaaaatggtaccagataaaaatatggatctacataaatgaagataatcagaaattataattacttggatgaatgtgttttaaaattttccttatttaaatataaggttaattgtttaaacaaaaataatgacaatgtagaatggggtttttaagacatataaaaatatattatttttatatgacaataacagcacagaggctgtgaggggagacattgaaatacagatccctctctatttatgatggggttacgttccaataaacctatcattaagttgaaaatagtataagtaaaaaatgtgttgctaccaaacatcatagtttagcctagcctgccttacatgtgctcagaaaacttatattaccctacagttgggcaaaatcatctaacacaaagcctattttacaatatactgttgaaaatctaatgtaagttattagatactgtactgaaagtgacaacagaatggttatgtagttacttaaaatatgtttctacttaatgcatatgacattgcaaagccaaaaaatcatacactgaaccattttaagttgatgaactgtctgtaagtctatatactattgtaagatatacataataacaaaagaacactctaataataatacaaaaaatacccaaaagaggcagagtaggggaaagggaagaaagaacagataggacaacagcaagatggtatgttcaagatcaaccataacaatagtcacattaaatatatatgttagaccataaaaggcagaaatggtcaattggataaaaaaggcaagtcatggccagacatggtggctcatgcctgtaatcccagcactttgggaggctgaggcaggaggatcacttgagcccaggagttcaaggctacagtgagctgtgatcatggcattgctctccaatatgggcgccacagcaagtcccactttagagacacaagtaacttaaaagtaaaaggaaggaaaaagacataccctgctaacattaatgaagagactactagaatggtcacattgatatcagagaaagtagatttcagaaaaatattaccagaaatagagtcctttcatagctttaatggaaccaaatcatcaaaacaatgtaattattctaaatgcttatgcacctaataatagtgcttcaaaaaataagagaaaaatacatcaaacaacaggaaaaataggcaaatccaaagttatagtcaaagattttgacactatgtctcaataattaatagaacaagtataccaaaaaatcaataaggctatagaagatttgaacaatattatcaactatcttgacctaattaacgtttatagaacactctgcacaacaactgaatacacattttttttcaagagcacatagaacatttaacaggacataccgcattctggactattaaaaagtcttaaaagttttgaaagaattcaagtcatacaacatatattctgtcagcatagtaaaattaaattagaattcaatagcagaaagaaatctggaaaatctgcaaatacttggaaaataaattatatacttcttaataacacatggatcaaagaaggaagccagagagaaattagaaagtatttgaactacatgaaaataaaaacacttcctataaaaatgtgtgggataagaaaaattgtgagatgtcactaagaggataatttataacactgaacttagaaaaggaagaaagatttcaaataaatgacctcagctttcacttaaaaaaatggtaagagaggctgtgtgaaatggctcacacctgtaatcacagcaatttgggaggctgaggtgggcagatcatttgagcgtaggagtttgagaccagcctgggcaacatgactagaccccatctatactgaaaatacaaaaagttagtcgggcatggtggcatttgcctgtagtcctagctactcgggaggctgacgtgggagaatcacctgagcctgggaagtcgacgctgcagtgagctgagatcacaccactgcactccagcctggacaatgagaatgagaacctgtctaaaaagaaaacagaaaaagtagagtacagtagtctccaccccccttgtctacaggggatatgccccaggacccccagtggatgcctgaaactgagtatagttctgaaccccatagtgctgtagaggatagtactatacaccacaatggatctgataaccaaaatgcttactaagtgactaatacacaggtacatatacagtgcggctactgtgcacaaaggggatgattaatggtttgagtgcaatgaagcaagatggcacaagatttcatcacactactcagaacagtacacaatttaaaaagtgtgaattgtttatttcttgaattttccatttaatattttagactatgattgaccataggtaactgaaaccaaagacagcagaaccatggataaggggaggctttactgtaaattcaatccaaattaagcataagagaaataaaaattagagcagaaatcaatgcgttagaaaaaatttggtaaagtcatagaaaccaaatgccagttttcttataaagtcaataaaccattaaccagactgattagtataatataaaacaagacgtgtgaacattattaggtttgagagaggggacatcagtacagatttcacagatattcaaaggatgttaaggcaatattatgcacaataaatttgacaactaaaatgtaatggacaaagattttgaaagattcaaatgatcatattcatgcaagaagaaataaatagtgtggaaaccttgtagatattaaagaaactgaattatagctaaatactttctcacacaggaaactccaggtacaaatgacttcactggcaaatttgacttgtttcataaaaagaaataataacaattctacagacattcttccagataaataaagaggagtgaatatttccccaactcattctatgaagccaacattactctgataccaaaatcagacaaggacattagaaaaaaaaatttagattgatatccttcttgaattgatgtaaaaatttggcacacacacagatgaaagactgtgtgaagacacagggagaagacagccatctacgagccaaggagagatgccccaggagaaatcagcactgctcacaggttgatcttggacttctatcctccagaaatgtgagaaaataaatttgtccaagccaccctcaaaaataaaaactaataaaaatttagtgaattgaacccaacaatatataaaaaagataatatatcatgaccaagaagattttatcccaggaatacaatgtgactttaacatttgaaattgatcaatggacacatattaacagactaaaacagaaaaagcataaccatatgatcatatggtggacacatcacgttactgacatcactgatcagtcgcagtgacatcagtcacatcagtggacacagaaaaaatacttgatagaatctaatgtcatttaatgaaagttttatacacatttaaagagtactatttggggacaaatttgtcgtataaagaagtgcaagagaattataaagtacaacattcaggattgtggttacctctgagcaaagagggaaaggaatggcactgggttgaaacacccatagtgcttcaaagataaaataatatttttcttcaacacagtggttgatacacagtgtttgcttaaaccctttgtttgtttgtttgtttgtttgtttttgagacagagttttgcccttgtcgtccaggctagggtgcaatgacgcgatcactgctcattgcaacctccgcctcccaggttcaagcaattctcctgccttagcctcccaagtagctgggattacaggcctgtaccaccacgccaggctaatttttttatattttcagtagagacggggtttcaccatgttgaccaggctagtcttgaatgcctgacctcagatgatccacccgactcggcctcccaaagtgtaggtgggagccaccacactcagccagttgttatcctttataccttacacatattggtattttttcatgctttaatatttagtaaaagcaatttttaaagctagtatttctgttcttggcctttttctgaaattatcataccagaaagacatttatttcctgtatttacagctttggaaactcataacatttgcaggttgaaagaagagctgtttgtatgaagtattcagttttttttagaaatatagtgtgatttttctataaacagagggaactggtatttcaagtatactacgtgaagaacaagagtgtgattagagccaacaagccaaaaaatagagaggaatcactaccctagtggtcagttatatataaccgagagaaagacagcaaagtgagactagcctgctaatcatatatttttctacatttctaaagttcattactcaaaatacaagtgaattatatttattccaaacagttctgttacgttttggtctttatttagacctgtcccagaattggaccccaattaccttctcctacccttccttgctaggaacttgtctgaaaattctgccacaagaattttacagtgtttaaatacatttacactacaccattcctataattatatatatctcacaatgaacagttgtctcattcatgagtctagaatcctttgctgaatggacatgcccaaatttggtgtcatttatttattcttacacatgccgcattcactcagcagacattaatgagtacctgagcggtgctagacgtggtactaggctaaaatggaaaaacaagacaaatgccctgctgaaggtgtttaatgtgaaacagacccgtgcacaaataattgagatatttgcaattcagaagaaatagtatgtgttacttagattttgtacctaagtacaaagttgcatggcctacttaaaaaccttcttctatagccaggtgcagtggcaccggctgtcattccatctacttgggttgctgaggcaggaggatcacttgagtgcaggaatttgagtccagccagggcaacatagcaagatccctgtctctaaatttttttaataaataaaaatgtttaaatttgtataatgtaaaaatgtttaatgttgtgtagtaaggtaaaattctatttaaaaacaataataaaaaatatttctgggctgggtgcggtggcttacgcctgtaatcccagcactttgggaggctgaggcgggtgtatcacctgaggtcaggagttcgagaccagcttgaccaacatggtgaaaccccgtctttactaaaaatacaaaaattagctgggcctggtggcaggcgcttgtaatcccagatacttgggaggctgaggcaggagaatcacttaaacccaggaggcagaggttgcagtgagccaagatcgcaccattgcactacagcctgggcaacaaaagctaaaaaactccgtttcaaaaaaaaaaaaaaatatatatatatatatatatatatatatgtatgtgtgtatatatatatatatatatatatgtatgtgtatatatatatatgtatgtgcatatatatatatatatatctgatgtgctagagtacagaaaagctggcaaaagtggtgagatgtgaaaggctatcataatctatttgtgaacacctacttctgttaggtttcatgataaatttttacatcaagttgtctcatcctatgaggccttatctacattttacaaataagttcagtaagcttgaaaaaagactcagtaattaaatcatactcacagatgtaattagcatcagaatccagggccttttaaggtcaaagcttgggatcttcctttttattttcatgctactcccttccccaggagtaaaggtgttctaggtgctaaaaggcatttttgctcctcccagatcaattgatgcaaataattattcacctaaaacctttattgtctttatgaaccttcatgtctgtctgaccttccactcttcctgaagcatatctttttcttaatgaaactatttaacatattttattctaacaaatatgtcatttgtatctcctcattagaccatggggttgagtatctgattcttttaagaaaaacagtgtgtactgaatggattaaaacaaattaacaaatttatgaaggaattacttggattttccaatattctttaatgagctaaagatgacagtgtaagaacatatgaaaagtattggattttcgcaactttcaatttaagactttctaaggttcatagagaaagaaaaggaattttaaagagatcactgaagagttgtgaacatatggatagttggataacgatgaagggaataagccctccttttttaccctatgtcaccatggctgagagatgcattatgatattggaaaaaaatttcagctgctgagttctgattagctcactctcagagctgcagcacattcgagatggaacacagtgcttttgggaaagcttgctaagataaatgagataaatgtttgcaccattatactaattccctagcccccttttcagcaaaagccttgttttgtgtgtgtgggtgtgggtgtgtgtttgtgtgtgtgtgtgtttcaatagatggaagaattttttaacacatgaaaactcacattgctgaaaactcaaaaagtcttcctaagcagaatcattatgccaaattgtcattgacatacgaaaacactatagattaatgcagtaatagttcatggttgctcaggaagaaacttaatttacaatttgaaacaggtttgcattccttagaaattctggaaatcaatcagtggcacagaaattgatctgctaaaggagaggaaaattgatttttaatattggcaactacatcaatttttttaagttctgaaggaacaactcttgaaaacaaatttattaactgttaagggattacttgatatttagtttcctagcaaactatccaaagagaagtatttatggcctcattagaagatgtatttttattgtgccaaacatcaacttcaaaattgcagtctctattatttcaaagatatggaaatcaaaaattaaatgaaatggagttatctatataagactaccattgcatcatattttagagtggtactttgcctcaaagtatctcaatatgaatagtgagaatctgaacacatttgcatattccccattcgtgatatagtgttggcattctaaaaaagaataactgtagctgatggcaatttttatctgaagagacttgtgcatgatagcaatatacaatcttctgtcagcataagaagagcatctggggcccattaactcaccaaatctgccactgttctgcaaatttttattaagcaagtgtagtccctaatagtcacttatgttatagaatgcgtatcaaatgctatcaataagcaaggggattgttttcccccagtgagaatgcatttgaagtgtataagaaagcttgacaaaagaataaaacactttaagtgatcactatattaatataaatgtatcctactgggaagccaatgtgtgtaagtattatgtgcactttgatgtttgccactaactagttctcagagtgccatctttttcatagattttttcccctgtattttctttctctcaattctaatgatgaactggttgaaattaagtgaaaagacacagactgtttatttatgctttttaaaaagatgccattgatgctgggcagttctaattagcttcaaaggcttacaaccatgagaattagaaacataggccatcaggctgctgtttctcaaacaagtcttcctgaatcagagaacacaccaggaaattaacaagcatccaagccaaagagtgtcctctttattaagcaccttatgataattaggtaaaataatgtacatcaatcttgaattgaatatgaggaagcatgaggttagtctagaaatcctattatctaaataaatcggaagaaagatcaagaggaggcagtccatggtactctctaagtatgtaataatggttataataaaataacagttataaaaatatttatgaattgcagcttcagaaacctgagcatttcattggtatctcttcaattattgtaatatccatttacgataatcaagagcaagtagtaccagtccttgggtaaaactgaaggataagaaagggaatgaaataacctttaaatacaaatacttttttaaaaaagaaagaagaaagaaaaggagaaaaaattctgtcatcagaacgagaacaagaaacttagactcttgctccatcaacactctcttactcaatgcttttaattaatactttactgttttggaatcaaagacctttcccacaccaggcccatttatttttcaatctcttgtaaataagtcctttgtttaaaatgacacacctgtcacatttcatatcactaccattccaatcactgtgctaaatattatgcagtgaaactactagacgtaagcttaagccccaagagataattttaatagtagctctaagttaatgtgagttataaaggaagttggtattaattataacacttgccatttaaaaaaaaacttggtggcatgtgtaattttacctcattttctcatttgctactgttatttaaattacttcccagcactaagcatgtgtataaaagatgattgttccaaatttaaccttttaaataaaatgtattctatcaattaagtcattatagttccctctcttttccattatgtttattcatttatcttctgtcctaaagatagacatctgtgtcagtgaatatttcagagaaaggcctctaatttttatgcctatcacccatttggattttctacaatgtttttcaaatagtttatattagtgtttgatataatttcaaattgtcaattaaaataatgataagtataagaaataataaatattattcagccaaaaagttaagaagataatttgttaagcctaatatggccagggaatttgcaagtacttaaatcagcttagattttttaaaaaagataaaaacaaagcagcaaaagccttacctttgtatgaatcccttcttctgaatgactatacataataaaaccgtacagtctagtgtactttcattgcctttcttccactgcaggatgatttaggagccaggtaaattgctaggtcgtatcttttgtggttgtggaatgatccatacaataacaatgtaaaagtacctagtgcccggctgaagcatagtatgttctcaattattttctctctttagttctttataatcctgagcaaattaaatcacgtaccccacaaccgtcatcaaatacaccacctttaccactctcacaacttccatttatcaaatgttttcatttattgagaattatgtgtctggaactgtgcaaagtgcttttgtacattttttttcatttagttccaactctctgtgtactgttttttcccccatttctcatatggagaaactaaagctaaaaagaacttagtggccgggcgcagtggttcacgcctgtaatcccagcgctttgggaggccaaagcaggcggatcacctgaggtcaggagttcgagaccagcctgaccaacatggagaaaccccgtctctactaaaaatacaaaattagcagggcatggtggcacatgcctgtaatcccagctactcaggaggctgaggcagaagaattggttgaactcgggaagtggaggttgcagtgagacgagatcgtgccattgcactttagcctgggcaacaagagcgaaactccgtctcaaaaaaaaaaaaggagcttagtaacttgcctggtaatgctggcattcaacccacatctgtctgattactagctatgatgttagtctctctttctattttgtttctcattaatgatgatgacagtagttcatatttattaagtacttattctgttgtcttctaagtaccttgcatatatttgcacatgtaatcatcaccacaaacctgtggggtaagcaatatcctcttatgatgagactgaggccacagaaagttaaaatgatttgcacaaaactgttgtttccaaacaaggattccaattcagaaagattatttctcatctgtagaatgagaatggatattttagcttgaacccatcagaatcatcaatttcaaaacatgttaaacaaaattatagctaacatttagtaagcttggtcaccacagaaagataactattaatagcatatattcaaataaagagagtagttttccagcatatagttagttgcgttgtcttatattccaggtttctcaggtaatgactcttctgtgactcttatcacaagtgtaatggagtggttaagagtgccatatttaagttcaggcttctccatttatgaggtgtatgtcagtttctttatctgtaatataaggatagtaataataatactttccaggtcgttgtgagaatcgaatgaatgaatagatacaaagtgcatagcataaaacctgtgtattacaagtactcagaaaatatgagttcctatggttatttttaatcattatcattgttttctaatgcttttctacttacagtgtagattgattctatgtaagtgctttttaggcctgagaaaaacagaatttggctcacaactggtgccttataaatacttacctcccaactagaaataaaacaaaaagtctaacaatatttttaagcagttgggaacagaataatcacagatatgtagtgcttttatctagaaaataaagaaatagcttagaaaaggagggctaggtgggagtgggaagattatgtatagtaactgggtcaattaagactgaatgttgtgggcagagaaaaaaagggacatgttactctgagatcaatctagtgttaggcgaaatggaagagattcttcttgttagcaaatttcccctcgccttgcttcaacccttgagaccacagttttgtgtactaacatagacagtggcacatggtaataaacagcttttgttgaatattaaagtgatgatctatgcagagatgcttaaggattaagaactttgcatctgtgttcatgaaggatgtgggttagcagttttcatatcatgtatttttctgatattagttagtatctgggtaacactagcctcatagagtggcttgggaaatcctctctctttctaatacattttctgtagaattggtcttatttatttcttaaatgtttggtagaattcaccagtgaagccatctgggcctagagttttgtttgtgggaaagttttacttataaacacattttttttttcaaaaaactactatagggcgacccatgttatctaattcttcctatatgagcttcagtaattgtgtcttttaaaaacgaatccgtttcatcagagctccattaatctagagttagtttttccccgctgttgaggcaagacccttcttcacattcaaatggatgcccttcagttatgaagttttctactctggctgttggaaataggcactattcccagccctgtgtgaacttcggatgctgttcctcttccagtttggaatggttctttgccaactcttgggttaattttcttacacacatatgatcatcagtattcaactacatatatgaggagatttttctgaagatagtattgctctttcctctctggttctctgctctgcaacctctgtctgctttggcttcctgggatgcccagcaccatgccctcaagctggggccatcactgttctgcttgggtgttggctttcccgcacggctgcctggaggctttcttcagagaataagctggggcaattgtaaagttcacgtcatttgttttccatctcttgggatcactgcattttgttgcctaatgtctaatctgttgaatgccattgtttcttgttttgtctagtttttaaaattgtttcaaggggaattacaaatctgttcccttttactctattttgactagataacagaagtctaattcttaagtatttaatatacacacagacacacacacgtattgctgttatgctgaaagaattttattatattgtatacatccctgggtctatgaatttggtttctcctcttgtaaatgtggaagaaacaacccagttaaaataactgaaagtattgaaaattatgagaaaatgaagttatgttcataaaagatctaataaacatatatttattcatagctgtcttcaagatatctaccaataaaagtgaggtatcccagggtaggctgggagaaaaaaatgtttctcaaatctctgccagtaaaagatttaacttattatgaatctgcattaatttactgtttaaaaattgtctgatttacaagccggtctgatccttgtctcttttatttcttctcctcagtgccagatgaaagcaaggttcactcattggctggacaaaaatcgggtaagaaattccttgtaactgactatattcctcttcctggaaatcactggctgtgttttagtagcagttggaacctgtttctatccactagtcactgaaaggctttctaattaatacatgagatgtctctgacttccacaaagatgacttattgcttggctgtgtgtatagtggcataatgtatgctgactcagaatgtttgggaggaaagaataaagatttccaaaaagatatataaaaccaaaaatcttaaatctgtactctagctaaacacttaaaaaaattgcaagaaaacccaagaaagttcaagattctttcccatgatgactttcatatttaagtggcgggacagagaattccagaataagaaagatacgatcatttttttctcctcaaaaaagaataggattttttttcttttttttttttctgcctgtcatcaaaatggattgttccagggatgtatgcattatttttatttagagacatgaatgagctccctagatattctctaggaagtccacaaaaatttctaaggatctcttaggtctttatcatgtgtgagttaccttcactcctaaaatccaagctgttttttcattgccaagtcgactgccttctattcctttttccttcctccatcatcatttattcacattagttgaaaacatttaaagctactaagctagcaaatagtggagtaatccctttcctctaggggcacattgttttggaggagaaaatgtccattttgctcatagcattgcccctctaaacaacagaaggattatgattttctgacatccctccattggtgaaacaaagaagtctttcccatcaccaagtgtctcccgtgtttgtgtgccaattatgttttcagcagtaagtggccttgatgcctcattacctccatcatgttccagggcaagattatgatttttttcctttcttctttctccagattctcttgtgataacagcagggaagggctggttcacaactcttagatttttttttcttgcttttcctaataaaaagcctaagaagttagatcactgtgaaagagatttctatgggagtgataaattgccacatgctccttgctcccaacatcctcttccattaaattctctactactggacatatttttaggagcttcagaaggaagttctcatgaccagggaaccccaaggataatctataatatcttcatcttaaatacattctactgcttatagttctcttatacatattgttataatacctgaagatgaaaagccttttcttagtactgggataggcttcaaggcaaaaagttgaagtccttttctggaatttttatcaatttggtttttgaaaatgagcaaataataaattttctggctttttccaggaaatcaaatcttattctaaccttaatttccaagcacactactattaggtggcaattaaaagtttgtcactctttttagatgagaactttgtcatctttgtatattgccataacattttatgtaaatttcaatgatctgtctttacatagtatgatataaaatattaataaagaattatgctaagtgcaaaatttgaaataataatcttccaaaaaagttttagtcaaaaatggcagaattttaaagctgtcacacaggttcattgcaaattccatacagcaacttcactttagctgatagaaatagttccaacagtctttatgtcacatgaaccacactgtttaaatacttctgatgttttaaagaatatttctgttactaattagtactgttattccaacatgcactatttttatatttttaagtgctattataacgttattactacttcacgtttttcattgggcatctgtagaaatgctgaaaaataaccagccacttgataactttggagcaaaagtggcctgcaatgaagagggctaaacaatcaccaaaaaccatatactgtagagtcacattaaatgagagcatcttgtaaaacactagaaacggttctgagaaagcacagagcagcattagaggaacatactcaaataaggttcaaaatttatgtactctaagaacatacccttccccattttttgttttttgttttttgtttttgtttttgagacagaatctctctctgtcacccaggctggagtgcaatgccatgatcacagctcactgcagcctcaacttccctggctcaggtgatccttccacctcagcctcccggatagctgggactacatgtgcatgccaccatgcccagctaacttttatttttatttttattttttttgtagaaatgggattttgccttgttgcccaggttagcgtcaaactcttctgggctcaagcaatccacctgccttagcttcctaaagtgctgggattacaggtatgaaccacagagcctggccactcccccaattttttacatttctttcttttggaaaattagtcttgaattataatgatcctcaggaactcacccctcacataaaacatagctcccctctgtgcgttgcatttacgtgaagggatatctcattgggatttggtggtggtggtggtggtggtggtggtggtggtggcggcagcagcagcagcagagggttaagggttctcttgattctaacaacctctttcagttacaaaatcattttttaaattcatttaaattcacctgtagtctcagtcggctacaggtcatctgtgaccactaagcaagttaccaggttgtattttaacttataaatctctacttgtctcaccattctttttttttttttttttttttttttgagacggagtggctctgtccgccaggctggagtgcagtggcgcgatctaggctcactgcaagctccgcctcccgggttcacgccatttctcctgcctcagcctcccgagtagctgggaccacaggcgcccactaccgcgcctggctaattttttgtattttcagtagagacaaggtttcaccatgttagccaggatggtttcgatctcctgaccttgtgatccgcccgcctcggcctcccaaagtgctgggattacaggcgtgagccaccgcgcccagcctgtctcaccattcttaaaaggaatcagttaacttctttttgttgtgatattgtccccttttccaaattctttcttcagaatatttaggttaaaataagagtttttttttttttttttttttgagacagattctccctgtgtcacccaggctggagtgtagtggcacgatctctgctcactgcaacctctgcctcccagattcaagcaattctcctgcctcagcctcctgagtagctgggattacaggcatgtgtgtggtgcccggctaatttttttttttttttgtattttttttttatgctaagagtctctcgctctttctctttaactatagaaatgtgagcagcttttatactatccaagaccaacaggaagttaaacaaattaaattgtatatactgacctaaatctatcatccagcctcttattcaagatgacattcaacattttaataaattcatctgagttaaaatttcttgagtcagctacttagtctgtaaagagctatttcgtgccaagttccatctgttggtctggcttgggtacctcccaaatttgtgacaatatttttggtacccttttcttggcttaatttttaaatggttgatccttcggagctcagatccaatcaaaggcccaggtaaaataaatctttataatatttttgacccaaaaatgtagtgttcccctcaccccttctggaattagtccagtattcttgagatttctctaacccctatttcaggggcttccccaaaagggcattgtatctcattaccttggcaaggaagatagcaggatgattctcctgtttctgagttggtagaatcctcctccaaatatgagagacatttaagtctatggtatggtgagacctgcccggagaagttagaaataaaataccctttgtttggttccttgaagaaaaatcacaagtttcatagagccttgaaaaaccaaaaacgtctttaacctctttccttgtttcactaattgaactctgacaaaattcaaattctagcaatgcctggagaaaaaaaaaaaacagaaaaatgtattttttaacagtaaaaccatttttaaatgatttaaatattctgagggaacattaggatccagagaaaatgacatcaaatttagcacagctttttttttattgttatgctttaattttgcttatactcagggtcttaaagtgtgtctttaagaaggaattctttcttattttctttctgtctactaaaatgacacttcaaccaatagtttaatgctcctttatgttcagacagaaagggcttataaattttactttttttagtgtcttcttttttttttgttttgatttactgcttggaactgttttaatatgtattgactgtctgcagagatctttgctgacccagctctttaagatgatgcagtactgaagaaggccgatgagttcttctttatgagctctgacatattaattagcaaaatggactaaaaagcttggctattcctgttttaatttcttatattctcaaacacctgtccatatagctgtaaaacaggcaagtgtgtgaaagtaatggttggcagcaagtccagaccttttctgagacaactttatcaattaatgagcaagtactcattaacaatctagggagctatttctatgtgaggccactaagtatgtttggtatcctaacacagtttgatgaaaaaactgaagctcaggtaatttaaatacttgatctcagctgggcatggtggctcacacctgtaatcccagcactttgggaggccaaggcaggtggatcatttgagatcaggagtttgagaccagcctggacaacatagtgaaaccccgtctctactaaaaatacaaaaattagctgggcatggtggcccatgcctgtaatcccagctacttggaagcctgaggcaagagaatcgcttgaacccacaaggtggaggttgcagtgagccaagatcacaccactgtgccccagcctgggcaacagagcaagactccatctcaaaaaaataaaaaataaaaaaataaaaaacttgacctctcagctggtaactagtttggggtaaggatatgaaccccagcattgtatggtggagcttatgctttggggcaatttatatttcactagcacatgccttatgaaagacacagcccctacatgacacacacacatatcaagctatctgatacatctttacttgcgttgtgtaacctcagccagctgaactaggaacacaatagctttaatttatctaccaaactactgtagttccttgagtatgagagggacatctaatctgatcgttcttgcctttgtttccttacatgtatgtgtgcatgtgtacatgtacaggagtgtgtgggccaagttaagagctgtatgagagagaagatgtgcatgtgacgtgtataaattataccaaaggcacacgtgcaggtgttgtgtatccttataacaaaggccaagagtttagtatgcaagttactacttcagcaggccttacattttgttctaaatgcaatgtgtataaacctcaaatccagagtgttcaaatgtgacctaagaaatttctagatccttgcaaaagaacagagcttttaaaaccatagggtgattggatagtcactttaattcaagagcaatgagttattaaatgacatttcataaattgtgttgagtcttattattccatacttttatagaatattaaaatttgaatgtgcatttacactttggaacaccagttatggccatttaaaaaatatttgcatcttctaattggattgcaaattttcatgaatttttatggttattattgatgaggagctaaaattttcaagttaatggttagtgtacttgaactcttttctttcctcatcgactcattaagatatgacagcatggttctctatttggacaaacatctttattggatgctttctaagcttttgtcatttgttttgttggataaatatagcattagacacaagaaatatatacatttctcacatgctgcagccttggtttatatttccatgggattcaggaagttgtcataaagaagttagcaatatgtctagcgttcttcctatacaaagttgattgtgaagcaactctagtatttccacatttgcaaaaaaaattactgaataatgtggtctgtaaaattcaatgaattaaactgaattagaaacaaatatatcagtcttttccataaaattctttactcctcaaatatggagcaggtgtatgcatctctaaaattcatgagtaaataaagagacaacatatgtttccaaatcaagtttcaaaataaattattttagttccactcatgtttattaaatgcccactctacacagatattgtgttaagtgctagagatacaaagtaaaataagacaagttctcagccttataaaatgtttataatatggtagaggagaaaaaatacaaatgcctaattcagtatttgtttgacaccctcatgctaaagagttcaatgcaaaaacctcacagaggaaatattgcttaattccatttggaattggggatggctgtcacgtttcagaaaggatatgcttccatagcaggatctgaaagcaaaatagaaactggcgatacagaaaaggtcaatgagccaacacatttcaggcttctggaaagttctgagaacatgaaacatcatggtatatttaagaaattttaagcagttcagtgtggcagcagtacaaagagaaagtgacaagataccaagttaagccaagtaggcagagattagaccatacagactcacaccaaatgaaaaagtaccattttatcctgtaggctcagataatctaaacagattaaataagaggtcacttttatattctagtaatatcaatcttttggttgtaggaacctgaagggaccccccccccccaccaaaaaaaaaaaaaaaggagagagagactaatagtccatataagagatgatgttggcctaagtgtcagtgattagcaatggaaggggaaagaaaagtaagaaatatttaggcaagaaagctttgagtattttttttaagttaaacttaatgggtaagtaaaaaagggtatccaacttgattttcattgtacttgtcagctattgctgcaactatgctgcataataaaaccaacagtaaacatttatttcttgatcacatatctccaggtatactggaatttgctggtatctccagtgtttgggtttagctccaacttacaggttaggaccagcttttctgcaggtgttgaccagcaatttcctgcggcatttacttcttgataacaagagtgagaagatagagacagggtagatagacacttaagagtaaaatgtattaacacaaaggctctggccgcccccctacaaaggaggccatggaaccgatggaactgatggaggaaatgctgggactgtgggtcagtgctgacacacccatggccatacgtttggtcttcttggccttggctgggctggtggatgggaagccagtatggatcaccttgtggatggatgcaaagagaccaaacttggcgggcactggaagtacctggggaagcaggagagactcacactgctgtcatggccccacagcctggagcctcccctgcctcctctgcctcttcagagcccagcagaaagacagagaaagaagcctccttggggttccattacccacactccaaggtggaaatctttcagatggttagatgatgaaggtagtagaaggcaaggatgattgggagtagaaggaagagtgacaggctagcatgagctgtgcagcagcaagattccatatgagcaaagtgcagaaagtgagaaaaaaggaccaagttggatctcctcctaaccctgacctgcatgatatgggtgtgagaagcttcaattgagaaagctgctgagaaagtagaattcatagtggagaactgcatttcaattaagaaaacaaaaacaaaaacaccacagaggtggtttgaaagaagaggttgggttgaaaatgaacagtattttgtcaaccatggaaggatagttggactcaagaaggcaaggtagaagagtctaggatagaggggagaagtaggacagcaagtcacgttggaagacacacagagtggtatcattagttgtagagaaattaaaaaaaaaaaaaaaaaaaaaaaaagctgagatgctctgattctagtgaccaagggagattataagctacctacttgcaagacctttcattttaaacatctttggaaaatctagtctgccaggattcaccaaatggctgtctagccattctagcaatgttttaaatcttaagttttttcagctaaatcgtagccgacacctcatattggaagtacacattaaatactcaacctggaaaatctgaaggtgagctcttacataatggacctcccagtctatgttgaataatgtatgtcaagctgaaattttatttctaaaatctgataaagttataatattgccagctaatgttgagaaatattttaggatgtattggttttcctaatattgctattacttcatgtaagatgaagggtgtttaggtgtacgagtttcaaacatgaatactgtttattggaggtaagaggaagccttaaaagacatatatttcaggaatagtattgcctccttacaaagcactcttttgttcctacattgaggctccagtaatgtgatgaatttcagtattttattttattttattttttttttttgagatggagtctcgctctgtcgcccagactggagtgcagtggcgcgatctcggctcactgcaggctccgccccccggggttcacgccattctcctgcctcagcctcccgagtagctgggactacaggcgcccgccacctcgcccggctaattttttgtatttttagtagagacggggtttcaccatgttggtcaggatggtctcgatctcctgacctcgtgatccgcccgcctcggcctcccaaagtgctgggattacaggtgtgagccaccgcgcccggccgaagttcagtattattaaccagttatacgaatgcttccatcaccttgtcatgacctgcccttccagccttgccttttgccaccatcaccctccatctacaggttcccaactcccagctagtcacagttactctctgaccatattttgcccttttatgcctcggagccccagctgaactcttgaagacgcacctcccagggaaaccttcccctgctttctcaggcaggctctctcttggtgcccaggattgtttaacttcaagtgtctctaggttctattctttcacactttcttgcctcaactcacacttctgctccagagccagtcagttcctgtaagagatagggagaaaaacagtttttttctattctcacacatacaacacagaatactaagcacagcacagaatgcttcaattctggtcaccaaaatgtgtatggtttttccccacacacactgaccagttctccagtggacagcaactcggtgtcctataattcaattcaattctgacactatctacctggcgatagagtcagaatccacagattaagctcttagttccacaagcctgtcccattcagaagccagtcccacgtcctaagttgtgacttgggcctctgaccaacgagctgtaattcacagttcccatgactctcctcaggttcaattaatattctagagtagctcacagaactcaggcaaatgacttacttaggcttactcatttattataaagaacattgcaaaggatacacatgaagggctggatggaagagatgaatagaacaaggttgtgggaaggttctaggagcttccatgcactctctccaggcatctccgtgtgttcagcaatctaggagctttccaaaccctgtgctcttgggctattatggaggcttccgtaagtaggtaggattgattacattattggccattggttagcaactgaactttcagctctttttctctctctccggcttagagggtgggactgaaaattccaaccctctagtcacttggttgattcccttggcaggcagccccaaatcctgaggctattcaagagctcttgttcatcagtcatcttattaacgttcaaagatacatcactttggagattccaagggttttaggagctgagtgtcaggaaatgagaggaaaaccaaatatatattttatattacatatcacagcctcaaagatccctctcaggatgttttttttaaaaaaatctcctttgatcaatagtcatggctcccttatattattaatattccccaaatccagctttttttcatacaggaaggaaaactcttatctattgcatagagtggggcaaccaatgataaactcatttagtaagctagtatttattgaacatgtaccgtataccaggctctttgccaactgctacaaatacaaagtggtatagaatatggattctgcccctaaggttctcacagtttagtagcaacaataggaatgcaaacagtgacaataccatgtgcttatgtataaatgcaaatgcacagaaaaagtaacagtggttatctttattgaagaggaagattatggttgggggtcaaagggaccttctgctttatctgtagtatttgagttttacattcagactatatttaatgtactatttaggtaacaaataatttatggattaaaaaataacatttttaaacttaaaccatcacatacaaaacctagtaatagaaatattgtacaaatggaaagatctagcatggggactggcaaagattatgggcagaagaaccacaggaaaagggagcttctagtttctgggaaggagatgaaaggctgaatcccggagtcatactggaaacctatttgggaacctatttgcagcacagaagtattttggaagaaaagagaatagagaaaggcttaaccatgagacctgtcatttatgggttgctggaaaagaaaaaagccataaggaaaatcataattagggaatattaaacccccttgtcaatttttggtatcctagagggcaaaaacttagtcctagtaatttatttaataaggtacccatgcaatgccatgtacaaaaagtccttttttagaggcccatgatgcccaactgtatccaataaaaacagacttataattagggggttaatgaagaatgtgtgaaatgaaagagaaaacttaaaggaacctagattacttctccttgctaaaataagcaatgcagaatcattcccactctactgataattagaaaccgcatacccctacgaaacagcttacaaatttcaccccatcaaaagagaacaaagccattcaaagttaccttttgaatgaaaacacttttattagccaatcagttttttttttaaaccaagcaaaccaaaccacaactgcaaaagaaaaaaaaaaagacagtttggttttagttttgtaaaatatcatggcatgccctcagtgagctgtgagagatatttagaaatactggcatcaaactggtgacagagacattttactgctgcactaacaggcctcacagaaatactactgtaggttgatttagtagtctggtggcccataccctattttaaatggtttatatgggcaaacattctttattttgaaaaattatatatttaaattaatgtacattagtaaaagactgatttttcacttacagcgctgctacatgtttttcgcaaataaaatttttgttcaaaaactgagttatttttaaggaaataagaatataaaatgctatatgaaaatggcagaatattataaaatggtaacactaattgttgaggtttgaaaagcactgattaattctgtaagcttctatcagcatttccatagtttctgtcatgcttctttacaaagttcagggaatcttagtttgagcaaagagtctctacccagaccttcaggatacattaacaatgacctacaccctgggtgccttttcctgtccgtagtcaaatgccttcatttctggttgaacactggcttcttcagtgcaagaaatgtgcaaagcttcaccttttacttactataaacttctctcaataaactctaacttgagttatattttcaaatatagtcccccagcaggccatttcattggagagagaaacataacagatgcaatggtacacttccatgtgggcctggaaagccttaccagatgcagtcagctttgactttttcctctcttaagccctgacatttaccagcaggaaatcaggttgatcccacaagaatacatcccaaagcctcactttccaccctttcccgagccaccgtcacctggagagcttcagtgaggaaaactctcctcaggcctttgcacatgcattcgattagcccagagtgatcttccactctatacggctgattcactctgattcaattctcaggtcaaatgttctttcttcaaagacaatttctgtgaccaccctatctaaaatagtcacccaacaagaagccagtttctctcaccttactgtttacctccttatagagctaatcacagtctgtagtaaatgtgtgtgcatttattgatgtatgtaacctactgtctgtttcccctacctccagaagtgagcttcatgaaggcagagactttgtatccccagttccaaaagcagtgtgtggcacacggcaggcatcctttacgtagtacttgctaaatcttttttcttgatacgtctttttgcatatttttgctctcaaactttgtgtccttaagctttatgtgtatgtcttgtcctaataaatagctggattttgttttgatgttcaatgtgacaacctgaattgtaactggggtttaacacatttacatttattgcaattactagcatatttagatttatgttttattttcagttttaaatttggactactttttaatgaccttttttccctctcttgtcattttaggctgaattgctttttaatcccatttttttctgatagtgatttgaaaattatacactgcatttttggcatgcatacctaacaaaatctaaaattagtctgtatctaatccttctcccaaacaatacaaggaactgagaaccctttagctttccttacctgcttccaatttttatatgatttccattttgttttctttcttattttttggtcccgcaaattatatattaatttcagtgttttatgcattcaatatttgttcagacttctccaagtatttaccaatttcttaactcaccatttttctttgaatctctgaccttccctcttgggtctttttccttcttctgaagtatgccttccagacattctttaatgctagtctaatgatgacactgttttgtttattagaacatgtattttccttggcaactagtttttgttgggtatataaagttagacttatagcacattggagatcttcttctattgtcttatggcttctgctctgaaaagtcagccatcagtctaattggcttctctttacctttgataagtcttttatctctggttactcttaaattctctttgtccttgacgttcactttcactacagtctaggttttggtgtagatttctttatattatccttcttggtatgtggtatgactcccatggctttatatcaatgttttttatcacttctgggatattatggctgttactatgcctcttgctcattctgtctcctctttgtggaattcttactatttagtaaaatgatttttaggccatactctctcaactgtatgtgttaaatcctttttgatatttttctgtcttcttgactctgcactccattctgagtacaagtcgagtatctcttatctaaaatgctggagaccagaaatgcttcggatttcaaatttttctggattttggaatatttgcatatacataatgagatattttggggatgggacccaagtctagacataaaattcatttacatttcatatacatgttgtacacataggctgaagataattttatataatatttttactaatttgtgcataaaacaaagtttgtgtacattgaaccactagaaagcaaaggtgtcactatctcagccacccatgtggtcagtctgtggttgtttggcaccaccatcattcccaactctgaatttatatgctaccattaggtagtcattttttatacttacacacatgagtagttaatgacaaaaaataggaataccattaatacagtaaaaaataatgtgttcaggtaaaaaagcagcacagtggcatcaccagaatacctatgtcagctgctcagcaacagcaacaacaaacagtggcatatgaggtcctatgtggaactttccacttatagcatcatgtcagtgctcaaaaagttctggatttaggagtatttcagattttggattgttggaatagggatgtacaacctggactaatttctccagacctatcttctagctccagtttagtgtctaaatctcacatctctgctgactctcattcatggtgactttttctttataagtttggtaatttccatttgggaggtcatatttggttggctttaatgtatgagaatcttggggagcctgatttgcatgtgcttttcttcagagaggatttagatttgtttcttctggagtactggcaggacactgctaacctgggatcactttcatataatttcttggctgacagtttaattgattgggagaaaataaacttgatttaatacctctaagaggtcagtattatggttgcaagttctcaaaggaatatggtgattttttttaattgttgtttttcctatctagagccagagatgagacagattttcttagactggctttgcttaaggaaatgtatcagggggatgaggcttttcagcccagtcttctactaaagttgtaggccccttgagggtcactgctttaactctcctgcttttgactttgactcccagatcctccaagataccaccattgtgtcccctcccaagctccaggttcctagattcagcatttacctaaaaggcaatctcaaattgcaagtttgcttgcctaccatcactcactgttggttttttcacttgtttttttgtttgttgaagggctttcctttaggatttcctttaatttcctatgaacaaatcaacccatttaaatgtgcatttttaatctatccaagatctatttgtggcatgtgaggtcatgtgcagagttttattcatattttgagaattgatatattattggaagcagaagtctagagtctaataattgtttgttaaatgaatgaatgaatgaatgaatattctttgtaaaagactgaattcaaataaaccattgggtttaatgcagatttaactctcctacatttcactttgactcccacatcctccaagataccaccattgtgtctttgcagaatgagtgaatgaatgaatgaatgattattctttataaaggactgaagtcaaataaaccattgtgtttaatgcagattagagcacacatgaagccagacatggttttatttcactggatctcttttgacaagacaatccaatataaaatgccccttagaaatatatggaaagccatgtgacataagaacaaagtgggaaatgatggtcataatatgctgagaaagtctgaaatggaaaattcctttcaataagaaaccacataataaaaagttctcgttatatttgtagttacaagctatggtttattactctgtctagagattcttgtaatgattcattgttattggaagaaataaaatagggttcacaaaggagcttttatcagattataatgtgccctatcataaagtggggaaaaagaggcttatctggctatttgtagtccttgcccatgtggccatggatcagatactaattagaattctttttgaacccctggaatgctctgcagagtgaattccatgtcatgaccacacttgaagagtagtgcatgagaaggctgtttgataagtcctttaggtactaaaacaaatcaaaaccagtcctatttattctaacaaaagcctctctcctcatatgttctctgctttgcaccaaatgatttttggcttttcatctttctaaagtctagatatcctgatactttcatggaatttttgtgtaacttaccagtcatgtaagactgttaccatagagtaagtggtgagtttggcaaagagaatggattgagaatttggatcaagacagcccatagtcatattgctgaagagctacctttcctattggagtttacaagggttaaagaaacaccactatttctctaggatactaccttggtcaactttagtaaaacagatgatgtactagttgtgtattgtggctgaagatatcagtaggcttttatttttcttcttctttctctgtgcttttttctcctttgtttctataaattaaaatttctgggcatggcaacgagaactggctttgcacacacaatacccttggctccaaggaggtcatagatttggatcatctcccagattatacatctgcccctctagcttgcctttcagagcatatggctgtggcagagggggcagattacaaatcacctctgtgttgtttcaaaagtataagaaaggggaagcaccttttcctatgaccataaagttgttacttgagtgttaaaagacaacgattttcttgtgaattgtcttcagtgagttaagatgcattcagtgcattgcagtcatagaagtcacactaaacactatgtaggggaatacatgacatgaaaagtcctgacctctgtttttgggaacttacatgtcagctgaaatggctacagcaacacctgcaaagagggacaactcagagggtccatttattgctttacattttattctcaggtgctgacaaataatttttcttaaaaattatatttctggatatgaatacatattggagcaatcaattcatttcagagtatatcagccgtcagggcttcttttgaaattgcaggcattgaaaattctggatctaggcatagaatcctaccaaaagacaatacagagctagattgaaagcccaaggtactgccatgggggtaatttatgaatctggagaaataacagagtaagaagagatgaaggaaaagaggtggatattagagaagatatgttattcccttttctaagctcatctgtgttctgaatctgtacccaactatttatttcagagccttgttctattagttaatggttctttctcttctgtcttcagattttccctcttgattggctccttcctttaatccaaggagaattaatcaaggtgacaaaggtggtggggcaaaaacagtgggaatatatggaagcagcaaggaacataagaggaggtccaagcaaaagcagtggataacagtgcaaacaggaactatttactgaaagtccttactaaggagtttccctttatcatttaaatagcaaacagaatgaacattttaaagtaaaattctgtcatttcacttcttataaaccttcaatatggaacaattatatgaccacatgcaaaaagaaaagaaaaaataacctccgtctataccttacaccatataagaagctaatctgacatggttcacagatcttaaatgtgagcactaaaactataaaacttctagaaaacaaatgggagaaattttagttacagtgggttaagcagaactttttagagcactaaaaccaggaagtacaaaaaaatcaacaaattagatcttctgaaaattaaaaatgtttactcttcaaaagatactcttgagaaaatgaaaagacaagtcacagactaaaaatatttgaaaaacacatatccaacaaaggatctgtatacagaatatataaaagttccgaacccaaggaattgccaaaatttaaggataagcaaaggcacaagtagactatttactaggttattttagacaaagagtaatgagaagtggaagaagattgtcagagagaataggacacaaatgataaatgtattataaaatgtggcagagacaggtggataggacttgacacttttttatatttgtaaacaagagacaggaaggacccaaagctgacctgagactttgaggctagaagatcagaagaaaggtagtgcctttaatagaaagaatcatgaagaagggtcaagttatgagaatgaaagtatgagtctggagctccagagagatcaatcaaggttagcgatacagatttagaagtcatctgcattagaggtggtagttgaatattgaatttgtccacaagattgcacagattaaattaagtaataattctttgatgggggtaacagccattagttttttggttaactaaaagcctaagatgaaggcaaaggcagttactagagttaatgatcagtctcatttttgctattatcatgttcagtggtttgaaacaactagaatttttctctgaaaattagcagctgcatggaaatgcaaagtttctagcagttacaaattggatactaagttaaattgacttatatatttatatttacagaggatcttaaacagaaaaatgagatctttgttcaagtttttaaatattagtgagacatgagaacatagaagtcatacaatgaaatttgcactgattttgtgaacataatcttatgatttcttttaaaatgcaattatatgctttctttaaatcatattagttgtctgttttgatcaactgacaaaagtcagcttatccacatttttccatttagtaaaaataaattttgaataaatgatgatatggtcttcctaaagtgattagtaatacaaatatagggttttctctttttgttgttttcatcttcagagattagtagaaaatttttcttgttatttgaaaatacttttttttacacacatacatataaattacaggtttgcaaaaagtgacttcattttatctattgtaaactggtgattcctgtttatgtgatcataaatcttagtttgcctacttcttgcttgtgtttgttggcattaatgctgaagttttgacaaaaattactttaacttttgcttccctcggaacaaccagggaaaaatatcaacagcgaaaccggatagatgtggcaccaatagcttacttcaaataaattaatacttcattttttaggcaagaatggtaatcggttctgttctattagcctcagtggtgtgaacatagagtttcatcacattattgtgtgtaagatatatttacaagagacttagacaaagcaaggtcttccaagaataagcacaaaatgtctatacacacgagccttcagggaagattggggtgatacatggaatcgatgcactttcaagttggcggatctgatcatcagtctctaaatgttagtaatcatttggtttatttacttttgaaattaatgtgaagggctctgtagcttctttttcttccttgggttttgatgtgctgatgtaatttggacattgcttttctgcctacaaatgggacgattcctgatatgtgtagattagggtgaaatctcaggtgctttttgattttctactttcagagaaaaagtagaaattgctgctgatataccgagacttcaccgaagagatgttcagtgtaatataattattttgatgtcacttttcattgttttattcacaaaaaggaaaaacaatattttataggaaaacattagtaacaagagagatatcttaatttttaaattaatattcagtgctctttttaacacgatatttattaggtgcaagttacatgctattgtagtaaagttaaaagattattcaaatctttggaattttcagagatgaattttatcaaatacatatttttaaattaaatgggctatcaagtagagtttagaaatcttctgttcatacagatttttatcattttagtacttcatctgtgatataaaacataaatcttgagagaagggcttttgatttttgttaaaagcagcatgcacatcctataaggcatcagtcagaagactcattagaaacatcatactaaaaagttaaaatgtttcttacgctaagattatatcaccaaatccttgaaaagacatagcttcttatcagattgttctttgccttttagacttccgtttcaagggagaaaaagtaatttttgactaaatgtctattgatttaatgtctcccagacccaccaaatagagtttattcaacactaaaatgcagttacctctagaataaattttgaaagctgaaatggaatttggcaactgtttaactcgacacagaaaattcactgaatttagaacaagaagtaaagtgaacattattttatttaattcaagatgcagttgtattttaagaagacataataatgagatggcaaaccaaaataaataaatgaaaatgaattctgttttctaagctcctaactccatgcaaacattataggtcaaaaatacaattattgtagtcttaattggagtcatagcaacttgttgcttaatttataatttctctgtagtcacatatacagatatatagttttgagagagttaatacatggaaaatacttagcttagtgcctagaacactgaaagtactcagtcagtggttgcaattactgtggtgtttgttgctattttctgttgcattcttgtgtctcttttgacctttctcccttgcttcactctgaataatttcaagaaacatgattttggcttaactgcttaactagatttgaactactgattctattcttttagcaattaaaggattcttttcaatatttggtctctgattcaaccaggaaagaagagatgagaaatggtggtgttctttttgttgatttatctagaacctgtggttttcagactcaggttgagggaatataagtgattttcaataagatatgccagttttagggcttgttattgacttgcccctatagtcagggctgttaaaaggattttcaacaaaaacgatctcatcctcaatcttaatgtgctaaagaagaagacaataaaagaaaaaaaggcattcctctcaaacaatttgaaatatctgcagttattttttcagagtttttactaaaactcaagctagtctagctcattgtgaaattttacaaatgcatacttcggatttattttcaaaggggagaaatcattctaaacttccctgtttcttatttttcttttacagtccccatgctatttctccatttcagccaacactgttaacagactcttttaacatttatatgctcttgcaaattatggcataaaaaactatttcttgacttcttgctatgtactgatattgtataaggtactgtgaggatccacaaaattaaaaggcatagatttcagagagggtaaaacttacacatgggaaacaattaagatcaagtgatttataaacagtaacctctgaaatagaaggtgccaaattgtgtgacacagacaatagggcaacagggctcagagatgggcaagatcagcggggctgtattcatcaaggaaggatttggcttgagcttcagaaggattggttggatttgtatcactgtagaagagaggggaaggcattccaggcagcagggagagcaaaagcaagctcagaagcagaaatgtcatgcaaatgtcatggtatgccctaattttaatgattccgcagtcctatgaggtgactttaatctcactgtaatttatatcagcagcaaaggatttgagtttacaagctggcttcatttaaagaaaaggcagatagaggggtgaagatagaataaatacattcaacaaatagtaatagtcaataaaaatatgaaattttaaggttctagctattctaagcatgtccttcagtctgatgtttggttttaagaaggtaaaattcttagggcatcataaagaacctcaaacatttaagataactaatctaatctctaaaccagaggaaggatgtttttcttaatactgtaataaaagaggctgccaccatattttatatggcaccaactctattggttattaatcaagttcttaggctaaacttcaggccttctctcatcccaggacctttagctagtgagccctagtgaacatagccatcattcaactccttgccttctccaatgagaaagaatgctgacacagaaatgttttagagtcaactgcaagaactcattaataccaagcccaagaaggaactgctgatcatcagggatctgatcacaaaataaattagcagttttgcatcacgatgtcttgtgacatacatgcattagtgaaagtaaataagcatgaagacagactgattaagctcactcatataattggtttttgagaacggttccaatatattgggagaaaaataagcatcaacttggaaatcaaattgacttttttcttaacactgaacaaaagaattgttagaggtttgaggtaaaagatcgtggcagaagccagtattgattcacattactggtcagccctcttaagattctatgcttctctgggtgttaaaagtccactggaaaataagagaaagaaaattgagtttcaaggacgtagaaaaatctgatttgaaatcaggtggaaagtgctctaatgccactagtattaggaggcggtaatttgcagataaaaagtaaaaatacaggtctggaagtggtatatttaaaattttacttctgagatatatgatgagtccaaaataagttttaaaataaaatgaagtataattttgaggaatatagtgccaatttgacagaagagacttctcagctctttggggaaaatattgaaatgcatggttttaagtgatgctggctagaataaaggtggaaggaggaaaataaattacctcattttaacaacctcattaataaggtaataagagactgtcttaccagtgatgttatttgcggactaaagtttctcaaaaggaagaaaagagtatagtcttgaataaaaggtgtacccaagtatgaataaaataagtataaatcattcatttttcaaaaacctgtgaagctcaaagaataggtattattccattttgtagatgagaaaattgaggttttgaggcaaatagtagggaacagagtctagatttgaacctaggtcactttagacttgtttaaatatgtaaatcactcaaaactcagaatttttgcatttgacttcagataaacagactggataaattcctacctaaacagaaactaactttattgtaattttctaattcctcaatgttaagttctcaatgattaaaggtgccttgagtattttattcaaaactttttggtacttaatcctataaaaataatgacatactcttataattaaatagacttatttcaaactgtttcccaatttcaatttattcatcctttttactagtgacatcattcattcatgataaaggaaacaaggaggctttttcaggtaatgtcttaggagtaaggagagagaaagcaaagttagtaccttgttaagatttccaagaacttttatattcaggaatttatattcaggaatttcactgatttttttttaaagttccttcaggggcaattgggctgctgggctgctgattctcaataaccacacttacacctgacaaacaaaaatgcattactctgtgacaaggcataattagtaatttcccactgaactggaatagtcattttagctgtcagaaatatttcttttcctagtaagaaaattcacttgcaaaaacaaaaattaagatctgaagagtacttaccaagttgagcaagcaaggggaaatggataagctaaaaggcagctatgtgcttctctcctactggcatgtatcatagactcagtattttctagagaattatctggatactctcatcaatatatcctaattcaccaatatcagtataacatgtaattttttccctagaatacagcaaataataactgaagattttaagggacaacttcagacaataatacctaaatacattaaaatgactaaaggagtgtaattggcttgtttgtaacacaaaggataaattcttcaggggatggagacccccattcgccatcatgtgattatttcacattgcatgcatgtatgaaaacatctcatgtaccccacaaatatgtatacctactatgtactcaaagttaaaaattttaaaaaaattttaaaagtaaagaatatcctgtcagtaataataatatctaaatacaggactaaattaattcataatacaatttgtgttggttaggaatgctctaggctgcagataacagaaagccctactattggtggctgggcatggtggctcacacctgtaatcccagcactttgggaggccgaggcaggcggatcacaaggtcaggagatagagaccaacctgaccaacatggtgaaaccctgtctctactaaaaatacaaaaattagccaagtatcatgtcacgtgtctgtaatcccagctactcaggaggctgaggcaggaatatcgcttgaacccgggaggcggaggttgcagtgagccaagatcatgccaccacactccagcctgtgtgacagagtgagactccatctcaaaaaaaaaacaaaaagaaagaaagaaagaaagaacaccctactattggtgacataaagaagtaaagttcctgtttctcacctagtaagtagtatagaaatgggcggctgctagcagggaagaggagggagatttcagtggatatcagattggttgtatctctgattctctgggattcttccacttgaccatcttgcagtagatctaggcaaaacaggaagggataaagggagggaaaagagcgtgccagccttatttatcttaccagtaaaagctaaggtcttcccccagacggctttaacacatttccacacatagctcattgtccagaattggctcattgccaatcctggcctcaaaggctaggaagtaagaacataccggattttctcgcctctcctccagaggcaaaaaaggaaaaaggtgtctggaaatgggggtgggatgaccaaccaacagagactgccatgccacaaaaaataatacattctgccactaaaaggaactttaccatttattacattactctgttaccatgagcttacctgaagtgtaccttaaataatcacttgaggagaatttctatatatccaaaaacaagcagagaagaaaaaaatcatactcttaaggatttcagaagctaggctttgttccaggtgtgctttctgcaaagtgttttaaattcaagccttagcaaaatatcagattgctaccaggcaaggaccttcagagtcacttgataatataggaaaccacagtgtcatgcatttgctacagtggatgatggtgggacacccccataatccccttatttgaaggattttattcactgataaaagtcactgctatgtgatcatgattgattgctcaacttttaattattgacatatattacaagtaaatatgccatacatatacacacacacagacaaatatacacaaacacactagaatttctgatctacatgagataactattactctaaattgacataatttcagcccaaagcagaaatatttgctcttttggaaagtatgtgagcttagtaagatgtagttgtgaatcttcattttgatacttagcaataacttttcagatcttcattattattgcctagtatttccttcaggggcccccaaatgtggattgggaatccaggttggaaaccactatcctcaactttccactgatgctcccatattgcttttaaaagaaaacatatcagacttaaaagttatttaaatcttaaattagctacatcttaacagcataattagccttttataccaagattagtgaaagatgctcggctgggtgcggtggctcctgcctataatcccggtactttgggaggccgaggcgggtggatcacttgaggtcaggaatttgagaccagcctggccaacatggggaaaccccgtctctactaaaaatacaaaaattagccaggcatggtagtgcacacctgtagtcccagcaactcaggaggctgaggcaggagaatcgtttgaacccgggaggcagagtttccagtgagctgagatcacaccactgcactccagcctgggcaacagagtgagactctgtctcaaaaaaaaaaaaaaagaagatgctttatttttgtcttgttttctgaatgggtgataacaagattgataccaataaaattttgcttaatttgatttttcaaggtaaatatggcaatatatattttaccactttgttatttattttcttagttctatttcagatcacctgtcccctcgtttctataattattttccccacaattatatttgtatctgatagaccgtatttgccataaataagaagcactaatagctggtgttaaaataggtaaactttagtatattttatataaggaccattgaatacttatgattacttgttttaacaattaggatgtgtttgactgcaaataacagataattgataacagtggcttaactaaaaaaagggtttcttcttgtctggcatcaaggacagaggaggcaggcaggctagggttggtacagttgttcaaataagtcatcaaataccagacttctggcctcctgcgtctccatccataccgtgtagcttccaacctcatgtttgtgggatggctgctgcccctccatgtgccaggcaggaagaaggaggacaggtgaaggacaaaagacataattctgtcccttttatttggaaaataatagctgtccaaaaacttaacctcagatgcttcatccgtgtcttattattcaaaaccattacatgaaaacaaaaaaccgcatgaatatctggagagatgaatatttttaactagtcaggttgctactccaaagtcaggattttgttaaaaagaagctgaaaaactatttggcataaacaataagtagttatacatgagacagataagttagccaaatcaaaatcatcctctttatatcagtttttcccctaaatttaacttaaaatacctgaagtaattggaaataaagtagttttccaatgtagacattgaaaattatctgtaaactagttcagtgttctctgaacagcaactaacacatacattgcagaaatttcatgaatattagattgtgttgattgcttcaatgtttgttcttaatctaaattttcactttaacagttgcagctaactattcatatatacaatcaactctcagttaccaaagggtgaatgccctgaattcccactattgttggaaaacctggctatccatttcttctttgcattgtcacccagtggaaagagttcgctcctttgttatacttactgtgaattccactccttcacctaacaaaacaatgccagagcagaagcacgtgtgagttttttctttatagtcagatcagctgctgtggagggcctttccctctaatgaccagctcttccttcagcaaaagtataaagcatgcaggcagctatctaaaggagcaactactttggagccagacttctcaatcttgaccatgaatccaggtgagaaatactgagtaaaaatacaaaatggatttgcgtaagagttcactaactcctcctagatcaggtcttcactttcttctttgagatgtcatgagtttacagtatggaagacactctatttgtttatttcatcagtcatgtgttcacttggccaacacctgttaaatgcctaccttgtgctgtgtatcatgctgactcacaatgtatacagtcgcaccgtattctgcggccaaatggattaatatttgtaaacatagttagaagttttacttttgtaagttatctatgatcttgaacttttgttacaagtccaccaggttgtacagctctgtggtgggggtgagggtcatttataaaggctgcatgtgaatcatatcagcagtcccccaggggttgcagagcacacaccaccatgagtgtgtgtaattactctggttacttcattgcacatttgaggattggctcctgttttgtgttatccatattattagctcagctcatctagatctggacaaatatagtttttttaaaaaaagtctattttattttccctcatatgtatatatatctttatcttagataaattactattgcctataattttcatatatattataacctctgaagagaatttagtacctatattctttctactctttatttctttgtgtgaataggcaacatgtttacctcccttcactatagcatattggtattaggatatactatatacttgaaacttagaaaatttgcaagaataatcagctgatttcattcctgatgtataaaggaaaatattccattccttaagtgcttttagtaacttatattgcagtgactttaatattactgaggaagaaacctgtagtaatcttattcacctcattggtaagttcttgcaatatttattattaaacattaattattaaatatgaatagtattaaatgtgtggtacattgctttttttaataacccctttcctgatatcccttaatttacatggtatacttttacattgatttttttataaatcatttctacttactttctatctgaatattatctatctgaatattaatatcaattatctacctgaatatttctatctgaatattaattcttcagttagcaccaaatgcagaatttattatgcaacttttaagccctctacagaaatcattatattattttataaagaatccataacattttctcttcttggcttttcagcaagttgtctatagtatgtatatcataatattaccttgtgttttaaaccactcagaaaactggtaaaaagcagaattgtcattttactaaatattctttcttcagccaattcccatgtttatcatttccttaatttttattgtcctgtgttgtaaagtggtctgtggcttcaaagggcttttatttgctttacttgcttctaggtttctaactgcttgtgtgccttttgaatacatgtttaaacataagagaaaaaatgtgagtaaggctcgcttctgatttcagactgcttgagagggaagtgactgaaggggtaatatataatcacaaatcaaacccaaggccactgttaggcttctttcggtgccctgttgaacgggaaaaattaaaaaaaaaaaaagtctctcgagtttcacagattagcaaaaacttccttgtatttaccatgcactgaaaatacaattaacagtttgtatgagaagacgaaagataatgaaaagagaaattagtctctgaaaagcacattcttatgaggtcatgaattacaagttcatgtgtcttatggcaaaatatttatctaagagattcggctataaaaatcaggagtcaccaccctctttagattacccaaaagagttgataatgacttcataatagcataaaaaatctggggtctttattgtttttaattctgatttctatattttatctattgaaaatcaagagctgtggataaaaagttcatttagggcagggtgtggtggctcacacctgtaatcccatttgagagatcaaggcaggtggatcagctgacgtcagaagttcgagaccagccttaccaacatggtgaaaccctgtctctactaacaatacaaaaaattagccgggcatggtggcaggcacctgtaatcccagctactcgggaggctgaggcaagagaatcgcttgaacctgggaggcggaggttgcagtgagccgagattgcaccattgcaccccagcctgagcaacaagagtgaaactttgtctcaaaaaaaaaaaaaaaaaaaaaaaaaggttcaattagatgtcctaatgagagaaaagaaatttagcagggatcttttcatatcaatatcaacagttgttcaaatgctaatacaggtttctcttaatggttatgagaatggtgtttgcattaatggaaagcagacacagtaatctcaggtgtgttcatattatcattatttagtctgagaaatctattaagagttagtcttaatacaagtaactgaagttgttgccttcattaaggatttctgttcctgaaatttgtaatgtacacagtgaattaaatatggcatacattagccgctgatacaggaagacatatttgaaagaaacaggggaagtagaaatgtggatgggaagagcatttagcagtctcatccctctgccattccttccttttgtagtgagccagcagggcgcctggtgctgacagccttggcaaacaacctagagagaaaatatgtcttctgaaaagatcacgaaatctcaaagacctccagttccttggtatttatacagcatttgtggtattttcctcctttcttttcttatttatccttaacagaagaaacaacaagtaaatctggtgaaaagcttcaccaagaaaatgctttctgaaagaatttaaaagaagacaaaggagttgcagggagaagcaggttggcaatgaggagctaggcggggccttcgggagcgggagcagcacccaccatctcacaaatggcccttctcggcaacgttgggggatatttattccggggaagtcagagaagctccaaagtggcttgcagcgctttatcagccgacatttacacagaaactcctgcctctgagcttcctgtgaaatctataggaggagaagcccaagggactctggctgttagaaaatttgtcatcctgctagagagacctatagattggtggttaaccacatggatattgctgtcagacctgggtttgagtcctggccccatagctggctctctgtgtgacccttagtcatgctgagcctcagcttatttagctttaaatgatgggtaataataatatccacctcacaggtggaagtggggtgagagaatttgtgtggaacacctagctccatttctggcacctaggacaacctccatacctgctagttgttatgtttgagtgatctgcatatttgtaacaacagggatacaattaaacaagagtccatgctcttcaggaattaaggagaggcaaccttctaggttacagtcaggaaggttccatttgccagacaacgaataatccttgagtattcactctgctggccgttgatagaaaagtgaccgtgacttcatcactgccttcaaaaagcttagcaaggaagacaggtatatacacaaacaatgtacagaatggggagtgtgcttgggttcaaatcccagttttgttgttcattagctgtgtgaccttgaacaagatatttaacctctctgttcccaggttttcctctatataaatgacagtaataatagcactcacatccaagagttgtggtgaggattaaacttgtgaatactgtacagtatagcacttagaataatgcttggtactcaataaatatatattagtcattattataatacattgtggtaatagaaatgagagatctggcagattttctctcctaatttcttttttgacatagaagtggttaggaaaggcttcctggtagaagtgatgtctaaaaaatggccagtaaggagaggagagaacagaatcttagaaagagagacggcagatgcagagacccaatggaggagggagggaactgatgtctttgaagtatggcaatttgttcaaaatggctggagtttggactgtggggggaagaacaaaggaaggagaagagaggtgaagtaagatgagtgagagaggccaggtcaagaaggcctttgtaaatcatcccgaggagtttggaccttctgaaagccaaagggagccctacaggagtaatttgaccagacaatcaaaaatcctggaaacagatgcccagagggagaaagtgtataaataaagacagtattgagctgagagttaagccttggagaaagcccacatttgggggaaggagaaagaaagggcactggtaccagagaccaagaaggaataaatatattgtgagaagaaccaggtagcaccatgcttggacgcggagggaggataggatttcaagtaggaagggttaagcaaaggtagcgagtgctgagaagagatcaaacaaaataaggactgaaagaagtttattggttctggcaattaggaggcaattggtgaccttggagctttagggaagccttggagctagaaaccatatggcagggggtacagagagcaaggagaaagtcgacttcctggatgacacctctgggttctccaacttggcaataaaagaaagaaaaggatagaagtgagagtacttgcagggtttttaggagagactcaagggatgatttcagtgaatagattttcaagatttcggggactagagagaactggacgactgataggcttgggggggagaggggtccctcatacataaggctaagaagacaggttagatgcagagaccattttgaggttgaggaaggagaaaattagggaatttttttcaaaggtctgataaagagaaatacagaaatgggaggcttctgttttggaaggttttgagttagctgatgtgggagaagctttagggacttagaaataaataaaacaattgctgagcactcgagagacttgtgtgcctcttccacgacaaattaatgaatttaatttttctacaagtcttccataatagaatgaaaaattgtgcctacttaactccttatgaaacttcaatttaattctaattcagaactttaagaagccactaaactttataataactgttgttcataggctgagcgctgtggctcacacgtgtaatcccagcactttgggaggccaaggcagctggatcacttgagatcaggagttcgagaccaggttgaccaacatggctaaaccctgtctctacaaaaaaatataaaaattagctgagtgtgatggcgggcgtctgtaatcccagctactcgggaggctgaggcgaaagaattgcttgaacccaggaggcggagcttgcagtgagccaagatcgtaccacttcaccccagcctggatgacagagcaagaatctgtctcaaaaaaaaaaaaaaaaaaaaaaaaaacagttgttcattgcccaatctctttaattattatactaaattttccccccaaatttaaccttaccttttaaaagaattgccgaaataagtggtcatgttgccaacacatcctctccttctacttccaatattagtagcatttcagaattctttacttcttgaaatgtttcctctggatttcccaaaacattgggacactatagcctctatcacctacacatgctggaactatacctcacacgtgtttgtgctgttctcactgcctctgaggctaactaacgccattggaggactcgtcctattcatggatttcatccatgattcattttcctcattatatttttacctattttcagctttttgccttgttaattatgtacatttgccataatttcacaatggcattattaaaacatcagattgtccaaaggggaagctaaatggatgtcataccatttagaacagagtttctccttcaatcactgcttttatttatgaagtttagaccttagaatcgcctctgtgcaatgtgagagtcctcccctaaaactctgcaaagcttcttctgagtcacgtcatggcatgcaggagtctccaagcgggaaaggttgcttttgatggttcagccagttccatttcagtgaagggacatcacttccctaaaatgaaccccctcttggtaaacgttctccattttctagcagagtcaaaccaaaccagagagaggcacgttctgggaagtaagttctccagtgtttctaaccataaagctgggtttctgaaatccaagattactcccagcagggagcctaaatacagcctgaagctacaaaaaataagtatccctattttacctgtgatgtctataaattgtgaccacttattttcattccagagtcatactttgtgctgaaccatgaaaagcaaagctacatttaaaattttaaaccataagctattagagaagggtaaaagagtctctttgtgttaggatttcttctgtctaaaggtaggaatagcagttgccattctctgacataaatagctctcatataatacctttcagggaaaaaaattgctttaggacaaaataacagtcactactcctttttcccgtgcatgaactttggaacagaaaaataacattaacaggttattaaactgtttgtcaccaaagaaaagtagatggtatttttgtgccttggataatgttaagtgaagaaaaaaatcatcaaagggatcatctgtacttgccctgctttcaaaattactttttctcttttcaatggaattcacgactgttcttggttttcagacttgtgactttgttcattagagcaaatggtttaatttttattccaaactctagattaagtttcagagttcagcctgggagaaaggaactattgaaaaccttttctgtttccttctcttttttcttaagggagggctttggttctcagagaatatcaaattccgatgtcagttttgtaaataagtatctgttgtctccccagatcaagctgtgtttgtcttatttgtacatttatagtaaagtaatctacaagtggttccttgataaagttaacacttagttaattacccagagccttgacatgtcctataattgccacttggctaacaaacatttgatacttgtcttgggtagaatttgttgaggcctaaagaagtaagctcttgatggatggggaacaaaccaaataaatacagtattttatgttcttttaattcagggccaagtggatttggatgaagtgtttatttagtttgctggctgtttcaagatgctgtggcgtattgattccttttattactagcagccgtttaacctgacctcttccagatccagtattttaaaagccataaattttaactttacttatgagcaaaggctgaaacactgtgaaagcctttttattagtcgagctctgccattttcgatgctctggtgtcacccatggcaacaatatttagggcttcttacattagagtggctgctgggctgctggggaggggcataggcagccataaaatgaagccgtaaacatttcaagggtataagattccatgactgtgatagcagacaggtgcaagaaagaaggggcaggtctaaagacaaaagggttggggatgatcatgttaaataaacatctactttagcatctcaggtactgaaaagaatttgaaaattagaaacagaataccaggtaatcatagagcaaggtggagccagggaccaactcgagtgacccatcttgtaggtcccacactgcctaagtcattttctggtcttcatattgcacacaaaagttctctgaaaacgaagttgaaagaaagagaccttgttccagtgaacagttagcaaactagggagatgcagtatttctgtcccaaagtcccaggcacacccttaatctctgcaattgtaacaaaccaggaaatccactttttttcctaagttgggaaaatacatgcctcacatcatagactgatttgtacaaaatatagtaaaaactttccagaatgtcagtactttacttttctaagacactatataacctgcactcggaaggcaggcaactgttttgtatcaatcagcaaatcaaagccatttcatcttcaaatagcccagtgatgaaactcctgggcaggttgtctacattaaaagtacctgtttttccataaaaaagaggaagaaaaagaaattttatacatgagtttacccctgaaatggatgagtagatgagaatgccttgtagttgaagaggaagacaaaaagaaactaattctacttgtgtgtcttcctggttttaacttacacacatcagtagcttttgttcactttgttgaaaatttcccattcgttttctaattatcaaaaatgtttttttaaacaaataatttttttcaacactagccctctttttatttgatcatgtggaaaaactcttaatacagcattagggaggttatataagcaaagaatgatcatttcaccataggagaaaaatccaagatataaaaggatattgaaagaatttaaacaaaaacatcaacagaagagagatactgaatgaagagatgttcccccctttcttcactttatatttctttgcaaagaaatttaatccaaaataatatgtgattggacttggattattatttcatcttcctggtctctttcttttcattcttgataacagtgtacttgagcatccttatactacctattgccagaaactgccctagccttttaagaagccaggtactcattaattcaagtgatgtttacaagttggctcttaatatttgtctcctcttcaggtattccagtggcttaaattaatatatatatatatatttgtatgtgtgtatatatatatttatgtgtatatatatatatgtacacacacacatatatatttaaatttcttgctgttaaattgtttccccaatcatgtttcttagattgctgaaatagaagaaactttcttaagaatttgagaaagtataaatcagggctgtaacatcaggattttatcttctttcagttttataaaaatggcccaatctcaattagatataggtcccacactgcctaagtcattgtctggtcttcatattgcacagaaaagttctctgaaaaggaagttggaggaaagagaccttgttccagtgaaaaattagcaaactggggagatgcagtattccagagaacaaaaagaaggtttgggtgttatagtaaaagttcccacccaggttcccaatcaggtctgtttatgcaaatgagagattcaaacttgcttagttctgactgatcaatacagctgagccctggttggttgatacagcaaaatcctgattggctgaggcaggtgagctatgattgattagttcaggcaaattctgaaagttccagagttaaaaaggtgtggggttttggggaacccagagtaagaaagtgtataaactctattcagcaaatggctgctccgctctatcttaaatataggcccaattagccactcagaattcatcttgaaggattggttctttcagattcacatttgttcacaatataaaaactaaacccttcagagtgtgagaatccttacactattcctatggctagagacttctgtcctagcaattcaagaagccaaactttttttgtttgtttgtttttgagacagtctcactgtgtctcccaggctggagtgcagtggtgcaaacatggctcaactgcagcctcaatctcctgggctcaagggttcctcctgcctcagcctcctgagtagctgggaccacaggcgtgcataaccatgcctggctaatttgtttttattattttgtatagacagagtctcactttattgcccaggctcaaacattcttatgaattcaagtccctaaatgcaattcaattcactaaacagcagcataatgtttagtcttttctttttctgtgaccttatttgaatcaaaatggacctgaacactttcattacccaaactatggtctgatcagtattctatatcacactcctcctattgaataacagtatgtagaatttgaaaattgttaaaaatacttatagcaaaatatacaaaaacaaaatttaacctcttaatcatttttaagtgtacagttcagtagtgttgaatacattcacattgttgtgcagccagcttttactgtaccagacatgctaataaactcccctcttccctgaagtaagccagcggcctttccacccagagcagctggtgaatttgatgatcttgggcagaatgctcccctctacccccacaggagggaaagcagctcttaccttggggaagttactcagatttctagaaaaactttctgtaaggttggctgtcatggtgtgaattaaaaggttatgtcagaggttaaactatgcaattaaatcaagaaagcagattattctagtagctgacattaacgtttgaaaagagacaggattagctgtacttagtcacatataaactgcacaaagcgaacaaaggggaaaaaaattatttcaccaagcttcccttgaaagaaaatcgttccatcttgcacctctaatttttcagcttaattctgttacttcatgaggttcattatccttttccagatttgcacacggtgactgatgctctgtgacgggttgtttttgtttttctgctttaaaaaatattccctccctccctaaataattatctgcaaattaaccttttctcttactggaatatttgttagaatagaatatagaaaatagaaatgtgtaagcaagactgtttagacaggagataaattctttgaggccacaagggtatcatttattaaatgactgctgcagtcctctaaatgggccccttttgacctgaaagagttaatgctctattgaaagtggctgggttgtccccagccttactcccttggaaggctctgacccattaatggcggtaataataataatagaaaacaatcctgctttgcttccattactctgaaactgttaatggtatcctaatgttttttattcttttagtgtaactgaaaactgacattctgctcagctaaaatttcaaatgtagtatttttttttcattaccatttttacatgccatgcaggatgctgagtgaggaataaggcagaggcttgtaattggtcttttaaatcatcataaacatttatttttccccccatggctatatctagtgccaataactcagtcatcaaatgatgggaaaaactgtttaatgatgcatcacaagctccttcctaaatttttacccagaacaaggcagggaatataaaaataagtcacattgctcaaaagttgattttaaaataagcacaaaacagtttttttttttttttgtgggagtattagcagtgaaccaagtgttcctttctttttttgatataaaccctttttagaaaagccttgtgtttttatatttttattgtaagtaataatgaaaagtaaaataggactctgcaatgtgtggggcagaactgtggcttctgttttgggaggctgacgtttgtaaaaggcaggtaatgatattacccctctgtgggactgtcaagacaaggcaaagcatttggcacagagactgtaccatgggaagttctaaataaagattagctatcattattattattattgttgttgttgttgttctgccagagcaaaacatccatcccagtttagggtactgaggcaatacccactcagagcaattgaatcctagctagggcatggtatagatataagtccctgccttgcctattgtccatgtgcattagagtgactatgtttggatccagggtcactgacttcagaggccccttattgccagtgggtgtcataaacctgtttatctggccactaaggtccttgttggtcttttcccattctctctgttcaacctcattcctatactcccaggccccatgagcactctgcagtggacacatggctgggcttgctgccccttggcaggccgatgttctccgctgtcgcccactctgtctccaggaccatctctgtttggtgctgctcatattccaaggatctatttcagcctagagtcatcattttctcctctgacttctgccactccctctgtatcttgccacatcccaccttgtttgggatgcttttgagttttgcattttgaccttcatgtagattgcttgttccttgagagcaggtgttcacaaagagatacccatattgtcttttgatgagctgagtccacatcctgcagatgtggaggaaaagatcctcctttttaattagtagcaacatattacgtgtatatagagtacactgcagctttgtgaattttttgtacatacataatttcatcttataataacaaatgatgggaaaaactatttaatgatgcatcacaagctccttcctaaatttttacccagaacaaggcagggaatataaaaatatatcacattgctcaaaagttgattttaaaataagaacaaaacagtttttttttcttttttgggggagtattagcagtgaaccaagtgaaacttatgagactggcatccctgttaacttagacaagttactttatctttgcctcaattttctcaactataaaatgaggataatattagtgtatacctcatataattacatgagttaatagatatatataagaatgtgcctggtacagagatagctgctgctatttttatcatcatcattatcatcatcaatatgatttttccattatcccacttttactgatgtagaaactgaagcccagatgagattaaataacttccttagattctaaacctttcaattccaagtccccactgaacatgcctcctatatcaaatcttgttgttaagcaccctagactgcttttagtccatcatttccttagagtcaatttacagaaaagtttctaattcacagtttgtctggaaatttctgtgaaagggaaacttaaaacaaacacagtgataaaacacaaacccttctccagaaatagataccctcttcctgggagacaggtctctctcctcctaaatgagaggcctctgttgagtagtcatgagaatacctatgggaatacctagctcttaaaagtgatatcagatttcctccaatctctctaaaatccagacaacatatttaattaatgtcattgtagataggttgtttgaacccctggtcaaccatagcaagaattgattttacctctcttttgaaagccattctatttttctaaattgtctaaccattggtagtatgtttctacttattactaatgatctgaagaatggtcctctcttcacaaaggagtcaggggtcaaggtgagcaaaccaatgtaataaaactcttcttgatgtagaagatttgtcacttgtaaaatccatgcagcaacagactggaacatgcctgtctataagctggtgtcagacacacttctcactggtgtggttagctctgtactcaccattccttcaccagcagtctgccctgttactcaagtgtccgacctgagcagaaacaactggtggtaacatggattgttatgtggatgagagattggagaatagaatatgaagtcaagactgtgagttacaatggaaagaaaacaatttcaaactagttttgcaaagataatttcttgactcctggcaactaaaatgttcagaggaacatccacaaagaaatgtagctgcacccagggtctccatgtcagcagtactctctcgtgcagttctggttcctctcttcagacttgattcttacagaaaagcaagatggctgccagaagctccaggcttagattctcccagtaaccccagtaacaaagactgctcactctaccaggcttagttctagttagccctgtgtgtgtcagtagctgtcccagagctcaccagggggaagaaatgcactgattagtcatgtctgggtcgtaggcacactgaatgagagttgaggaggcatagtacaccaaggaaagccaggatgctcattttagatagaataatgggtgccggctaggaaaaagaatggatgtcagcactcgggggagaaaagagagacagtttaggataagtggagagttgtgacactcttgctgtttctctgtgcgcttctctgaggtagagtaaagcaagtgtttccatgtaccctgacatctcagtacaacccagcaagaatttcagtacaagaaagactgatcatagagttccctgagggaaggttattaatggaagtatcaccttcttgtaaccttgtttcccgctggcaaagattcctcaggctgagttactgggaaactccagtatgctgtcagatttcacaacaacattaagtggtacttcctttccatatttgccacctcatttattttgtgtgtccccatgttattagttttactgcccattaatcattatatattaccaaatatagtaaagcgtgcttacgaggagatagcaaagggtccggccatgacagtcacaatgaagccatgccaggaggaagcctaggggtagcaggcagtgccccctgtcccgtccacccagacacataaccctgagcacctcctggctcccaagtgcattaagatatgttcctgcaccctatccctcctcgtcagagaaaaacctggggaaaatagttctgttcattttgaggacagatgactaaccatgctaaaaatgtatatgaagaaattagaagaaatttgaaattgtaaaaagaaaggaagagcaagagattttattagcaatgagttccattgctgcaaaatataccactctctttccctttaatttattctatgtgtgtcttccatattattttttctctgaataccaatatcatcaagcgtttactctggtaaaaaaacttcatggctttctattgtcccctaatttgggccttgccttcttagccagatttcaaagcccttcatgcctttactttatcctttctactcatgtttatttcccaccaatctctaccacattgttttttgttactagtcactccatcctcccggtgtccccaccccccaggagacgtgtttggacttttcctcatgccttttcctctaagtggtgtgcctgtccacctcctacttctcttacctatatatcatccatcttcaaggatatgacccacatcatgcataaagtcttactcagtgacttaaagtcacactgtgctttcttttctctgacttctgcaagcctaaaatactccagcccttaactgtgctctatgtcagcattcttggtacgtggtttgcagagatacctgctggccagtgatcccaaaagtccatgaccttgtctgatttgtaattttgttgatggtgtcatgggttagtctgatggagaagagtgaaagaaactaactagttctttacttgctgtccctggcatggttattctcaggaaattgttttagcatgttacttcttcatgaaaaatatctttgcaagaaataaacaagtttatttgggctactaatagaagtaaaggagatagaagatgatttgaaaagtgataagaaatcttagaccaaaaaaagtagaagttttcaataaagagtgaaaattcagagctagtaatgaccctgtcctacaatgtatgaatagggaagcagaaatcctcttgccattctgtgggttatagagaatcctcctaatgggtgtaaattttgttcaccaaaaaaaaaatatgatgctaagcggtgacatgtactgaatatttgctgttgccaggtatcatgttcaaagttctgtatcagataatcttccaactaccccataaatgaggttctatcattatctctgttttacagataaggaaactgaggcactgagaggtaagagcctcacctagagtaacacaaatagtatatgggtggagctggggcataaaactgctatggttgagtgtgtccccaacaagttcatgtgctggaaacacagctcccagtgcagcagcgtggagataggtgggacctttgggagatgactgagtcatgaggcctctgccaccattaacccattcataaattagtggattaaaccattcatggattgatggattaatgggttattgagggagtgagttagtaatcatgagaatggtgtattataaaagctagtttggccatctgtcatgagccccctcaacgtgtgatgccctgtgctgccttgggactctgcagagagtccccaccagcaagaaggcccttaccagatgtggcccctaaaccttggcctccccagtctctagaactaaaagaaatcaatttcttttctttatacattacccattctcaggtattcagttatagcaacaaaaaacggactaagagaacccaagatgtctaatgtcagattgtgcttgtaatagcaattgctttaaagagtaaattatgagtgaatgccagagatgcaattaattagctgagtaaacaggtaacatggctaccattggaaatatgaatccagataaatccaggtgtatgtacgaacaatttattttctaaaatttggggacttgtattcccctgagatgggtccttcttgagctttaaggatctcctatacattctctggtgttattagttcatgtgtgtttatctttgctctacacatagactagaatgtctttgactaagctaggtgtttaatcttttatttctgaggcagcaaagaaaatgggaggaatttcagctcaaggtttgtcagaccaggaaagcctcatatagcatctgagtagccttgccaagtcaataggatgacatttccttgtatgcactctcagggaacttaaaataagaattgaaagaaggttgagtgtttgttctgaaatttacatgagatgtaggactgaggcactgcctctcaggaatgtgaagggaaatcacaaaatacctttggaaatcccctcaattcaccatagagaatacaaaattattgtttcaaagagatagccatttcatcagtcaaacaccgatgaaatagttggcttgtgtttgaagatagtgacacattgctatagacaaaatgtttgtttcccccaaaaaatcatacattgaaatcctataccacaatatgatggtattagtagatagggcctttgagaaattattaggtcgtgatgctggaaccctcttgaataggtttagtgctcttctaaaagaggccccagaaagctcttccacttgagaatgtggcaagaagatggccatctgtgaaccaggaagtaggtcctcaacagacactgaatctgcctgtgccttgatcttgcacttcccagcctccagaacagtggagaaatacatttctgttgtttgtaagccagtttatgaaatttcattatagctgcccaaatggactaagacaaaaattggtaccaagaagtaaaatgacactataacaaatacctaaaaatatggaaacagctttgaaactgggtaatgggtggaggctgaaagagtttttaagtgcatgcttaaaaaagcccacattgtcatgactgaacttttaaaaggtgattctggcaagggctccaaagcaaaacaaaaacaaacaaaaaaagcaacagcaacgacaaaaaacaccaacaccaccaacaccaccatcacaagaggagagctgtaaagaaagcttcgatctctgagtcttcttagatgatacccacataatcttgaatagaacgttggtagaaatatggatggtaaaggccattcttatgaggtctcagatggaaatgaggaacatgttattcacggaaactggagaaaagaccatcctcgatataaagtagcaaagaactttgctgaagtgtgttgttctggtgtattatggaaggtagaacttgtaagtgatgaaattgggtatttagctgaagctatttgtaagcaaatttctctgatttctctaaaatccagatagcgtatttaattaatgtaattgtagatagtttgtttgaacccataggcacagcctggctttttctgactgcttatagtaaaattcaagatgagaaaaatgacctaaagatggaattgtccatcaaaaaggaagcagagcttaaagacttaggtaattctcagcctatccatattgaaaagtctgaaaaagcctgtttgggaaagaatactaaggatgtggtcaaacaactgtttgataaggagattagtatggatcagccatctcagcagaagccaggagctattctccaggacaatggaagaatgactctgaaggcaattcagtgatcatcaggacaatccttcctaccaacaggcccagagtgcaagggccctggagacagagtggtgtcaaaggaggggctgctggtgccctcaggacctcagtgcatgctgcatagggcagccaaacaccactgggttctattccttgtgctgtagtgtcaaattgcttggacaccccaggtagagctccagtgggacccagtgtagcatgggtcacagaggctatccctcccaagggcacaggcagcaactttggtggcatccacacaatgccatctctgctggtgcagagagctgtagtagagccctcatgaatgggattagtttccttataaaaaaaagactcacagagagttcccttgacccttccaccatgtgaggacacaatgagaacacaggcatccatggaccaggaagcaggccctcaccagacaccaaatctgtcagcaccttgatcttgaacttcccagcctccagaactgcgagaaaattccattgttgataagccacccagtctatggtatttttgttatagcagaccacattaactcaggcacacatgaaagctataaatcttgaaacacaggaatcatactcagggtggtgagatgctcagcatgagagaggcaagcaaagacccgcagagaacaactcatttctccaaactcctgttccctcccagacacacagtccctcaagggcacactgtcattgagatggaaggtaagtgaaattgctctcattaagttattttatcctgcccatcctcccacctttttttctagttttctctcatcatgaacatacagttgaatttgggtaagatcaattgtgtgtgattagacttcactttgtacaggaaaaaaatttagtgaactgtaaagccacagaaaatgttagttatagtcacatttatcttccattcctcttaggaccaagcacagttatgagccacaaaaaatacccagtaaataattgtcaacagctgacttgattttggcttgacattttaacattagattgaaaccttgcttaaagtgtatttataaagaaattgttattcatatgaacatgaaactgaaaaacctcactttctatcagttctgtaaataactcagttattgagaattgaaatgctcttttttttcaagtacaatcggatagatataaaaaggggaaaaatacaaaaaattataaaaatagcatttaaccttaaaaaatacaggtgcccaggctatacaatatgtaaagatacattcatatatgtaccctccaagaaatcaatcaaacattgaccttttatgttatgctaatggtttttgaggaaacattaaaattctttatattatgccttattttgagagtactgtcatatacaacccacataaacatacaaaccactcaacaatcaaaagcagaagaaacatttactgttttagcaagacatacaaagagttaatggcaaaaggaaagagagggaaaaaatcaccgcaatggtctgtgtttagaatataaagcctgttaccaaggtatacaaggaggagctggaaggcaaataaaggtgttcttggcagtaggtaaaattaagactatttaaagcacacatgaggtggaaatggcagaaaacattaatattacaaagataagttaagcaaaaggaacaactagtatgcaaagaaaggcaaaatacagagatgaatgaataattatgggtagggcagtaattattaaatcattgaaagtatgtaaaagaacctaagggttgtattaacaaagaagaggaagctgtatgtgggctttgaggaagtgaagcaattgtggactgtttctccatgtaaaactttgttcagtctcacagcactgaagaaaaggggcatcccagtgttgtaagtaccctttaccttcatgttccttttttcctacaacaaatatttgtgcagtagatctctgtactgaggatagaaaaatcaataagtctaggaaaggtaggtaacattttttgatgctgtatcacaggtaggaaaatttcccacactggtccatttatttgaccctcaaatgagtattctattacttatttaaataataaaggtagtgttttcctataagtacccacatgtctcttctggagaccaatgctgtgtacttaatttttcagttattttcttgaatgcagctttttatttgttttttgtttgttcattttgtttttttaatccagtagagtctttctaagggaggaaagaatgaaaacaaaagattaaaacaaaccagcatgctgggaatggtgttgtctgggatcctcagttgccctaccagaatctacccacagataaggttatatatgtatctttagaaatagtttaaccactaagttgaaccatggagtatattttcttatctgtaagatagaagaaaaaagaaaaacaaaaatgtcagaatatttttggggtaatgaattcactatttgttacattttggggacataatctgagttcaggaaagaaacctaaacaagacataaaattttgactatttgtttgtgaaagaaggaatttttagtaaagaaaattaaagtatatagcaatacttggcaaacatttgaacacacttgaagggccatgctcatactcataatcaaggaatttatttgttcacataatcttccgatattttctctggatagtttcactttaaaataaagtatttggagatagggtaggagagattatgcaaatgtatgaatcttaatgagaagttcattattgaacattttgatgtgaatttcaggaaacgataaaagaccctgggatttgtgagacttaaaagaaaaattccactcttggagaacttggaaattgccagtaaaagaactgagacccaaatgacagcagataatgtaaagccaaattgcattatgccctatggtaatgaataggaaacagggcactgtgataagcttggaatgatgatcaatatttggaacactgtgataggcaagaaggtaattaggcccattatgaacacagtgaacacagataacataacttgggaaattatacatttggatattatggagaattttttaaaggctaatggatttgcaatgatatcaagtaaagcatataagacattttgcctctaggaaatctacttaaaaaatcaaacagaaaattttcagtaaatgtaatctaaaatgaaaagacaaagtgaaatatgtgggagaataaagtggtattgtgactcctacttggaatttacaataattttgtattcaaagagttttacatttattaatttcacatcacaactccccatgcagcaggaaaggcgtttctattgtgtttgtccaagttgactgctcataataaggcaaggccaaattgataataaaagcaagctatcttgacaagttctcagccttcccaggtctcatgctgtgacccctggatggcattataataatcttgatccctaatttatgatgggaaacaatccctttattttagaaggaaggattgtaaattaattaattttcactaagtgccgtgagggccattgatgttattggaatgtacaaattaatacattatttattgttaatttatcataagtatttgttaattacaaagctctagctggaagaaaaacttgccatgtatctggaagtgaatatcttccctaagacaatttctcattttttaatatggatgtattggaagcaatttcatcaataatggaagatccaattactggtcttctggattaagacattcttttattgtgagatttttaatgctaaagtgggaagttcaaacattgccaattaaatctcagactaattaggtgattatagcctaaggagaagggcaactaagactccactattaatctatcttatcacaatggcctctatatgtgatgaacagatgaacatatatatacctgtgtcaaaagaagaaatgtaaggcattgtttgaaaaaacaatttcaggagtttaattgttttaaaaaaatttaaggagttgtttccctttttgaataaaaagggaaagcattttttatgaagtcctttttagctgtttgtagaacgcatgatcatatttaagaattcaatgatggattgaaccaaatctaagatttccctcattgaaatgtttagaggtggtacaaaagtgactgtgacagtaatgatcaccattgctttatgagcactcacgatgtgccaggcacccttctatgcttttcttatcctcaatatgatagctgagggaactgaggcacaaagaggttattaactcaagaagtaattagcagggcagggaatgtttggatattctacagcctccttttaatccttcagtattaaccactaccctctagacagttttattctcaattattcaaatcatctgcctgtggagaagcaacagcagtgctcagctgtaaggcaagggcaggaatccaagactgagtcagagaaactgaggtccacatccaaactatcctccaggaaggaccttctgtttcatagcatgttgaagtgaggctttctataatacctggaaggctggggcagcggtttctcagcatcttaagaatcagtttcatagtggcacctctccaactaggtggtagctctctcatgggcctcttgccaccctttttatgcctacaggacacatgggcattttgcctggcacagcttaactctttagtcttggagtgtgtttgtgtatgtgtgtgtgtgtgtgtgtgtgtgtgtgtgtgtgttcattcttttcataacgctgtatttttgggaatggagggtagtaggggatgtatcggaggattgatctgtgcagaagacatgaccctgaaatttccctctactctatataggaccatgtcaagctaatccttcatttggaaacagatggaatctttaaaagcgctataacatctttttaaaaaaaaaaaaatatgtggcatttttttaatgaggccacaattttaagagaaaatttggcacctgacattaagaatgtttttattataccaccttgagaataatttttatgtgagatccttcttttagcacccttgataattgtgtgtcatctgtttcatgaatcttgtgtatgttgagctcatgtttgtgaggggaggatccgttcttctcgatcttaaagaacatggacatagaagccacaaccaatatcgcatcagctatagatgaaaatatgaagagtcatcatattttaggataacttcaatgggatcaattggctgaggttttgattttgctaaattactcacttgaaagagacctcttcttgagacccctggttttagtgaaagcctagaaaaaaaaaatgtgatttttgtaaatggtgaggctagacatagacagtgaatcttctcattttaaaagctgtaaaattttctacgcaccatcaacctaaactgaaattggtgagagtaggagtagggaagagggattgaaagtggcaatttattgtactccacacaatctttacagggagggtattttattccaagtgttttgttggaatttaacactgatgcctttcaattgacattataatcccttacacagcaggtaaccttgaccttctgtaggagccctcaaacatatgaaagacatggggatccctggagaaggtgcttgtcagagcccccagttcagtcagttcactgtacctgtaaatccttataaggactttcctgattttggttctcttctctaacatgagtccctactctacagctacattctgtgcattctccaggaataaatagaattttttttccaatcctgaaaactccagagtccacatttacaacctaaggactcaaccaccctttttgcttttaatattaccatgtattacatccaatagagttaggttgtaatattgcccaacatcagttagtacttctactttgtgacttctatttatatagagtgaattaattgccaactctattaatcttgcaaaatccatgaatccttaatgttcagtttgcttagaatgaggaacagtgtatttgtttcttcttagctatgacttcttgctgagcttcacatgagctccttttagataacgtgccttctatcttggacgatttattcactttcatgttccctggaatttattgctaaacgttgacgtgaatgcttacagtttgggctctaatgtaatctcctgaatggcaattaataaataaaagatggttactattgctgacagagaatcagggctttctcagatagttttcatcttcatgttttcactaaacttcatgtcagacatccctaggggctgatattataaaatattttctgtaaactccaaagcttttactattgcttctatacacccaaacctctgtgatgccttttgttttcttgtcagaaatcatcttattcaatttctgtttcttcaacttatcttccttcctgggaatataaaaaatatgcctctttctggatttaatagtgacatatcctcagtatttatgacttgcaagtaacacctgaaatttgtccctgaaattttttgtatttttttttttgcttagtcttatctctgttgcatttattgaatatactctgttgaatttactgaatactgaattgcacttaccctacattaatagccagtagggtttataaaatctagtgtttattgtcatcctgtatattgttcaaagtgcaaagttgtctcctataagttaatgatgaaactataacgcaacatccaatttttgcagtttgcctacttgacgaggctccagggttaatctagcctaatattcttattttagaaatgaggacaatgtagggcagtttaagttgtttgaccataatcaaatagagggtgcagagcaaatacatctttagacagtaaagtacatggtacacagcagaaaagctggaactaggctgcctcggcccagctcctggtctggatgcttattaagtgtttaactttagacaagttatgtcaatgctgtgtgcctcaatttctgaatctgtaaaatggggctaaaagtagtaccagtagcacaactataaggattatagtaagttactgtgggtgaggcatttagaatagtgcttaacacagactaagcactccatgcattattagctattacgattattcattatgttgactatttttaacacgttcggatcataggtaaaggtgtgtattgctatttcacttcacataggtatatatatacatcagtgcttttttgtacttcttttgtattccttaatgctgtgtgcagctgctagtagtagtgttcatagtggcagtgataatagaagcaaaaatagtgatgatagtaataaaagatagtgccgtttattgagccttgctaggtgctagacattgaagtaggtactttacatacataattcttaataggtactcttgtctattgataaatgacacagtcgttttttcccagaaatgcaagtagacttcatgacagtagtctccttcgtaactggaaaggaacatgagctgtggccctggtggaaaagctttgactgtagagacaagagccctgatagaattccttctgtcttaaagataatcctgctaatattatatattatatatatatatataatatatatatataatgctgctaatatttatataacctaatcctgttattgataattgagagactagctgggggtgggaatggaggtcaaggaatggagtgggagggggcaggtagagggcaaggcaaaccgcacaaatgaaaaacattatataccagaaaagcaatgattcaaattcagttgtgctctatattttctgttttataattttatattgcattaaaaggttgcctcttttctagataccaaataggaatacattcagaactatagcatcgacacagaaaagttgttttctttcttgctttgcttgcttgattgattgattaaataaatggcagttaccatacattaatagccaatagggtaaggtaaagtgtttaattagaaaaatcacagtcacttcaatgttcttttatttccatgcccagtatgttccttactaatcatatgagcaaccatggcaatgataaaagctgtcaggtgtgggagtgctaggacgatactggaagagaagctctcgtcatgttaggtgcttggtatgtttgtgtgtgtgtctgtgagtatgcatgtgtgtatgtgggtattctcacatatgtgaaatcactctcattcacatacatagtctctataaatagctacagcctttcaaattcataggtgtgtgtgtatatgcctatagacacacatgcatatacacttctgcatagagagaaatgtacctatagtcatattaaattttatcacagctttagaaaaggaaacagaggctcagagaagtcaaaccacttgttcaaggttacaaaaggtggcaaagctggagtataaccccaactcccacccacttaacaccccttttttgggatgtccagacagaaatattcttagaacaatagcattacaccacactgccccattagaagaggggtgaccttttgccctttcttttccagaatctccaagcaaagattttggtccaactctgggtttgaaaaagtccagctccttggagagtctgcagactgcagtggccgaggtcaggaagaatgaccttccctttcacaggccccggccgcacatggttcgaggccgaggctgcaatgagagctttagagcagccattgacaaatcctacgatggacctgaagaaatagaagctggtaggatgatatgcttccttaaatggcttcttcatctcattattatctgcaaatcatgggcaagaatgtgtgctcaactacagaaaaaaatgatttaaggatcacaattatatttttgatattaaaagtaattcattttcctgatatgttttgccctttggcttaatgaacatggaattggagaacacaatatgcaatttattttacagtgcaaggctaaataaatgttctccttcacttttctacaaggaccaactgtcatttacccttagggtaggagcactaagtatgcatttcttgacattctcattcgagtcattagaggcagcatcaatccaaggactccgactgcattaattgggtagaagcagttgggatattttgtactcaaaactctcttctcaccctgtttgtttcccagcatgcaggctttctgagctgatcaaggttaacaaggcagctttcagagagattagtgcttgaacacatatcaagcctttcatactaccagctaagcaaccggttgtccccactcccagcatcaagtcttgctcgaagtaaccagatttaggcagtcagatcttcaaagggcgcacgtaaccacatagaagggtagaactacagagtgctgttattcattcttttgcattttacatgttagcgtttctctgtatactaactgagtgtgcccctgaccatgggtattgattattttttctctgtacagacggtctgtctgataagagctctcactctggccaaggagctctgaattgtgagtctgcccctcaggggaattcggagctagaggacatggaaaataaagccaggaaagtcaaaaaaacgaaagagaaggagaagaaaaaggaaaagggcaaattgaaagtcaaggagaaaaagcgcaaagaggagaatgaagatccagaaaggaaaataaagaagaagggcttcggcgccatgctgaggtatgggcctgctttgaaggcaaagttggttctcattttgtctctcctggtaaaatcactcctttgtctgtactcagaaaaaagcgcacgcttttcctcgtcttcagccaaatgcatacggctctcaattctgtgctcgttctctttctgcagaggcagaggagctttttggggaaagttacagtgatgacaggacactgtcttaagtttgttgtcaaagaaaggtcaacactatgccaggcacggtggctcatgcctgtaatctcagtactttgggaggctgggaggattgcttgagcccaagagttcaagaccagcctgggcaaggtagggagaccctattctttttttcttttttcttttctttttttttttttttttttttttgagacagtcgcgctttgtcgcccaggctggagtgcagtggcgtgatctcggctcactgcaacctccgcctcctgggttcaagcgattcttctgccttagcctccctagtagctgagactataggcatgcaccacaacgcccagctcatttttgtatttttagtagagtggagtttcgccatgtgggccaggagtcttgaactcctgacctcaagtgatctgccttgtctgccttggcctcccaaagtgctggggtttcaggcaggagaccctatttctaagaaaaaaaaaattagccaggcacagtggtgcatacctgtaatcccaagtactcaggaggctgaggccagagcatggcttgatcccagtagttcaaggctgcagtgagctatgattacaccataaaagaaaggccaatacttagtagaggcatggacaatgcctgcagtcctttgtaccaaagtgttatgaaaataaatacttcctctgacaccacagggaaagtgggaagtggggaagccctatgtgttacctctggaatacctcttttgaagcaggggagtcagggtagatgaacctcatccctctgtgactctaggtgtgcagtggccgggcctctgggcacatcacttgtcacctccagaggcactgtggtacaggggagatgtcactgggtctgggctctgatgcccaagtctggatccatgactccccacacatgagcaatggggcttcacacacattgcttagcttccctgagccttactttccttacttttaaaatgaggccagcatacttgctctactgacccagcacagttgtgagatatgatttcatatgctatacattcattgactagacggggctcaacatggcacagtcagaaaacagctttgtttcttctctccccttcaagtataaactgttgaggctgcctcttccacaccctgacatctcagctttctggctgatagctttctggtcacttttgggtaaaaaaaaaagcaacttgtttgtcgggggctaaaatatgcaatccaatataaatgaaagctttcttcctttctgcctgttggacctgaaccacaaggagcatcctatggtatggtgggaggcaggattccaccttctcctatttctcagtctttggaaccaggagacaaagacaagattcaataggataggattttacttaactggcattatctggtataatctggccatcaaggaatctttgtggctacttttgtggattttttagagtgctccttactataccagtcactaatgtaggtgattttcccactgacctatttccctaagcctctgacctcagacatatacccctgagtctccttaccccggctggtagacttcttggacagtgccagtttgagacagctctagcttaacttacagccacagcatctacctggcttattagagttcctgatctcccaccctccaaatgatgcaagtacagcttgttcccactgtaccgctcctcctcaccccaccatagagatgttccaaccagccttgcatcttcagacttctccagcacatcccacaccagctctgggcctcctcactccagaagcacacatcagactctcccaagaatgctgtcatgcatggggaagggaggaggcagtcaatttttgcaagtcacaaaataaacaggtaggaagtggggtgacaatctcctattatacaattacctccaaattccctaaggggtttacttgtagccccctcacttattttgttgggtgttacaggcagaagtacccctttctattactgtctttactcctataatttcttctcaaatcaattgatcactatacttctgtgggctgaaggtgaatgatgggagatgatggtttaggggccagtttggccacctcttatgaaacccttaggagatacctcatttaagaatgctgcgtgtatttattaccaattgttctcattttgtgatcatcagctgaaatttctacatagaaaagaaagttccatcattccatatataagtgacatttagggaatacaaataatcctcttagcagtgagccttcccgttacatttccagtgctcatgaaatgctaagcaaggttcctcatgctcaaaatcttgggagcgatgttgcccctggatgtgttatgacaagacttgctgcggtcctgctatcacctggggtgaggttaccccagcaggcctgatgtcataatagctatctgaatattaaaaaacaaaattttggccaggcatagtggcccaagcctgtaatcccagcactttgggaggccaagacgggcggatcacctgaggtcaggagttcgagaccagcttgactaacatggagaaaccccttctctactaaaaatacaaaattagccgggcgtggtggtgcatgcctataatcccagctactcgggaggctgagacaggagaatcgcttgaacctgggaggcagaggttgtggtgagccaagattgcaccattgtactcccgcctgggcaacaagagcaaaactccatctcaaaaaaaaaaaaaaattcagctaggcatagtggctcaggcatgtaatcccagcactttgagaggctgagatgggcaaatcacttgagcccaggagttataagacaagcctgaacaacatggcaaaaacccatttccataaaaaaaggaaaaaaacacaaattagctgggcatggtggcatgtgcctatagtcccagctactcaggaggctgaagtgggaggattgacttagcctgggaggtagaggatacagtgagccatgatcccttcactggactccagcctgggcaacagagtaagaccctatctcaaaaaattaaaattaaaaagaacaaaatttcagcaaattgagttctaacaattgaattggattttattagtgattcataaattggtccacatcccatctacagaatagaagggcatttgagtgagatgagcagaaggtgtgagcttcataggcagaaaaagactgaagaaagcagaaacaaggaacaaaaaaaggattgctcatttccaaattgcattccttatagggttaaagtagagggactttatcattccagctcatgtcactggtcctcctttgattagttgctgggaatctcctatattttgggaaactgacccatttctaagttcagtttgattatgtggcatgtagcatgagtgactccattctggtttggtctggtctgttgtggcctagtgcaggagctcaaataatggcctcccatacattttattgaatatgatctatagtatagtaaatgccagattgggacagatgtcccaatagacattcgtcctgatggcctctgtagactctgtccttccagttgccattttgaattttaaacttgcccatattctagataattattaggattgccagaatttatgaactgtgagttaaccatcttgatgataatgacaacatgtaattgcaatatatttagataagaattttgtctttgaagggatggagttgagaggtgaaaattacaggctctgcctacagactttctgagttcaatcctggcttctctaattttcacttctgtaacactgagcaagttctttaacttctgttgtctcagtgtcttcatctgaaacatgagaagcataatagaattatcatttttatgagaatcatattttattagatgtaacatggttagacctgtgcctggcaagcaataaacattcaataaatgttaattattatagtaaacataataatgacccctgaaggtgtctgcatcccaacccccagtacttgtgtaaatattttgttacatgacaaaggaaaattaaggttgcgggtggaattaaggttgttgatcagctgacctgaacataaggtgattatcctgcattttccccaatatacccaatgtaatcacaaggagccttaaagtaaaagaagacaaggtgactgtggaaatgaggtacagagaaatgtagtgctgctggctttcaagatggagggaggggaccatgagccaaggaatgtaggcagcctctagaaactagaaagggcaaggaaatggattctctctggggagcactagaaaggaatgcagcctaacaactccttgaacaccttggttttagccctgttgtgttctttgaaccactgtttgttgtaatttcttacagcatcaaatcaaaaactaatatagttatcatcataattacttttactacttttatgatatcatagtaatgtataaggaagagttttttctttaaggtgttaacgaaaaacactattaaaatatttaactaaaatagtctgtaaatataaaaactgttagagcttcacatatcccattttctagaatattactaaattaaaccttaactttatattttatttcagatgatttgatttggcatgttcatacttcattgcccataatacagtgctggttcttcccttttattgtcccatatattctgtattttcatgtagtagaaatcacaggtcctggatcctttagacatttagcacctcgggctttgtttctttccacgattttagcaaagttaagatctgaaaggtggtgtttgattttatcttctgtgtaaaaatagcaactgttttccatagccttttgcatctgagtttgtgagcatattggagttactgctacatgcacattttcaacaacaaagaacacaaagctgttaccattagccaacagattttgctttaattctcatctgttgctcagatgctattgacttagtttctttcttatttaaaaaaagattgattgctttaaggttctcttggagttagatgtgtgttttaagtatgtattattttttccgttatctgcgtttctcagatgctctcctgaagatagggtattgggatgggtcatgcagttataccatgtagaatggcacctggccaagggggtgaatgaagatttaaatcctgcctccctttcctcaccaaggctggcatcatgaaaatgtgaatgccttagtggtgttcttgttcttgtttgtgaaaagctaagtgtttgcacttttctgatattagctggtccatttgtgtcaataatatgtagtagcacagtttaacttcttaatttaacctactcttgatccttttgaaaaaattacagaggatgtctttaattaatatctttatacatgttgtctaattccaatatgcttatactttgttgatttcagaattatctccttgcatgattcaagtgtgattcttatatagaccatgaattattattattattgtggaaaaatatgcagctcaagagcctaccaattttgtagtttctctgtatgctctgtgcttaaattttttcattatatgtttgagttccatacatattgtgctctttatggcactaacctgcagaaagactgttcatgcccctttcagccaaagggtgaagctccagctcctttaaaagacaagcccattgctgtcagtcctaggccaccttcctggggcctagcagatttttctaggagccaaagagaaatatcctttgacaaagaaaattttaccttgtctaaagtggaaaacccagagattagtttctgatttcttacttaataaccttgtcaatccttatgttacttaaactaaattctgtcatagatttatgttcaaatccattttttttatataatagctgctgttgtctctttttgatattataggccactcacttcaaaaacctttgaactgtcaacttattttggacactgaatggaaaggtttgatatggttcagattcccttatctacaacttttataaaatttgatcctaagaggaattatgccttgcaaactcctttttactagactaatgaagaaccaagtacaaacgctgccaataggaacttcatctttgcttttaaaatgtgtttgcccatatcatttgattagtaacatttattgaaagccttgtctttgccaagcacattcataattatttttatgctatatctattaatttattgtaatcaataattaaacttatcagttaatttattaaagccctattttgtatcaggcactgttctaggcacttgacacacagcaaccaagtcctgctttaacagcacttttcctgtcttaataaaggaaggaaggataaaaacttttgagttcattgtggtgagattaaaacaaaaacaagcagccaggcatggtggctctcgcctgtaatcccagcactttgggaggccgaggcaggcagatcacgaggtcaggagattgagaccatcctggctaacatggtgaaaccccgtctctactaaaaaatacaaaaaattagccatgcgtggtggcgggcgcctgtagtcccagctactcaggaggctgaggcaggagaatggcgtgaacctgggaggtggagcttgcagtgagccgagatagcaccactgcactctagcctgggtgagagcgagactccgtctcaaaaaaaaaaaaaaaccaaacaacaaaacaaaaccccaagacaagcaaaatattacataaacatgtaaactatttgtaacagtggattacccagggagtgaaggggatattcactagatatttcagggacaatccagtaccccatcagctcgagggaatcaatggtcaatttacatggtgtcaagcaagacatccaggccatggctctcacggaatttacattccagtgaagggaagagaataaacaactaatccaaaataattgatacgattccaaattgtagtaggtgctatgaaaaaggtaaagcagaaagaatggtgtcatcccacccttggtgacggtctaacagcagaatagagtgcacactgcacacagcccaagctacactgaattttcagcagatacgttatcagaatttagcacactatggtactaaagccaaatcactttatgcctgcttttgttttcttttttgcaacttataaatatgggaaggttatttttaaaccaactccacatagagctataacaaaaaactaacccaaactgtgtctgttttagtacacaaaaccctaggatacctgcagtacacattctaagacaggtgggcattaatgtaaatggtgaacttggtttacaggtgattggatcaactctgttcctcctacctcatcagctggatattctttattgtttcttctcaactcagataatgcaagcatacctcaaagatagactagttcggttacatagtggagcatcagacaaagctaaatcatgaacccttgaggcaaaggtatttttaacaatctagaggcatcaactttttgttcctaagccttacagattttaaggcatatatgtttacttcattttattctaaaatatactatctattttatttaaactaggggaattctatataaagacatcctgctgtgaattattttaaaaagaacactcctacacacacatcacacctaccactaccaccacaaacaacacaccaccaaattagccaaattaacactgaacctagttaaaaatctgtcccttagaagctctgtggccttcactaccaccaaattaatgctgaacctaattaaaaatctatcccttacaagctctgcggccttcacgagtccctttgagtttcagtcacctcctcatcagcaaactaagtataataacacatcctgtccaggttgttgtaaaatttaagttaaacggtttaggtaagcaaagctgtcagtgtagtgcctaacttgatagacattacttcttatccatctatctatctatctatctatctatctatctatcatctatttttcattggaaagtaaaaactgtctatatatggtatgcaacatgatgttttaatatatatacacaatgtggaagggctaaaacaagctaacatatacattacctcacatacttatttctttcatggtgagaacacttaaaatctactctttttttttttttttttttgagacagagtctcactgtgtcactcaggctggagtgcagtggcgcgatcttggctcattgcaagctccgcctcctgggttcacgccattctcctacctcagcctcccaagtagctgggactacaggggcccaccaccacgcccagctaattttttgtattttttttaatagagacggggtttcaccatgttagccaggatggtctcgatctcctgacctcatgatcgcctgcctcagcctcccaaagtgctgggaaatctactcttttagcaagtttcaagtacaagacatattgtttttaactgtagtcaccatggtgaataatagattgcttaaatttattcctcctgtctagctgaaagtttgcatcctttgaccaacatttcttcaacccctccatagcctagcctctggtgaccatcattctattctctctttccatgagttcgacttttatacacctcacatataagtgaggtcatatggtatttgtctttctgtgtctggcttatttcacttacataatgtcccccaggttcatccatgctgctgcaaatgacaagattttctactttttaatggctgaaatagtatttcttcctttctttctttctttcttttttttttttttttttttttgagacagagtctcactctgtcatccaggctggagtgcagtggtgtgatcacagctcactgcaatctccgcctcccgggttcaagtgattctcctgcctcagcctcctgagtagctggggttacaggtgcctgccaccacacccggctaatttttgtatttttagtagagacggagtttcaccatgtttgtcaggctggtttcaaattcctgacctcgtgatctgcccgccttggcctcccaaagtgctgggattacaagcttgagccaccatgcccagctggctgaatagtatttcgttgtgtgtttataccacatttctttatccattcatctgctgatgggcacttaagttgattccatgtcttggctgttgtgaatagcgctgcaattaacatgagagtgcggatatcttctcgacataccaatttcatttcctttaaatacctaatggtgatattgctggagtatatggtagttctttttaaatttttgagtaacggccacactgttttccatgatggctgtaataatttacattcccaacagtgtagaagggctcccttttcttcacatccttgccgacacttatctttcatgtttttgttaataaccattttaacaagtttgcagtgatgtctcattgtggttttaatttgcatttccctgatgattcgtgatatcactgagcagtttttcatgtatttcttggctattggtatgtcttcttttaaggaatgatagacattacctcttgtcttccccctctggctccacttcagacagccaagaccgtcaaatattacctttgtctcaagcaagatacgtttggaacccactaactttttctttcagattttagattacctctaactgctgttttgtaatgtagttgggcatgatgcctattctctagcctagcataataaactacataaagaaaagaaatgacatagctaaaatcattcaatcatttatattttataagctttgggtcacccctttctcaatgtaaccatgaactgttttcaaaggttatttaatcacttggtgaaaagcaaaaccttctattgcagaatacaaatagaaagggtctcaaaaggataaaacagttttttgttttgttttgcttttctttctttctttatgtatttcagcccagagtgtgtaggtgggtttggacttggtattcttaatgcgtggctcatagttatttcatcaggctgctctgaggttgtcctgtaatacattacccataaagatacattttgacttggtttttaaattaggttagatagagactgaatacttaagtcaccagggaacatgacatctgtcatacatttctcctctttaccttgatcccataacagctgttacaggtctcatgtacaataaatgtaatgtggccgcagcctgtcattacctctttccagatagtgattgtaaaatgcctgggtatcccttcaactttatgggtatgaagggtaactgagccaatgtagccaggccaatgaaattttaacactcatttccccaaaggcaaaaggccaacaacaggctagagttaaggtgctttgcttcatgaagtagaggccggtttgaaacatgaaatttcagatgaaaaatgaaagccaaagtgggtcagagttcttaattcaacttcaagctaggtggagaaatacattgacaacagagagccttacagatcagggtaagacggctgcatacactgagactgagacaaatatatgaccatggcaaaaaatagaaatttgcatgtcgaaggccaccacccatgcagccatccattgttctccatggttatctacaattacagaggaaaagaaatcgatgctaaaccatgttggaattgagttaggctcaatttttatctctttggtaactctgaattttctctcttcagcccatcttaaattatttactttctctttcacaatgtgagccatgaatattttgtttcttcattttgttaatttgccaattttcctttgagctaaatgccctagcaattttaatttttcattcgggttggaaagagcaatgacccttttttttccattattactatcacaggcctgggcccagaatactactttttatgaccagcagtgttgagcctataatggaattgcaaagtagagagtataatatactgatattgacttgtgttaaacccagtggtgtgatcactgataatatttatatgtttatgtgtatacatccttgcttttgttggcttgcaactaagcaccagagagaagaactagaaccataatatggatagattgtgaacatgagaatgtaaaaaaatgagagagagtgctatgtgaatagggcaagtgatataaaatgatggcgatagatgcaagtatgataactaaaaagttaagtatagattaaatttagatcaagcacatttaggattgtttggttggcatttatttcttagctaaaagaggacccagagacagatgggctactcatctgatgggctgagtacaaagacagatgagctgccgtggcacccagcacacagagttcgcttaatatctgagtttaataatattttccagctgtcaagcatatctgcaaatgtttgtttatccttctgttttttgagcacatgttcatggaggggcaagggcatggatggggttaattggtatgaaaatgtacaggaaccttgttttcaaaatcatttaaaaatctgattgctgctgccatgccttcccctcctaccctatgtaatcttgattgctgtgcaactctgtttacggctgtccaaagcggtaaaatgattttgtcatacttatcacaataaaaaatgaccacatagagtgtcaaccaaaaggcttatttatttgattcaaactctcttctcctaatatgcgtgcacagctcccattaacgttaatgtgaattacaaagaacactgaagaaggatagacccctttatctcattacttttcttggataatgaggtttagatttgttaacagatcagaacagaagtccagtggataaaatattggcttaacttttaaagaaatggatatgctaaaaggaactttcataggcactaaggtagaagatacactttaataaataaacttcattagcatttgaggttaaatatgcttatttaagatgctggattaataaaatgcaaaatatttcctaatggacctatttgcatactcatattaaataactaataaaatatattaatgatagttttattcatatacatgtaaacattcctgagttcctggtgggactgtatttgcctaatttacattgttccgtgtccaggtcaatgtcatgtccttgtgggatgtttacttaatactattagataatgacatgtatagatttaataatttgcttggggggcaaatggaatccgttctttgtttagtaccttttatctgagaacttcaatgtaatttactaacatccatcttcaagatgcatgagagatgaatgtggcaaatagctttgctttgcgtataataaagaatgagacactgagaagtgaagcagcctcccgagagcctgtgaactgatagtgatacaaaaaccccttttgacttttgttcctatggtgtcagcatctaaaaatgcatggacaccaaccacgcttcagtgtatactttcttacactctgtagcacccatacttatttttgccatccgttggattttcctgacaaggcaacatcaaaccagcaatttagtaacatgagatggttcctaatgaagcaaggagacctgaatctttgaaataataactgtaactgttttcctcacagaatagaaaagaggtttcccagaacaattaaaagcagataagagatacatacattgaaaaatagataggagatatacaaatatttcattgcacattgaggactattatctcaatcctgctaaataatatccaccaggattttggagacagtccaattttgcttctccagctaactgctgatcatttctgcacagtggccctgccacaacctcagcttcaacatgtctaaaatctaattcagaatctacccatctaagtcaccagctcatcctgactctcccaattctgtttgaggcactgccaggaatcccgtgatgtccgggatgcctcccccttcccatctccacccttccgtcagtcaacaatcttgatattcacaaaatactgtctcttatatctggcccttcttttccacttccactgccaccactctaattcaatttgtcattgataactggattgttgcaataacttactaactgatttgcctgctttattcatttcttcattcctgttcattctaggcatagctaccaatcattcgtttgttcagttattagatatttaatgaatgctttccacacaaaaatgcaatgtaacgtagtagcaaagagagcagctctggaactattctacttaggctcaaatccagctctacttccttctagctgttagtctttcatcttacccactctgtgcctcagtttcctctcttgtgaaattgaaataatagcatctacctaatagagtggccccgagactaaacgagataatagatgataaatgtctggcacatagcaagttcttaaaacataatccattcatagtattctgccttgggagccgagatgtttcccagttacctagtggttctcaaagtctgtctgtaccctaggatcatctacagagcttgttatagattcctgggtttcattatcagagactctaattcattaggtttgatatgaggcctgggaatcgctgatgattgtaatgcagccagtcccagggacctctagaaaaatcatactatttagtttggcattcaatgccctctatattctcgtcccagtttgtttgtttgtttgtttgtttgttttagcgtttctctctccaactttccactctaaccagattattcactcttactctcttcactgttacccaaaacaagctttgtgaagccttaagataataccatcacttagaatgaccgtcttcccctgaggcctgccaggcttctgaaagccacctcaagccccatctcctttatgaattctttgatttgcatttctctccttcccatcaaattttttcttacagtctgagtttttccattgagtacttcctgtaggcctgcttggtttttagttttgagtttacacatctgtctcgtgcccttaatgaaattgtaaattcctctaagcagagggacttcctctgcaatgtttttctctgttttggcccctaataatcttttgctgaatgactgactggtttatatggtgtgctaattggagtagatttatttggatattaatgtgttgtgcccctttagtcattcttggtaatagtattgaaaataatgaaaacagtggaagtggttcaaaaataagaaagagggtgagctgcattgggagttaattatttttttttaatttctgcttgaagaaaaggttgaaggatgagttaactggcaatagtaactagctgttctccatttccactgaggacagtgctagagaaaatgggccaaaatcactaacgggaagaaatgaggttagatataaaaaagaagacagttcttaagcactggaatgaggtttctgaacaggttgtagaattgacctccctgaagtactttaaaaataggaaggataaatatccatctaaaatgatatgaaaaagatttgccaatcagctcattatttgaatatctattaagcactactctctgggaaaacccagaaaaaaatgtacaacatgatccttttacttaaactccgtatctaattaagatgacccataaatatgaaatcattagcagtgaaaataggatttaaaagtaagagctaaactgttaggttatcaccataattggagtttaaattcggatatgtgcccttctctacctctctactcctgaaaaacctactccaggcctttttttcaatgagtgaattttcagtgtcctctttccaacagcatttctaggtaaaatggagaaatctctgatcttttctgaaataagttattcaatactattgagcaaacaactgctaagtacacagcaagcatgttgtgataaatatgaaactaatcttttatttttttctaacatcgtcttttattcatccaacaaatattgattacctaataagtatagtcttagtacttggttgggagataccacagtgaacaagacagatgtcttttcattatactcaaaatctagtgcccacaacctttcctcaaagtgtggtagggcatataagttgtaatattaaaatgccataaaattgactaaacccctttagataaccagagcatccttgaattacataaatgatggttaaaccacttgcagtgtactcagtaaagatactgaatagtaagatgtctggatttccaaccttaattctgtaactgccttcttgaatgaaagtttttcttcatctggaagatgcatacttcttacctacctgcaatatgtgtataaattatcatcatggtcatcatgtatttggtcactgattgaaactgattacagggtagatatgtctatgggctaaaatagaatgggattggttagctggaaagtcagtttcacaaagtgaaatggcactgaattcaggaaaatagaccaagactattaacttgtcaaaatggaaaatatagcctttaaatatagtcatacacatggtgccctttggtttgaattagggtaaccaactcatcccactttgaacactgaaaatctcttccccaggaaactcctcagtttaaggaaagtgggccagtcgatcaccctattctgcatacccaattttatctgatccttcctctctcttcttccttccctcaccattctttgtttacatgccagtgtatatagtcataaaaattctctgaaaaataaaatgaaagttaaaagtaaatatttttaatgctacaaatttaaaaaccatatacaacaaatttaaaatgtatatgaaagagtggacagtataaaaggaagcttgagtgaacttttctgttatctgagtttttttgtgctttctttaacttgagctgctgtctgttctcctaaggctttcttggtattagaaaaagccacatagctctggaaattaaagtagaaatgtctcagcagagaataactaaaagcagcatcccacttgccaacaaaagaattcttaaaaatattatataattcaaaactcaaaaaagaaagagctggagggaacatcgaccagaaataatggttgcaactttgattgcagacaaacccaccagcgaacagtaaaaaccctaattctagggcttttggtatgaggttcctcccattgataggtttcttctcccccagggactgtaattttccactttaaatttgaactctagtcaatgtatagtaaaaaatcaatatcatagatttgttctgctttctttatgcctcctggaattttcaaagtatgggaatgaacagcttttatgaaaaagatggactataaaatgaaagatggaggactttgaccaatttcctagacctttgacccagaaacactataccagaccaggatgtcattgtcccctccctagctctgtcatgtctttgttattcccatactatgagggcattaaatgtcgagtgatatgacgactatcgcacttttggaaaggatctttgacaggttaactagaacttgctaccagaatatttgtcctgtgtatcctaccttttcattttaattttactttgctattttcaatacagcttctttccctatattgtgatggggagagggagaaactcacagaaaactaaagggtaatccctttagcatttaacatttatacaaacaatagttcttgcattgttaaaaacgagcaaaggtgccaaagaattattccaacaaatgcagacatggggacatggtaagtaattctcatcccctgggctgatcaaactccctttcctgagagttgcaatcctttgatcagccttctaactccacctcacccagcatcttagtgtcaacaacaagctcaggccacactttatggagaagtcatggccaggcctgattcctctagactggcattagagctagtctggatcatcttggtattttccaccatttttgtcatcacttgaaagacaagaaccacatcttaccatttttgtgttctcctcagtacctccgcctttgccacattttcccttcctctcatatcctctcacatatatggcctcattttcaggttcctcctggtcctctgtgaactaaacacagagacagattgattttcaatagcctctcccgtgaccttggccagcttggtataaatgctttctacatctggcatctggtcacccagctacagaattcaataaaccagtagagcactgagcaaccatgcctcttaaacaaagcactacctccctagcatgtcggcttctactctggaatccgctcccgtagcattgcctagaatcctcagtcctgcatgagccccactctgaagtccatgttcttagactagagcactggcatagtagagcttgcttatttctgatgggccatctctagaacacttgattctgtctttcaaccctatacatccacagttgtaggacctttttctttgaaccttgtgtatcttatctgactttaaagtatttatctgtcatttgccttccttactgctatggtctgtgtagctggcagagtatacctggatggactgcttctagactacctggctgacctctctaagtcagcctctgtgcttttgtgtgattttcctcgccatttttcatcctggttagtgggactctatctaattcccttccccagtgattctacaatgttgggcaccaaatttgctgctgttcttgccttgctcatagtgtacattcaacaatggattgctgagctaattcttgattgtgagaaatccattctggaaatagtaactaacaatcagtttttacttacagctgcttccataggctcatgtgacattcaaatgacaattaatgttttttctcctgtagttttttttcttttttgcccaaaatatttattttgaaaaactcggccgggtgtggtggctcacgcctgtaatcccagcactttgagaggccaaggcgggcagatcatttgaggtcaggagttcaagaccagcctggccaatatggtgaaactaaaaatataaaaattacccaaatgtggtggcatgcctgtaatcccagctacttgggaggctgaggcaggagaattgcttgaacccgggagatagaggttaccatgagctgagatcacgccgctgcactccagcctgggcgacagagtgagactccatcagaaagaaagaaagagagagagagagagaggaagggaagggagggaagggtgggggggaggaaggaaggaaggaaggaatgaaggaaggaaggaaggaaagaaggaaggaagggagactcaaatattaattctaaaagagaggaacaagtccttgaacactaccttgatcactggaatctctgctggaaggaaccctcttaattttggaaataatatgtgttagaatgtactagtgagctctgctcttcagttttgcattttaagtgttaaactctaaatctaactgtctatcatgttttattccataagagacgtatcagcacatagggaaatagtggtaggttataggatgtaatagaaattctaatagactgtttaacaataatatggcaggcagatgccattttaatcagcattgtcattaacaactatcaatagagaggataagatgttcttctctttgtgaattatgatttatggctggcacagcagtcacgctgaagtatatttattttacaatatagagacattgattaaatgcacatggcatctcaaatccagttgacattttaagtcaaaattattacagacacacagccattcatttaagctgttgctttaaaaatgtgtctcaactgattgttaatggaagaaagtctagctgggccaatatttcaataacttgttcctttattttgctgatatacatacactgggggaaagctgcctcttttggccataccatttctggtgtataggcactaaagagaagaatactctcttaaatacatacactcagggtttctagaccactcagaaagcattctcttactagtgtaaaattattttttgttccctttccatagttctccctaccttctctgaaaatcttgctttctagcctaacaatctgcttaggaagtaggtcttaaataattgatgataactgtagctaaaacattaatatagtttagagatgatagtttttgtaatatatgttgccaatagaccagccacattaaacaataaaagtgtttgagtattgattgttgatttacaagattgaaggaaatagtaattgtgtctgagagtatattctttgattcattttcttatttatgtctttttaacctcaaaacttagatttttttaaagtttgtattatgaaataattttagacttacagtaaaagctacaaaaaatagcacaaagaatttccttataccttccgcccagattcctcagatagtaacattttttctgaattagctgtagcattctctctctctttctctctcttcctctctctctttccctctctctctctctccccccgcccatatgaatgtatatgcacaaatgcaggcatgcatgcatttttctcttaataacttaacagtggttgcaaacttgatgtctttttatccttaagtgtactttgaagctaggactatcactgtatcattttattatacttttgagataagtcaagagttggcctcaagtaaacctcaaaatagcaaaatcagaaattacaaacaaggaaggtggtaatttcaaatatgattacaagtcaagaaaaccatttttgtggggtttatcactatctaatctaaaaacataaattaagtcagtgttgactcctggtaaatgagtacagatttccaagagcgaggtgtacttctttgacaattaatgaaacttcagaagtaaacctctgtaaataggtgcaaatatccttgtgataaagcgtcggtaaccattaaatttggtgcagagtgcttgaatgaaatggtgaacaggaaaatatcctgcttgttattgttaaaattgtgctgcagaaggatccttagaaattgaataccatctctttctcagacttgttatattttccattttactgcaaatgatttattgataagactggagggaaggctggagaagccataccagtctttgatcaccttaggactttttcttttcaacacctattcatttgaaaacatattttgaaaacataaatgcacaaagataaatgtattatgaaagttatagtggattcatccaagaaatttatactttgcctagtcaggaagagtggtctggagaaacagagcatactctgccagtctttttatttacatctgttaggtagttggggtgtattatgttggagtgaccactccaggtcaaagtcttgtgtcttgggaaagaagatgaagcacagtaatacaggttaggtgtagctggtggagggtgttgggatgcatatctgttgaggaccagcactttattaagtccccaattccctgaacattcacgccagctcttacaaaaaacaaagcagtagtatccatgtgtgttcctcatcgctggcctgtcccaaaattttatcaatgtgatgataacaacactcgtgcacatgaccacatattgctgaatttgtccatatagctaactggagatagtttgattctgggtgaaacaaacaaacaaaaatatgaaggagtagtaacgttctacagaatccttttcttccttctctgtgatgagatttaattagatagagctgctgaaatctgttctgtgcttgtgagttaaatatgtctttgaatgtctgtgccccaaatatctcccatgtaaaatataatacaactttatgaagcactttgaaactttcagccaaaagaaggaacgtgtgttgttatatcattattaacacctcttttttttttttttttttttttttttttttttttttttttttgatggagtcttgctctgttgccaggctggagtgcagaggcatgatctcagctcactgcagtttccgcctcctgggttcaagtgattcccctgcctcagcctcccaagtagctgggactacaggcgcccaccaccaagcccggctaattttttgtgttttagtagagggaggggttcatcttgttggccaggatggtctcaatctcctgacctcatgatctgcccgcctcagcctcccaaagtgctgggattacaggcgtgagccaccgtgcctggcctaacacccccttttaacattgttaaaattaaacaggtagatagcactgtaagtgttttaagaatgtggatatgtcatcacttttacagcttaactgtatgctatcagggttaatggtaaagacaatgtctagaaaacaaaccttatgtttccatgttcttggagaatccacgtgcagttacacagtattcatgaagcacatgtagagctcaacttctaaggtacagtcctgagattacctaaaaattatgtacagaattttaattatgagtatgtgtatttttgtggagaaagaatccataatgtttttctaatacgcaaaggggactatgaaaagaagctaaggaccattagataatgtaatctagcctctgtagactattgatgttccctacctgacaagtggctgatgttcttattcagccctctgattctttccactaatgtagtcaacatttagccctgaaggatacaaatctctgtcatgggagtaaaaatgtaaccctctgtggaaggaataatgagacataagagtgtctatctcaacacctttcatgtctcagggacatcttcgggataaatcctggtttggagataagtgcagtgttatgtctactgcagaagggtgtttattaaagattgtcttctttctagtactctctagctagatcccatcaagtgtaaaccaaatatagccctccccaacataagaattatgtttgtttttggtgaagacttttaatgtttgtatttacccatgcttttccaggatatcgtcaatgctgaggtcttctctctgctgtcacaactcagaccaaggaaattttaagtatgtttagatactttcttgagtttcataccccaagactgtattacacaccttcttttgtcaggggctttacagtgtctaacatagctaggctgtaatatcatacctggccattaggtgttgctacgtcacacactatgctgcaaactgaaaaatgatttagtttagaatttaagaatctgtaaaataaattcttctattacttttttaaatttatacatttaacatctttaatataagtgtacttgaagtaagaagtgggtatgctaaaataaataaaatatatagataaaggttacccatataatttcagtgtgattgacaatttatgcttagcctagtagaacaacactcatttttattaaaataaaagattaatacttctttaaaaacaaggatgtcctatttgatgcaaattactgttcaagaaagtaactgaaatttcctttcttgaaagggcaggccattagagatataaatagagttgcaggttaatatatcaactttctctttaaaattagtaatgtttaaaaataaattgtttcatttccacctagatcacttcctccttcttgacactattccagctgtcatattctgtgatattgttctctcagggcattcctgttagctttctggcagctactcctagctattcatcttattaaaagttgtcattccctatacctctatacccagtcctcctctcttctaaccctcctctctctttctctgggagagaaagagagtctgtaaaccagactccacccagactctggactcataatacatgatgcttactaaacggttttcccagatggtccgtaggtaccccaaaatcaacctgtatattatagaattaactttgcttgtttatccttaccaaggctatccaataaatcaagaggatgctgtgtccttttctctcacctgtgaagaccaatccatcaattcgttaccaagttccacaaattctactctctaagaatctaaattctctctccatcttcactgcacttccttagttcaaattctcctaatttctccccaaattaaagcaatgaccttctgaatagtcttgatattctctcccagcccacttactacagtactgcccatctgatcttcacaaacatatatttgatcttctaccaaaatttttgctgtggtttcacagtttcttgaagagcttagatttctgaggtgttatacaatgttcaacctttatacttttatgctgccatagataagtacataaaattatcataatgtgccatgacagcattaaggtagtcaatgccttgggcttttcatattccctgtgactacaatgccctttccccatccttcaatccacactaaccccgtggtcaactcttagtgatgcttaaatgctgggttcaagggttctttggaagccttgctgacaacaattctctccacactcagtactgataaagatagtttactaatatcatctcattgtttattagtagtagtagtagtagtagtctcagagtcttcctctattgcccaggctggagtgcagtggcgtgatcataactcactgtagcctcagaccccagggctaagtgatcctcccacctcagcctcccaaatagctgggattgcaagtatgagccaccgtacccagcttcatcctattattttgagtaattagacatcctatctagtaataagataagtaattttactggtgtcactttggaggtaactggcttcagataaggttattgaatttcatagtccattatttcaatttacctacaattatcagggcaaatatatagaaggaacaaaattgaaaaacaaataaaaataaataaaacaattgtgagagcaaataaacacaaaaacatcctatcatcgtagacttcattgcctgtgtatcttaatgtgaatatcatgtactgttttatcaagctttaaatctgaggaaatggaatctgtgaaaactgcctaatttgttaatttgcatgtgaagtatactgttaccagggaagggtgaaaaacggatttggcgcatgtagtttactaactctgagaggataactggtgttagtttctgctgctgtaacaaaattgatttggcctttattatacctcctattagaaaattactgtgaaaaaccgcatactgaaaatgtgagagcgctttgtaatgaagaatacattttatgtagcaaagcaggaagcagtgacaccaagtcttaatgacactttatattctgccagtgtacttagacacaactttctcaactgcataatctaaagtaaacaaaaatcttattccattagggacacaatttgacaattgaattttttggtgaacttttggcatccattgaaagaattggctgcaaccccagagatggggttaatctttttagggcatcattgcctggaaagtggaggagatgaccaagtcaggctctaggagtaaaagcattatctctatgagctagaacgaaggagttattcaacagttatcatctctatgaccactttttattcaattgcaagagcacagaaaggatattattttactcaagaaaattggggaaaaaatttacaatcttagtatgctgaggcttgatataattaaatgattaaaaggtaattaaataattacctttgtattttaataattccctatagtcttaggtcaaatctatgtggaagaatatcacatatcctaatgctgacagtatttgctgtcacatccacccagtttggaaaagggctcttcattaggggaaataagtagtacattcttgtacagtagtaaatacttatcatgtagcaagacagaataaaaatcaatattaatcagactagacaaatgcttctagtataactgaaattctcaagccctaagccctaagtgttctcttcggtgctatttattactaaaatatttgctacttctgacaccaaatagttctgtaatgtagggtctttaacttttgatatcttagtctgatcatcagaatacccagctctatcactgtatgtgttcttagggagaatatgaaaattttatttaaagatcttcagcatatacatgactgctattttcttaccttggcatcccacaatgaagctaatggaaaggtttagcaattctatgctgttgctcatttctccctgaaactttgactattcagcccacaatatgtctacctgtatgctccactgccccacctttatgaagatatggctgtatatttcagcttttcatttttatcgctaacggggacacacctgttcctaatgctacctaagattgtgctggtctttggtacattatagaggtaggaatagtatctaactcccttatattattagtgtttactactttataggtattgaaactgttctgagttctgtacatttgttaattcatttaatcttcacaataatcctatgaagtagccactgttattatacacatttgacagatttagaagctgaaacataaaaagattgcttgcccatgggcagatagattctaaacggacagaactggtaggatttcaccccagcagtctggcgccatactcctccctttttttactctttggctcttagctagctgggcaaacttgggtaactttaagctactcaactgctcattttccttttcaaacaaagagaaagagaggaataagctccacctcatagaattgtggtgagaattaaataatacagtgaatgtaaaatacctcactgactggtacatagtaaagtattcatgttattctttttcttattactatcaagcaatcaataaaagtcagatgaaggaattaactcatggagaggcataactcagaatcactaagttgatccttccagggtccatttttattttttctgttgaaaagctcatttataaagaatggattcagtggtctagcttggcctctttcctgaaagcattacgtatagggatcaagcactcttatgctttcttcattaggctaaagaaaaagctattataacaaaaagagattgcatttctattaaagcaattttaccaccaaattagacattttaaagaatatatagaatgatacatggaatgctatcagttgtcaaaacccccaatatttccaaagcatatatgaaaataaaagtcagagagaaactcattttatcatcttttaatcctaatgccctggttttccatttattgcattatgagattgacattatatcattatctcttattgtcaccttagccttgtaagctttagatgttgctaatgttatggtaataactgctacaatttgcaattttcagttgtattagaccttgattcacttttttaactacctcatataaccatcactgatttttcttgcagataataacccccttaatggtttttataagtaaatatcagtacaaaattatcagagcaagaaaatcaatattagaaaacttcttatattaaaaataacagaaatagagtaatattaaagtaattctaaatattcaaaaatcaaatgcatgagttattttgaaactagtgttagaaatttcatgatttggaacttgctagttcactgttctttttcgattttactacactttaaaaacactgtaacctatttttaaaaaattaaaaataataatacatatgggatcaccacagagctagtgttttttagaatgttttcctgtatttcacacaaaccatctctttccttataattaaaagttgtataatattgttcttgaaggaaccatatcatatgtcttctaaaaggccagtatgttgtgtttttatttcttttggttaaatgggccctaaagatttatcagatattaggaatatgaagtggcacagcagacggtgaaatagtatatcttttctcaaactttttcctcaatgcatttctactaccaatcaaaatcctgcagtccaacctcctgtaggaaattaaatctttgctaaataaccctattggcgaagctcttctatttctcattccccctgctccttctctggcatgccattcattcatctgataaatatttgttgagcaccaagtatgcacaggcacggggtacagtgatgaatgagatgcacttctacccacagagaacttaaaatatagtaacttgtcactgactaccttatatcactagttatttttcatgtgcttatgtcttacagagagcaaagactacaatttaaaattattttactttctgtatacctttcatctagcaagtgctcgaggcatatttagttaaatgggtgaagtagctcctattcaagagagaacagttttggggcaatattcacccactcctaagctagaattatcacatatggtaagacattagcacatgccattcgactagcttcttagctcagacagtggatgactttcaaataagataaaatattagatcacacaccatgaagaactcttgcaaggtaactgcagcctcagtgcatctttgtccatctgggttatgactctgtgaaagtaagtgtaatgacagagttgaacagacattcagatgttaagaagcaacatgcggtaggctagagttttgagaaggaattaagggccctcctcattggagtttgcatcctcagaagattgaggaaatatgtataagaaataatcatggccgggcacagtgtctcatatctgtaatcctagcattgtgggaggcagaggcaggtggatcacctgaggtcaggagttcgagaccagcctgaccaatgtggcaaaaccccatctctactaaaaataacacaaaaattagccgggcgtgttggcacatgcctgtaatcccagctactcgggaggctgaggcaagagaatcacttgaactagtggggcggaggttgcagtgagccaagatcgccccattgcactctagcctggacaacagagcaaaacgccgtctcaaaataaataaataaataaataaataaataaataaataaataaaataaaataaatcattaacgtaggctgggcacggtggctcacgactgtaatcccagcactttgggaggctgaggcgggtggatcacctgtggtcaggagttcgagaccagcctgaccaacatggagaaaccctgtctctactaaaaatacagaaattagccgggcatggtggcatgtgcctgtaatcccagctactcaggaggctgagggaggagaatcgcttgaacctagaaggcggaggttgcagtgagcgaagatcacgccatggcactccagcctgggagacagagccagactccaccccaaaaaaaaaattattaaaatataaaaattttatgaaaatactagaattaatgggtgttggactcttgctagccttggcttgcaacaacagccagccctcagggctgtttgatccagtctccttgcttgggttaacccagaagacagcagggcataggctgaggcaactatagacctgactctgtagctccagggaagcccatcctgtgtgttttcattggtttattttcatttgtttgctcagaggaaagtttcagaaggcatttcttttggggctacattacagcccttttagttgtcatttaaaagagtatgatttcaatttatgacagacaatcaatcaagatttttgttttaaaatgagcctatgtgacctacagaggaagtggtgttagaggtgggacagttcttaaaactggaatttataaacatttcagctttactcccaagacagtgcggagcaagaagggttagagaaaggagaggaaggaggtagggaagagttgggtgttaatttctaaactataatgtggttccttagtcgtttctcctaaagcagacatagttttattgagggccattcatgggcaaacctagaccaaagccagtgacttctctcaaatggatgtttatttctttctctcttcctcgacggaaaagaaaaagcagaaagaacaatggggaggaataggcatgcaatgtctgatattgctttagtgttggcgaaaaaggcagcctccctccacgcccaccacaagtacatacacataaacatatacatgtgacgacatatgcacaaagacagggcaaacacaagtttacatacatgcaggaaaatgggcacacacatacaaacacacacacagacatgtgcatacaaacgttcacagatttacgtgcatataagcacacatgcacatatattccacacacacacacacacacacacacgtacacatacacacacactccatagatgacagatcaggtatcaatgatcctagtctcttaaacccctgagcaggcagtaggagtttcccttttcctagaaacctaagccagaagttctcctcacagcctcatctgggctagggtggaggtgtgatgttctcacaggccctttccacccatcttttctgttcttagaaaagcctgtgttgggccgggcgtggtggttcacacctgtaagcccagcactttgagaggccgaggcgggtggatcacctgaggtcaggagttcgagaccaggctggccaacatgacaaaaccccatctctactaaaaatacaaaaaattagctggacgtagtggtgggtgcctgtaatcccaggtactcaggaggctgaggcaggagaattgcttgaacccaggcagcggaggttgcggtgagccaagaatgagccattccactccagcctgggcgacagagtgagactccgtctcaaaaaaaaaaaaaaaaaaaaaaagaagtagagcatttatatttggccaggcacagtggctcatgcctgtaatcccagcactttcagaagctgaggcgggcagatcacaaggtcaggagttcaaaaccagttcggccaactgtgaaaccccatctcaactaaaaatacaaaaaattagcctggtgtggtggtgtgagcctgtaatcccagctactcgggaaaccgaggcaggagaatcgcgtgaacccgggaggtggaagttacagtgagccgaaatcgtgccattgtactctagccagggtgacagtgccagactcggtctcaaaaaaaagaaaaacaagaaaagcctgtgttgatatcattgtaatataaaagatagtattttctgtgggccctctgtcagtctccaactttgcttgcctttttagctaacacccttttctcacatcatctttgctactgtatagagaggtgtatatgttgtgagtgtctttctcatttataacaatccatactcgtaaactgtattcctccatatttcctgaaatggacttgaagtttaaggagaggtgttagagatggacagttccaactagttgaagatctccccaagccccttttatgggagaaaaagagaaggaaggaagggagaaaagaaaggaggtggaagaggagaagaaagaggggagggagaaagcgctctggagagaggaaagagaaacagagagaaatgaggagaaataaggagaaaccaaagaaaatatttgtggtcttctactttttgccattccctacacttttctgttcatcgccacctatcctgagtagtggcttgaggagcttttgaggggtttgagagggaggttgggaagctaagagcattcaagacggcttcccctcttctctccttcatctggattaaatgcatccagtatgaggaggagggtgcagagagctctcccttccctacctacactaaatagtagtgtccacttttcactgaaaacccacagtgtgcaaagtacctagttagggaattgatactatgtttgtctctaatcctccccacagccatatacaaggagggtattattatccacattttatatatgaggaaactgaggcttgaattagtgaggttagtgattcattccttagctgttatatagcagagcagtttttctattttatttttatttaaaagatttaatttaatgagtagtaaacagattaatagaaatgaataatagttaactcatgaatgtggtttaagtttgtaaagtaaaacaaaacagaacagttttacttagtagaggggttttatgaaagtacatactaccccagacaaagaaaaaaggagagggactgaatctgttgggtaggtgagaggggaatgagaaaagctctgggggaaatactctatacgtacattgtctaatagggtagccactaaccacatgtggcttttgagctcttgaatgtgacaggtctgaattgaggggagctaaaagagtaaaagacacattttagtataaaaaaagaatgtaaaatatctaaacaaattttctattgcttatatattgaaattataatatattagatatattgccttaaaatattaaaattaattttacttgtttccttttacctttttaatgtgcctaatagaaaattaaaagttacatgtgtgactcacattatagaacataaatgtttatacttgattcctaaccaccctgggcttcttcctagtgtggcactcagagaggaggatatagggacacagccaattccatcagagaaattcctcttttgtttgtttatcaaatcaggtttctgatataaacttctttgagggaaagaatctacagccaaaatgcttgacaattctagtcttagaatattttccatgtaccctgaagacgtggaatgagaagaagaaacccagatacctttcttttcctcttatcactgtatcccatgcattaactagaagggccactagatctctctatgattccctctaagatggtggtgggcctgtttttttttccttgttattctggtatgtcaggagttcatcaaaggtatatttgttactgaaattttaccccttttctgtaggttgcagaaatatatttgtgaaagggaatgtcttttaagtattcctaattgatagcatggagagaaccaagttacagatggtctttattagaaattccttctcttttggaaaatgtagacctctttttcctaccccgttagcaacagtgattggagaatgattgagtggtctcttgtggaaatatgtatttacctatgtaaagatcagtttcaactcagcacattcttctttaactggtggactaacctgtaacctctaaagggtgttgacatctcttcagtttataactgtgtgtatgtgtgcatgtgctcgtgcatgtgtgcaagagtgtgctctcatgctcatatttatgtttttaacaataaatccagctgctaacttagagaaaagcttttgaagctactttgtagattttaattttcttaagaataaataataatcctggccatttgaacaacccatccccccaaaatgttagcacgtggtcacatacctgaatgtgcaagatgaattcaattcaagggtgacagaactgatcagaggaaaggtaagaacaaatgcatgctatgaaaaagccattgatttccctgacactaattgtaaccaaaaataacattgtaacctcaaagggtatttgtatgtgtttgttgtcagagggcagatataggaacccaagatagagcccagacagtttcttagttagaatatcacctctgctttttgaagtcttacaatgtttctttctctatggccttttcatttggtcctccaaaaatgagggtctgttgagtttcctctgatgagttttagttgtcctgtggaaaggaggcattctgatgtaagaaagttttgcttatcattagttgaatgcactttccatcctgcaaaatgttaatcctcagatcacaccaaagtgaaggacaaagcataagtgagaacaaactacatcaagtaattctttcctcatgtgtcttttacctaaggcagatgtgcatacttggtgatacaattgacacattcctccctcaaatgtgggtttcatacgtttctccatgatcaaaaaggaaatcattttatcttgaagttgtaagagaagcatttattttaccatccttttaaaggcaagagtatctgaaatttgagataaggaacaagcctatagtttatgcccctcccttccgttcatcctttccaaagcaccaacagttctagaggccatggggatttatatataaataagtccctctcatggaatttataatctgtgttgctttgatccaatccaaatataagcattagtagccatgccactaaataagtcaattccaaacagttatgcctgccccatctttggaacatggtgggaagtctcaggaacagacagcaaatgtctacaatgtccactggctcttgtatatctctaaggcttaccatcatgctttctgaaagtccctgctctcaggaactcactatgctcgttgtagaattgtctagcatgttgacagtctcttttctgtgtgtgtctaagtcctacatgccatgtgtatcatggtacctgtgtgttgcactgaagtgccatgagctgtagtaggaagagctttggcaccaagaggcaagagatatatgttttaaacgtggctgttccaacatgttggatcatcttgcagagccacataacactgaggtttatagagtccattttcatgctgctgataaagacatacacaagactggggaaaaaaaaaaagaggttcgatggacttacagttctacgtggctggggaggcctcacaatcatggcagaaggcaaggaggagcaagtcacatcttacatggatgacaggaggcaaaaagagagagcttgtgcagggaaactcctgtttttaaaaccatcagatcttgtgagactcattcactatcatgagaacagcacaggtaagacccgcacaggtaagaaccatcagatcttgtgagactcattcactatcacgagaacagcacgggtaagaacagcacaagtaagactataattcaatcacctcccgccagttcctcccatgacacataggaattgtgatagttacaattcaagatgacatttgggtggggacacagccaaactatatcagtagagacaaggtttcaccatgttggccaggctggtctcaaactcctgtcctcaagcgatctacgcacctcggcctcccaaagtgctgggattacaggtgtgagccaccgcatccagccaacccttctctttaattaagaatacttctctaagaaccagcctgagtaattttgggtaacttcatatgagtgagaatatatgtgatatcaggattgtgattatcataccatttgaccatgagttcccttttcatctgcaagtcaaaggatagttatttctagggcctttttcccttaaagactggaaagtctgtacttaaaatgagcaactccattcctgatttttacattggacttagaatctctgatcttatttccccaggggcaacatttatgcgacttggcttgaatttcttcctctttccttctcttcatttcttcactatgtctgcctttaaataccacttaaggtaataacttgttgcacagttaccattctttatttcttctgcaagagatggtcagatcttctttctggcttccacagtctggtgaatttgggacacattcatttgttcatggcccaaacatttgctaagtgcctattatttcctgagaaatgttagttaatgagccctattccttgctcttaaggagtttattttctaatggaaaaggtaaacaaaagcaggtaattatgttacagtgcacagtaaccattaagaagagatgaacatgtgtgcaaggaccctaaatgccttagctgggtgaagaaaaatggccacttttaagaaccaagttgcaaatgtaggcctaggtgcaggattaagaccatgttcactttgcttattagccatattgtcagtatcttaaggaatacttgtggggttggctctttccttagtggaacatctttatttcttgtctactttttatttcttgtaaaaaaaaaaaaaaaggtaatctaacctaaccttttctaatgtaacctaacaagtgttattttttaaaagtatttttaggttctttgtgactacatttttgtctttccctagacagtggcttcctaattagataacctgtatagacaattccaaatttagcagaaattcaaccaaatacatgcttcacagtgcaaacaccagcaacacctttcagcaacacagtttggtgaagacatgcctagttgaaagatattttgtgacttgaggtttatttaagctaataagtaataataatttttggagcctgaacagatccccagttttagcatacttacatcttctttatgtctctatgtattttaagtttctaagtaactgttcatagatgtattttgaacatggtttcctagatattgtctcaattccaattcaatatttatatctgttggaaagcacatgcactggaaaaatgttttggcaactgttttcattgactgtaaatcatttattagatagagtgttgttaaagttgaaatgccaaagttgatctaccctatgctctttgactttttggttgttacagataaaaagagattactctgctgagagtactaattttacttaaaggtccttttggtttgcatattaaatatgtcattcagtctctcccaagttaaatagagtgtgccctactgttactttgaagttaaatgaagttattttctgttttggtgcataagtaaatataatcataacttactttctttttgtaaatgaggttaataagtgcttgtgtcaaaaaatagccagtttatgacattttagttcatttattttagatataattaccaaatcagtgttctacttttttcttcaaataacaaaatgctggccgggcatggtggctcatgcctgtaagcccagcagtttgggaggccaaggcgggtggatcaccaggtcaagagttcaagactagcctggtcaaggtggtgaaaccccgtctctacttttagttttaatacaaaaattagccgggcatggtggcagacacctgtaatcccagctactcgggaggctgaggcagagaattgcttcaactcaggaggcgaaggttgcagtgagctgagattgcaacagtgctctccagcctgggcaacagagtgagactccatctcaaaaaaaaaaaaaaaaaaaaaaaaaaggcttcatgaggtgtttttgtcatctgtgatggggaaagattgtagcatccaaccaaagagctataaagaagacagtgttgtacagtttatgtcttggtcttaattctaaacttcccttccaatatgtgcttatggatgttttaactcatttttcgtttgtttgtttccactttgtcatctgttcccattctttaatattactttcatttccagctaaattgttaaactccagttacatggagaatattaccatgggaaaacatcatttaatttatattctatctagttctggcaatagcagtaatacataatgtaacttctcagtgattctcatgtcataatttaactagctttgacttttactgggagtaagcaccctactctggaaaatccatttcataattttgtgtctcaatgctatcatgtagctaatcagttaattgtaattacttctgcttaattcacaagaattctgaaaggatgtataataataaaatattttatcatggaatttgtctctgataaggaagtaaccatgagaaaacctattcaagtgggaatataattctataaacctaacttccaagtaaccagtctttgttgaattatagtgaatttccagatagctttgtgtctcagaggacatgggttggagttctatagctgaaccagcattattttaggtattacatgaggaagcaaccataacaaattgaacaggtggtcctgggaaaataagtctggaaaaagtccagagattggtgggggaagggggataaaatttaactaatggtccaatgaaatgtatactaccctggataggcatatatctctggtagcctctattaacatgtaaaatttgtaaaattcgcttgaagtttactgaatatcattttgtttcaagttgtttcactgaaataatcaaacttgaagcatctcttgatgtaatgataactcaagtttatatagtatttttttgttttgaatatcagttcatcatctaagaaatatcttaagtcaaatattagtctattttaccacaaaggaaaataaaattttaatgatagtaaagttatcaacacaaaataagaagaaatagatcaaatgcagtgttattgtatcaagatttaaaaatataaaactgtgaattaattttaaaaaggagaagtttagtagctcaaatagatttacaaaaataattgacacaactcaggtagtgattgaggtggtttggccttcagtggtttacttctatgctactaaaagtgtggtctgtggactagcacctgagaattggtagaaattatctgagaacccacctcaagcttactgaattagaatttgacaattggttttaactagtttttcaaatggtccacatgtaatttaaagtgttggaggtattggcttggttaaatgtaatgttaattttagtcagtagtgcagcaacatgtctgctaagaaaaataaagtaagcatagatggagttcataatcacatggcatccagagagagataattggacttcctatcctgctgactttgttcagttacgggcgctataagttgtgctttaagaacatgcaacaaggacaccgaccgggatggtgaccaattttatatagagaataactgaagaaacaaaacatttgacctggagaagagaaaacaggagagctataattgctgtgttcaaagattccaaggcctgtcccttggaagacaggggagaaggaggcagaagtaaagcaattaatatagacaataaacaggaaaatgtatctttttaaaatctaagatgaactttgaaacaattatgtgtgtcctaaaagagatcttccttattctaagtagagagttatattgctgaatatttttaagtagagactgaaaaaccactacctagaatgaatccccctgttaaatgctctctaagctccttgtcacaaggtaacaataggagttgcattgaatctatagattgctttgggtagtatggtcattttaacattattaattctgaagatcttatacagtattattctgtataaaggtataaatgaaatagaaaaattcctaaaatctacgtagaaccacaaaagaccctgaatagtcaaagcaatcccaagcaaaaagaaaaagctggaggcatcacactgcaacttcaaaatagactacaaagctaccataaccaaagcagcatgatattagtataaaaacatacacatagaccaatggaacacaatagagaacccagaaatgagttcatatatttacagccaactgattttcaacaacggcatcaatatacattcaggaagggacaccctctttaataaatggtgtgggaaaacttgatatctgtgtgcagaaaaatgaaaccaggcccaaatctctcaccatatacaaaaattaactcaaaatgaattaaagacttaaaggtaagatcccaaactatgcaactacttgaggaaaccaggggaaacagttcagaatattggtctagtcaaagattttatggctaagatatcaaaagcacaggcagcaaaaacaaaaatagacaaatgggattatagtttactgaaaagtttctggacagtaaaggaaacaatcaacagagtgaagaggccactccactctgggtgaaaatatttacaaactgttcatccaacaagaaactaatatccggaacacctaaggaggtcaaataactcaacagccgaaaaacaaatatccaattaaaatgtgcacaaataagctaaacagacatttctcaaaagaaggcctacaaatggccaacaattacattaaaaaatgcttgacattactaatcatcagggaaatacaaaccaaaaccacagtgagatttcatcttatccgagtttgaatggctatgatcaaaaaaataaaaaataaaaaaataaaaaatgctaaagaaaagggaactcttagacactgttggtggggatgtaaattagtagaaccattatgggaaacagtatagtggtttaaaatctatattaaaattaggactgccatgcaatccaacaatcccactactgggtatttttaaaggaaaggagtcagtatatcaaagggatacctgcacccgcatgtttaatgcatcactgttcacaatagctaagatatggaatcaaccaaaatgtccattaacagatgagtaattaaagaaaatgtggtatatatacacaatggaatactattcagccatataaagagtgaaattctgtcatttgcagcaacatggatgagcctggaggacattatgttaaacaaaataagtcaggcacagaaagataaatactgcatgttcttatgtatatgtagaagctaaaaaaaatgtttaagctcatgaaagtagagaccagaattgtggctattagaggctgggaagcatgggggaaggagagggtagggagaggttggttaacagactcaaaatcatagcttccgacagcactgttggttaaatgtggttaactacaatttattgtatatttttcaaaaacctagaggagaggattttgaatgttcccaacacgaagaaatgatgcatgtttgaaatgatggatatgctaattaccctgattttgtcattatacattatatgtgcatattaaaatatcactctgtattactcctaaatatgtacaattattacacatcaactaaaaataaaaggaaaaataggtaaataatatataaaagatacagtaaaaatacaatattataatcttatgggaccactgtcatatatgtatgtggtccctagttaatcaaaacagcattgcatatgactgtatttctccagttttaaaaattactcattgttccatctgggcatggaactgtgtctgttttatccactgtctgttgtatcctcagcctctagcacagtgtctgacagaaaatgtttctgtatgactaaagggaggaaggaatagatgggagggaagattgaattcattagtatattcaattaatatttactgattgtctttgatatgcaggcactctgataggcattaggaagatgtaagtgaacaaaacagattaatatcccgtctctacaatttaatttttctgtggattagtttcaataacctataagtagtttatacagaaggagaatgaagaacaagaatcagatgtctactagagcaacacatctttaaagaagtaaacagcttccaaatatctcagagcaaccagaccaacatgaagtatgttgaagttgacataaaatagagatttcatttctttgttttaaaattaccttgaatatgaagttaaaactcttcatgtgttataggctgatgaaaagcttagacaaattactaaaactttggagactgcaagactccaaataggagcaacatgaggtagagcagcatatgcagctgtatgaccagagaatttctgagaatttactctgatttcattgtcagtgttttatgttgtgatttctttgattacatcatggtattattagtgatgttttagtatttaatattagaactactttgacctgaaaaacgtgtcctaaaataccttattttacctgagttactgtgttctttgaaccttattccatccaggtgtcaacatttttttctcatcaccatgcatctttgattttataatgtaagtcagtgagaaaacaagattaatttaacggaaaattgctttccacaatcttttctggaatctcttttgtctgttacccaggcaatatctatattattactttgtcctcaaaagcttttaccaatttggcaacacagaatgactaaatctcttttcctttatctggcttttcattaggaaggaaactcccaaaattcatttctatcagcattatcctcaatgctaaatcttgtatgtctcaagtctgtttataataaatatcctcattatgactaaggtcgtcttacttctctgcattacttcagtttctaatgaaagcaatgcccaagtgactaagtggatgaagcccccgactgtaggaaagtgttcccatcaaatatctcctaattgccctcaatgaatcagcttcaggctcagccttatctctggcaccttccccagctttgtgttgatagccaataacatgtgctccgagcatgaaggagataaaaatggtgtgactcttagaaagccagccatagagtggagttagggagctgtttagattcttgacttcatggtcctgatgtgattgattttcaccaatttgccttcagacatgctttgctatcattgcttcaaacacgtaacttcagatcctacagggaaacttgtgctccttcaattgtttctgctgccttacacataggtcctgtgttaagacatcttgtattcatcagcctccaatggtaactttaggcaagtaacataagcactttctctgaccatctgtaaaattaagtagtaactacaaagcatctgacacatttcttataaaagcacagtccagtcaccctggcctggctcacagctgtggagaacagcgtgcttgtgtctgagcctcctgacgtatgttttcttttcagtccctctgccccctgccttccttaccaccaccccccacccacaatatcttctctttctctctttaactagttctcctccaccctcaccccctatgcctgaccctactcctcacacctgctttggccccatataatacaggatgttttaatatactatgtacatggaagaaaacggaaattgaagttgccagccatgaactttcttttcttttcttctcttttaagtgggggaagagtatcgtcaacagcaaggaggctattttcttagtgacagcagaaaagtggtagggggttagggaaagaacacttaagaaattagagcttccagcggatacatggtgtttgatcttttaatggtgttgctgctgggcctggtatatattttatcatgggagatggttagaaatctgagctttgaaggtgggaaatgtgtcagttggtttgtgtgtgtgtgtgtgtgtgtgtgtgtgtgtgttgtaacacagagtacgccacagagaccaaaagccgtggaactgttaaaagacagagacatacaggcatgtggatatggagtggatgaggcacacagacacatattaaatgagaacctactagtgacaccctgaagagagaaatgaggtaaacaggcatgatactggagggagagggatgatagatcagtgaaatgacttctatgcttcagccttccagtatcacacaggctgtgagcaactcacagactatcaacttatgacatcaactccttggcatgactttggacacagaattcatgcagtctccacctgtcccaggtagtccttgattttgtgtgtctgacttcaacccttttctatgggcattccctagaaatgcggaacatactcttcaatacctcagctaacaaatgagcatttctggttctcacccaggggtacatactgggagccaccggttttatttctgtactgtcagccttatggtctttccagtagagtttatgtatttatttgaagcttttagggcattttgccctcacttaagctaattggactatatgtgaaattgcgtgggtatagcgggggtagaatgccaaagaacaggcataaagaaaatgttctgaattctggaaatatattctaaaagctcacgtctgaaagttgggtaacgaggaattttatcttttaactcttcctcccccttcatagcatttaacttttgtttgattttcacattcaaaaagaacaattttaatgtatttttcagaactaccaacagggccagcataaccatggagctgaaaacagatggtttggttttgcaaaggagaaaaagtgatatcttttcctcacccatttgcaaggttcatggttgagatccctaaagcaaaagacagattaacaagagaaaagcatacatttagtatacattttatgtgacacaggagccttcagaagtgaagacccaaaaaaaacaaggaaccttatgtacttttatgctaagtatgacgaagtggacagccttggggaaatatgattggacaaagagggtatgatctaatggtaataaacttgggggtacttagcaagacctctttgctcagattcttctctttgtccctgtgtcttcagaaaaatggatgtctctttcttctgggtataggagatatctctcgaatgagaattttatgaccttcttcaaagaaaggtcagaaaaaacatttatgtcctgcttaaggagggtgggaggaggtcagagagaccttcctgcttctgctgtttactcaaggtgccatattttgaggtagcatgtcctgaactccatcagttgaatgtttatatttgaagttagaacctcccccagtccatgctgctaagttcaccccctttccctatctcctcatgaccctagagaatttgaacaaaaaagggtccagtttcaaagacactgagcataagagaaagtgaagctggactgaaaccagggaatcaaataaaaatctactcccagtatattctcttcagaaaattattctctggagaaactgaatagttacaagggcacagtggcaattatgatgctttacaaaaataccatatatgttttgtacttttaggaaaatgaaaactgcacatttgaaataaaaaaagaagatgcagctgggtgtggtggctcacgcctgtaatcccagcactttgggaggccaaggcaggtggatcacctgaggtcaggagttcaagaccagcctggccaacatagtgaaaccctgtctctactaaaatacaaaaaattagccgggcgtggtggcgcacgcctgtagtcccagctactcgggaggctgaggcaggggaaatctcttgaactcgggaggcgaaggttgcagtgagccgagatcccgccactgcactccagcctgaacgacacagtgagactccgtctcaaaataaataaataaataaataaataaataaataaataaataaataaatttcatataaatgcagattcctggcttctcctagaaaaattaggctgcctggcccccctggagccatattccatctgacaatatggcttgcccatttagctgaagcacctgacctccagcttgtcatagtctctaccttgcctccttgcctccccacagctgaggctcaggtgttatttagtattgtgattattcagttatcttacttgtttcagggttgaggaaaaaaggaaataattttatgcctacatcaaaattgggacaatcaaagaggttccaagagggcttcatgcttcccctggcttactgtgctaaggtaccttccaggcttctatgggatttaagttttctacctaaaattcctgatgatatagtacaagctttcgttagctctgttatgagcacaaagaccatccttcatatggtcacctttttataagaagcttataaactttgtcaccctgcagctattccttctccagattactgtctccaaagacttcatttttcatttatgtgatcacacccatgtactcttgatctttgccacatttttcctgtctccacacagtcagggcctgatcaataaggaatgactatgtgttgatgacttcacagctctcacccattatccttcagttcatgcatatgggtgtcttgtctcctttttaaatagcgccattatcctaatggctaatgctcggtgggtggccttctgtaactcttgtatatttttctaccatggctgaacacagtgagtacatttccatcttgtgtttatgcacttgggttttcttttgtaagcacattgccttccacttatttccattaaatttcatattccttattcaaaaacacttctccaaattggtcaaagtaggttttaattttcccactgctgccaaaggtgctggttacctctcttcaaattgttgtagttatcacactttataatgatactgttttatcattcaaatcattggttcagaaatgaaattatatagagtctatggccgacctctgtagaacactggtaaggggtccaactcaagatgatcagtgatccattgaaaatggtggttgtcttctttaaaaaataaaaataaaaataaaaactttgagtaaaataaccccttaaaattaagtagttatttgcctgaattaagtataacctgtaacttattgttaagtaaacatggttaagctaacctttatatgaatacccaggctgtaaaaatttatgctatttggtagtcttggaaatacaaattccaaatagcctgaaataagaagctacaatataatgggaggccagtagttaaaaaatactgccacagtagaaggggtgaagtggatcaggaagaatcctaggatactttacttagaaccctttgtacaaacagcatgaaagtaatgagattaatgaaagatttttttgtcaaatttagaagaatctgagaaacaaactgcaagttttccatttcatttgatgtcttggcaaacctactgatatgtgtgttatttgtctctgtcttcttaatatttgctaccttgccggttgcctggtgatttaggaagacgtggggagtatttgtaaacaaaggaagcttttcagaagtgggtaacagtagccagagtttgctggttggatcttccaggaagcaggagctgagaaataggagtgcaaaagttttgttgaggggcatacctggggaagataaaaaagggaggaagcaggattaggcagagagccctcaatcacagggcaaatctgctgagtcttggccagctcaacaggagctcccgaccaaagatcccctgttctaggagctcaacactgggcagaaaacagccaggtcctattgcacccactgtgctcaatcatgaccgagagctgcctcagaagagtgtggactcaagtcagaagctgaggaggatcctaaaggcagtaagtaagtaatagctacaggctgtgagctctatttgcattcctcacagctgaatgccaagttctttcttgaaggaaaagtacaagcaatatatcttcatcacttgtgcttagaacattttccttattactgaacaacaattagagatgatcttgacattctcctctccgtattctcaatgtttcagcaacatgtgcaaaatccattcttctataccaaagtcacacactcacggaagagatgaagctctcaatacctgaagtaattcccaagtgttggtgaaggagtaagacaaaaacatgcaggattagaatgggcaggagagagagcagatgggttaggaaagagaatcactgaacattgaccctaactaaatatgaaaaggaaatggcaggtaggtgatcaaagaatcaggtgggcaagagttacctaaaatatcggtttcccattcactgcacaaaatgatggcatttgcccctttggaaatggttagctcttagaactctggaaataatagagtaggttgggaattttattcctccagaataatgtctggttttgaaaaacatgcatgctctttaattctcataatactgaatcttgcctttgaattctgtcatttaagtgataaactaaagcagttagataagggagatttttattgtacactggaatagatacaaaatagtggaaagtaaaggataataataataataaaagtcttagatggtgctacaaggtgacttgaattttgagaaatcaaatcaactcaaagaggaaaattcaggtaagataaaaaatatgtatggtgatagagtgtaatcttagcattgatattgtatatgtactggctcattacccactgcatcaaagatcataatgtgtttattatatcatttaccaaatgatagccatttcctgaacaactggcctctcctgcacatccttgtgtgatgtcctttattaataaatgatgcctgtactttggggcagaaagatagaaaaagatatctgaaaagggtctacaggaaataagagagaaattggtaatctccttagcttttctcttttgcactgttacattggctgattgtctggggcatgcaaaatgtatcataggtactacaactaaatcttcaaggtaaaacccagaaaaagtgagaaagagacccaaaccaccattttatatgtaatctcacttggtgtttgtttatcctgcctctccaagctctcctggcatgagataggtctgccatggtcagatagtaagtagcatccaatttgttgtttcttacttcatcaataatttttttcaaaataaactgtggaaagaaatccacttcctagcatgatgcaaacatcactacaacacagggtttcttaaactaaatttaaaaaataaaaaaggaagtagtggttattaattatttatttgcatttaagaacttcttccataagcattttccagagataaaaatcaaagatataattaaacttcagaatgaaagctgaggtttaattaatgagtaggtaacactcagttacctaacatcttcctagtaataaaatataatattaggaaggaaatatgttagccaaaaaaggaaggaaatgtatctttttctttttctcttttttttttttttttttttaaaaaaagaggaagcaaaaggaggagagtgatattgtgtttcagggcatttaatttgaatatatcacttgatagagtgcagacttccctgagttctataacctgtagtgtaaacacacaataaacaggcaccaaaacgcacccaagccaacaccaagcagccagtgggttttggctgacataaggcctctggtttgtggggttcatctggctccccttcagctctatcccaacatatgaatgtttctttagttagatcagtagtctttatatgcctctgttatatcagaaagacctgggtttctggagcagcttataaagattggggtttaggttaaaagcacatcacaggcaaacatgtgttgaacattattctgtgtgtggagactttgaagagcctctcaggtatatgtaggatttggtattatgaggagatgaattggattcaaggtactcaatcttattgccaatctttttcaataagaaaccatctccttggtttgcacatctgtgtttgataatgtgggagaatgtctttgattagactttcagagtaatcattcaaaggcaactttctcctctgctttgccgcatctcataaagttagattttgtacattagtgaggcactgattgcatgaaaataatattggctttatgagagagtataatcttgttcaaattataactctccccgccattctcaaagtactatttttgtgtcagattctcctccactgctgcttttatgagcactttccaaaatagtattttcttttttgtttcttctcctttattgtctttttataacttttaatcatatttttatggtaccttaatagccgaggcaaagtcacaggtggccttcactaaatcatttctacttttctataatcctaatggcagtgaaagaaaagaggtctctgggttgtcccccaaaatacttgtttatatcttccgatgctatttttaatatttctaaggatcaagatctctaccttgtgttaaagtatacatactacccattttgtttggtttcctagcatttgaaaaagtatattcttgacttttctcgtttttaattattattaatacttaatagttaattacttagttcaagttatgctaaaaactaattattttataactttttggcaattagtactcttactaaattttactaattgcatatcaaaacaatgataagagcaacttctaaaaaaatctgtcttcttggttcagtcttgctggttttctcttcaaattaagtgaaattctcttgatattttttcaaaaggtgaatattttctggaataaaatacagagttgaagtgaaatcatggaaactgctgtttgaacaatggtcattaaatgttattctctctgtcaccttgctgtctccccaccacatttatgatgtgaaactaaataaatacgggtacatctttgaaaccggtgtttttgataagaccactcctttgtggagttgtatcagggaatagtctcttaatcccagttggttgcatttttttcctttttatcagtctagatagattgagcctaggtcatctcttttgggcaaggatggtgagttttcagaaaactgaaaggttgccctcaagctaggtgctggagggattttgccaactgcacctggtgctgagtgagtggtagcataagcaatttgggctggagtgagaggcgaggaagaaagccacagccaagacttgggagatttcaggaaataagaatccagctgaccaaataagaaggcccatgggcagggagcagctgggcaccaggagatccaacacaggagccactgccttggaaattggaggcagttatttcatttccggtgatgttttctgattctctatatgattttaactctagaattgctaaaggtagctctgtgagtaaggtgggttgctagcctatcaccagattattaaagtaagtgtaatgtagggcagaaacaagaaaaaaaaaaaacgttggcttccagagaccagagactttgcttaaagaggtacgtgacagcttctgagggatctgtttgtatacataacatcccagtgtctttctgtcaagctacctgcctcccaggtacacgcgtattgctgaggaaacacaaccaacacccactgtttcaaagaaaaccattctttttggagtagtaagctcttttataaggctgaaatagatgtggagtattttaagatgaatagtcttacatccactaaattctacccagtttactctcattacaccacaagagccttggattttctatgtgtataaagacggtatttgtcattgagcttagtgctttttgtagggtcggcatattataggtttccctcataatgataacagaatcttacatcaagtgaacatggaggactgaatatttaaaccatgtgtgaaggagggaaaaaaaacatagtagagcttttcttttcactgtacagttatggattatctttgctggctggatatttatttcagatttttgtggtttctcatgtcgtggattacagggactcttgtaaatgggtttcatatggtaactagtgaccttgaaggactcaatttttaagataattaacttcacagttctaagtcagatctatgccagtcacagaatgaaataatttctgtttagttatctgggatttcattcggttgattaatacctataggagaagagactatttgctttgatttacatctatatcaccttcaatttaatatttcacgagaaatagaaggcacgaaataaccattttggagcagatacacaggcatcaaatgaagctcttttgatgtgaggtgttggagataaacaggtagtatcaggcgtccatagccttgcgttttactcacccctcatgctttgcacctaaagtgtgctcataactttgcagccatgagccatccccttgtcattttcagcccctgacttgttcctggggctgctgattcatctgttttcattgctgtcatgaaaaccagtctgcatttcatcataaaattcagaagtgccctattatattaggaaagaataaccccccaccagtggccacatcatatggagaaagaaccaatgtttcatctttctgtttttcagaagtctcccccaaaatgttttgagacaaaaatcagaatagaatctgcttaccctcaaagcaataggttttctctaaacaatctaataaggatttgtctagactaacatcctttgggaatttatctacagatgtctttaactcgttactgtgtccagcctgtgccaccacttgggagtaatgtgttccacaaattaactataaaggaaagaaatgaagaggaccagaaggaacaaatgcacaggaaacagtgcaaatatgctcctagacaagagcaacatttgttactgtttattactacttatccagaaagcctttcttaaacatatccccagacctgcactgggcaggctaccccttttctcccccttgatagtgcattagtaccgctccatggaacaaattgtcacagaatatcaaaatatgctatctacttagctaatccctatgttgcactcctgagcttagagactaggccttactcatcatagttccatcaacatgaagcacaatttctgaaatatactggtatactcagtaaattccttaaaaaatgacctctttgtatctcaaaaactctaggttattccttggtacatagaaggaacccaatacatgctttgtcaaagaagtaaagaaaataaaattattttagaattgttgagaatcttggtgatatgactgaaaccttttgtttcatggatgacaagactggggcctggagaagtgaggtcatttgcccaccatcctgcagctagaattaaaaccaaatgcagtggtttaaagctcagtattcttttcactccaaattggtagctgcctgtaatttgctggcattgtagaaacaaaaacatagtgaaaatcaccaaaattatattttacatttataaagtgctttacagtttccaaagcattttaataaacactatctgacctccctgtggtgttatctcaagaaggttaataggggagatagtattcctctttagtatatgaggaaacagggattcagagaagctaagtgacttgcccagagtttagaattcaaatccttctttcttttttcttttcttttccttttttttttttttttttttttttgagacagggtcttgctctgttgcccaggctggagtgcagtggcagtgacatgaacgtggctcactgcagcctcgacctcctgggctcaagtgattctcccacctcagcctcctgagtagctgggaccacaggcacatgccaccatgctcagctaatttttaaaaaatcttttaaaagttcccctggtggtctagtggttaggattcggcactctcaccgccactgcccccgttcagttaccggtcagggaaccaagaaatggagcaggacgagctgcagacaaaacccctcagacagcagattaaagaaggaagaggttttttgggtgcagcacaccaacatggcacatgtatacatatgtaacaagccggcacgttgtgcgcatataccctaaaacttaaagtataataaaaaaaatgaaaaaaagtaaaaaattaaaaaaaatctttttagagctggggtctcactacgttgcccagacttttctgaactcctggactcaagtgaccctcccacctcagcctcccaaaatgttgggattataaacatgtgccaccatgagcagccaaatcctcatttcttgatgaagattccttctctgataactatcttctgatgctgtgagagtgaactgatatttccaagaaaggtgtatcccagagattacaaacagtgaccatccaaaaaatattagaactgcgcagggatctttccagagcattctaaaaatgaagcttacaatagatttgattggctgtgaagttgaaatggggagggaggtaaaccttatgcaggttgttataggatgttaatctcctgggacagaatgggaataggtaaggtgacaactttaaaacaaatcagagaattaagaacatggttaagaaatgatagatttttgtgatcggggttaaaaagagaggagccatctttgatataaaataggactttgtttaacattcttgggaagatacttctcagaatggtgcatctcacccttcccattggccaagagcgtctcttgaatatggctgacttcctggacatgcaacctgtgtagttagaagggcccatagaagtgctcaccattggattaatactttgctgttgctgtcgtgaaaggctttatcatttttgaacagtcccaatgttttcatttttcaccggacctcatgcatgacgtaccagttctggtgaagcaaatgaggctttgccaaattttttctaattaagtgggactttttcctcctttgcaagtgattattccttcaggataaaaaagttttgaaccatgatgcatttgttttataaaatgaaaaccagagaagactgcaaaggtagtaacagaaatgaaaaaataagcaaaaatgataaggccaaaattattatttttcatatctttatgatcaaatatcttttctttatgataaataatcatgttttgagaattaggatttttgaaaggatcaattaaatggccttttctgactctcgcatgttgcttcaactgtgtaaggtgagtgattgatcttttcatattgatagaatggttgtgactgaacaatcatgagagcctgctgtgggtgaagatattggttttcttccaaataatttgcatattatattagtcaattttcatactgctataaaaaaactgcccaagactgggtaatttataaaggaaagaggtttaattggctcacagttcagcatggctggggaggcctcaggagacttacaatgatggcagaaagcgaagggcaagcaaggcatcttcttcacaaggtggcaggaaggagaagtgccaagggaagggggaagagccccttataaaaaccatcagatcccatgagaactcactcactgtcacaagaaaagcatggggaaactgcccccatgatccaattacctccacctggtctctcccttgattcatggggattacggggactataattccagatgagatttgggtggggacacaaaacctaaccatatcacatatttacccagaaatttcagagtcattgtgaggttggtaagtcagtgtgacactgagcaagccactggtgccccttcttgcctaatgtctaaaaattccttttcctactgttcttcttgctgtacatcgataaaggtttatcaaactttgtgttactcctcagttctatctagggatggtgtagccaagaagttgaagaaaattgaaaagctgtttgtatattcagtatttgcattttatatattttatagcatatagtaggataatagagaaaatgttaagattatttttatttttatttatttgtttacttatttgagacagagtcttgctctgtcacccaggctggagtgcagaggaatgatcataggtcacagttatctcaaactcttgagctcaggcaatcctccacctcagcctcccctgtaaaccctaaaagtgttgggattttaggtgtgagccactgcacctggctgagattattttttaaattgatttagatagtatccttcattgagaagctctgctgagcgtacatataaaagaatatcattctggccagccgtgatggctaacgcctataaacccagcactttgggaggccgagatgggcagattacttgaggccaggagttcaacaccagcctggccaatatggtgaaaccccgtctctactaaaaatacaaaaattagtcgggtgtggtagcaggcacctgtaatcccagctacttgggaggctaaggcaggagaaccgcttaaacccaggaagcaggggttgcagtgagctgagattgcgccattatactccagcctgggcatcacagcaagactctgtctcaaaaaaaaaaaaaaaatagaagacaaaaagaacatcattccagtaacaacaaacacaaggaaacttttggggaaaaagtttttcttcccctagattcaaactattatctattgtttctcatttgcataataattgtatgactgctttccacctctgctccactgtggtgttttctgttctagcttcttataatactgaatttggaccagcatatgtttatctgttcactcattcattaataaaacaaagtattgactacctgctattaataaatattaagcacagtgtgttgtgggaggagagaaggacattttttcctacttaatcataattagccttaaatagttccctaggagtttcgggtgtgtatgttcacactcctttggtgatgctgaagcattttgaggacatgactaggtcttacacacttcggattgggtgttgcacacagaataaagtccatgaaacttcctgagttgaattatatttggaagacaaaaataatttctgtctggcttagaaacattaagaacccaaagtctatgcgttagggaagagaaacagtcgacatgggtgcagaagtgtttgtaattaagtgggtgaacttgcttagatgaatgaaaccagattatttgagcagggccaatgatgccagagaaaaagaaaaataccaatggagagtaaaataagtacacaaaatgaaagattctgaagttttggaacgaaagttttagctcaggaaatggaagaatacttgagagtttcatgagaaaaaaaataagtgatagtgatagattgtaattatgcagacttctctgaagtcaaacagagaagggagagtatgagatctgtagtggttattagaagaatgattaagagaaagactatggcttaatgtttctcttttgccaaagatgttagaaagtactcaataacattaaagcagaagaaacagcaataaaataagaaggcatagatacagtgatgtcattgaaaaagcacacagtcattgaatctttggctttggagggatctccataaccatttgtcaacatccccacgcctggctgaaccacagaatcacctggtgaactgttgaaagagattctgacattcctcacctcatatggtgaatctttcaaagatgagaaggacgtaaatttcacataagctgttcttagccctttttggtcccttaaaattaccccattcttaatttttgtctcctgagtttccataaattatctatgtattcatccagcaacttgaaattcactattttgctgttttcagaactgtatacgtgctttcttgtccaatcaccgctactcttttaaaaattgagaccttagcctggatcttctgcatctcttatgtcttctaggattactcaaagatccccacagaagttctgcagtcacatctgtgagttccttcagtgaactctgataagattcatttgggcctagagacacaaactcataaagcggctagatgctcccttttagttttatcacctctctcaggcttcggttgcttcttaatctgttgttttgtggcttagtgtgaagatcattctcattgatagggaagatggcagcaaacagaatgcttgagtttttgttctctcttactgtcatctgctaatactataatatctgccccaaggggcgtgtgaatcattcttttccttcactctaaacatacgctaacaattccttttattgtcctctgcatttttctcaagcttgagcttattctcagatttaacccttcctgacactattcttacccagttctctcttgcattcgttttagacggtgtgctttcccacccccgtcttttgaataattcctgtttcatcagccacatgccattctttacattcctaccacctcggtggcattttaactcatctgtatagtttttagcatttatcattatcaaaattttattgttgaatgccttgcttcccccttaagacatctttcttgtcttagaccctggtcatggggccgtatcattctttcctctgaacttgtagaaatttgtgcccttccatttttgagaagtgttgtctgtggcgcagcttgctttaaattcgcaaacatttctggatcctccctagacctgtgaaatcagaatttttgaaggtagctcttgaaaatgtgataattagtaaatctataatgtttgggaattatgctgcccagcaatttcattccctgactcttacaaacaccaagcaattctctcaaggtttccatcgctttaactttgctttattggtccagagtaatagctcctctcattagtctcttcaactttcgaaagattaaattgtcagcaagttaataattcatctgttctgcttttaggacagtacaactttggaaaatcacttgaatttctctagatactactatatcttgtctccacaataataacatgaaatatataagggaaatcttatgcatgtactctggctggctaggttgccagtaatctgtttccattagagtcataccataagctttcctttttgtttcctcttttattttggactgagtgcaaagagttgggtgaacagtaatcctcagttcatggctctatcgtcatttgtctatacaaaactctttccctgtttgattttcccctttaatccttaatctatactccttttaccctctgcatgtagtgacttaagtgtttgggatatatccacaaataattagagttgttttgtgtagatatatgtaattcacagaaatggtattgtgctcaaaatatcattgttttcttttttccactcagcattgtttttaatatctctttcacacaattttgtatcctttaatcatattatatagtatgtatatggacatctgcttagcttctaagcaccctttaccgcacaatgacactaagaaacatcctcatacgtgccctgtaatggaactgaggaaatttctctggcttggaatcatgggagccatagaataaatgcattctgtccttactactgccagaaaagaataatagctaaaataggataaatgcattttttaaattttctttaatctttcccgcttgcatttcaaattcatagtattgatatctatttctatcaccaatgcacaagcattctcatttcccaaggtctccatcaatacttggtattgtctacatttctgatttttgtcatttgaatgcatatcaagttgtatttcattgtgtttttacatgaatttctctcattgctaatgagtttggacatcgttttatatggttgttaattcttatagcatctcattctgtaaattctttattgacatcatttgtcatttttgttggatttcttgttttttcttttgtttttttccttttcattatcaagttgcagtcttaatcagatttttcagtggtgtacctcataaagcagagatctttcattttatagtaatcaagtacatcatattattttcattagaggtggttatactttgggcttttaggatcttaagaaatctttttccgcctctatgtcacaaaaaatactttcctacatttccttctactgagctgatagacttacctttcacattttggtctttaatccactcacatcccactctggtttattgtgtaatagaagggtatagaaagccagctttattttttcttaatacagtgaggaaatttttccaacaccaatcacaaaacatattcattcccctgaggagtgcagtgccctggggttggggcataccgtgtcatggccaggtgcatgggctctggggctgaactgcccaggtctgaatcccaggtctgtgacacactagctttgtggcagctgctaactactgcttagcagtgctccaagtctcagtgggctgtttggaggaggaaatgagatgtcccagacacacggaaagcactgtttttgttatttatcaagttcttctgcatatatgaatctattgcagttcttcttttctccactcagtctcattggtgtctttatttttttttcttgtgtcagtatccatgatagttctccctttctaatatgtctaatatgccttcctcattcctttccctcccttcttcactgccccaacccaggatcacatgctccgttttgcagattgacaaagttgactttgtccatgtttgttgagttgaacgtaatttggaggaatggtataaggataagaaaaaaaaacttggaggagactaatgcgtaaagcaaatgggcgtgcaacttattaatttacagtgagacagataactgccaaacagactcaggtacttggtttttgtatctgcacattcatctctgcaggacagtatatttggaaagccatttattttagggtcaggagctcatggaatcggagaagatggtagatggaaaatctaatgtcattatgccatacctctggaatcaccccatagtagacataaatttaccttccaaacaaggcaaaagctgtactgtcacccagatctccctactcttctggacagtgctgagtacacactgacgaattcttcttgcctaatcctctctctaaccccacccttttatagctctgagcagaatacctcatttctaacacattctctattcagatttgtcaacaccattgcctaagcctaaaccatcttcctacattctagccacaccttgattcaatttctagacccagggttttatcctgccccttaaggtaacgtctttaggtaactaatctcattcagtgtcagtaggttttactcacttaactaagaggacaacaatttttccgagtttaggaagcaatttccattttgcttttctccgtgcataccacttggccacataggatcagttttacacttttatctggctacgttttactctcctctttaaagtcctctctggccaacaagctcctcccaaacacatttttttttctggttccttttatttgcctctaccccactcatcttctccacccccaggcgtggagccaatcttcttatatcttaaattagtccctatttttttggctccttcagtgtctcagagttggaaagacaaagaattgtaatctttagagtaatattttttttagattcaaacagctagacctttttctgaacctattcaaacccatttgctgtaggtaactgtctaacctatagccctgggcttgtttgcagcatcaaaattcattcccaaagattcttgctaaaagaagctggtgacaatgaaaagtagtcactgctgactcagatgttttatatcaattgtttttctgacttgacatacaaaattgagtcacagcattaaatataggtattattatacaattaatgtcagagcaaaataatagcctgctttattttgattttcatgtttccattgtacttacagctatttatttctgttgttcaatcatagcttactttgacttcatgttcaataggttctgcaacaaatttgtagttaaataacattatgtgtctcatctcaatcagtcacactgctgttagttcaggtaaacagacaataatgaagtaggcagggcaaagaatgtgtgttctgttccttggagagcatcttgagaggcataaatgaaaatgcccccagctcccttttgttatttttctataccaactgaatttggaaatgtgtaatctcctaggtagtctaacagacataacaagggcctataatcttaatcacatcagtaccttccacttatatacttgctttccacttgtcaaagcagtcaccttcattagcttgtactactagtttatgtgacataaattctgcgagattggtaagaatgaattattattgcattttggcaatgagaaaatgaagggcagaggcagattaatggcctgcctaaagttacagggtgctgaaattagaagccggcttgcctgacttctgctcttccactgtacctctacattatattcttggtgatggagctcttctctcagaaaatgctataattcccaaggaccacatttatgacagcgttagaaaggtctagaacaaccttccgtgtagatccatgtgggagaagtagtcttccaccaagtgctgcgactgggggagtcagggaggctctctgccccttgccaaagctgtgggacttcaggttcccacaggcccctctccccttgcagcagggcactggagggcggtattaaaatgctgtgttctcttcgaaatcaagcacaggaagccatcagcaacagctaaaacataactctcattatgctgtagccctgatggggccccagagactaagaaccagggaaaatcaaacagaagtcagagtatcacaaaacttccagaattgagaactgtccccagaagagcaaccacagtgggatgcctggataggaagccaaaggccataggagggtaagcagtggagaggagaggggccttacccgccaaatccataggttttccaagactgttccctttatgcactaggatctaccaaataaagagagtaagataaaggtcaacaaattgactaagacatacgaagcatttagtatagtgcccagcacagagtaaatcctcaataaatgtgagttataaatatctgcttgcaagtaagaaagcaaggcaaaggggtataattgaataagaccagacatagaaattagaactcacccttgggaaaacacacagagaaaaaccgaggagtaacacatgcctctttcttttctggagcctctgtttttgttttgttttgttttcttttctttttgagatggagtctcactctgttgcccaggctggaatgcagtggcacaatctcagctcactgcaacctccgcctcccgggttcaagcaattcttctgcctcagccttctaagtagctgggactacaggcatgcgccacaacgcctgactgacttttttttttttttttttttttttttttttcgccatgttggccaggctggtcttgaactcctgacctcaagtgatccacccgcctcggcctcccaaagtgctaagattacaggcatgaaccaccgcacccagtctctggagcctcttttcctcccatctcccatgtgtagtgaacacagcgaaggcaccctgagaagccaggtggtcagaggattgacccagcgactgcatctgtcagttctaaaatgaagttgaaataaggaattcctagagatccctaagtaatcaaccatgccagagtaacaggataaagaagcatattttgcatttgtctattgactttattccaagcgtaaaaacacttagacgtgttcaaagctaaataaacttggaacagagcttcaagactctgaagtcccatagcttagtgacttcctatatgcacttcctagagaaccactcattttcggattctcctcctcttttttgttagtcttgacgtagataagagaaatggcattccctagtgtactgtttcctttgtcccctattactcaagcctagaaattacatctgagtcctccttgttacaggtgacaaacagcatttgttttgcattttgatgcagccacattctcaggttccagcctgccaagcaaggttggcctgggctggtaatctcccaggctttaatcctctccatcttttatttgtgtggaagctcaaggcattagtcctcttaaaaatctctaagattcattttgttcacaactcttgaatatcgtattacaaggcagggtgtgatttttattgacaattggagtatgcttaaatgaagtgtgtggatgcctcaagaggggccacaaattcccacaacacttaacatgggttctggtaacaaagacacttaacagctaggtaagaatgtcaagtggctgtgactacaataatggaggcctacaattagtttaattacaatacctactcacatgtaataatttctcaagaagcatggaaggttgctcactccactggtagtttttaagtcttttttaccccaaggcctctcttagaaaatctgctgtacagccgggtgtggtggctcacgcctgtaatcccagcactttgagaggccaaggcgagtagatcacgaggtcaggagttcaagaccagcctgggcaagatggtgaaaccccgtctctactaaaaatacaaaaattagccaggcatggtggcaggcgcctgtaatcccagctacttgggaggctaaggcaggagaattgtttgaacctaagaggcggaggttgcagtgagctgagatagtgccattgtactccagcctgggagacaagagtaaaactccgtgtcaaaaaaaaaaaaaaaaattagctgggcatggtatggtggcaggcgcctgtaatcctagctacttgggaggatgaagcagagaattgcttgaacccaggaggcagacatttcagtgagccaagattgcccaagatcgcaccactgccctccagcctgggcaacagagcgagactccgtctcagaaaaaaaaaaagaaagaaaagaaaatctgctgtagcctggcaggtcatgatgttctttctgccacaaaacacacagcatcgaatccgtttacagacacaggcctgctgtcttccctttctctctgccctccaagtgtcacatcagggccatatccacccaaccttccttttttttttttttttctaatctacaggaaagggaaaacaccactgagattatttacaaagaaaaacccttatcttaataatagtttgcttccattaaatgtatcttctttggggacttaatctttgtgcccaggcatgttggagacaacagctggcatttatctttatggaaggaaaggcattccaagcatagcgtgttgggactcaagtcatttcttactttccttttattattcacactgatgaatttaagataggcttcagatgaataaattaataaactctgttgaagaaaaatgacaactgcctatatcgccacacatgtgaatcacagggtgccaattcagtagtgttggaaataggatctttccaattattttggagaagggtataggttacatgaccacataaagcagtcagctcttataccctgttgaagataatcagtgacaaaatcagccaaagcaaaagattatccatttatcctatctatctacccacccacccatctatccccccactcatccatccatccgtttatccatccattcatccatccatccattatccatatttatgttggctagagctctgtgggttactttaaaccaatttttttctttcctaattcaacttaggaaacattaaaattagctttacattccataagcacccatacactgatggaaagtggagacagcccatagcgctttgtttgaaggagttagaattttaaatttttcctgaataacctcaatagactaataatcaagtgttgactcagctctcaaatttgctgtgcagtgcttacatggacagaggtaaagaatttcctacttatattcgatgacaacctaatgttttgttctctcagtggttattacagcagcttatatttatgaagtgtctttttctgacgagtttaaaagattctgtaattcactgcattttacatgtggggacccagaggaatagaaatgtcacatcgtgactgagggacagagctaatgccagaacacagctctcttaacttgcagggtattgctttatcttatcatgctacctgtcagcatacagatgacactcaaatctgtctcctctcaagcctaaattcacacttttttttttctttaactgtgactgaacctcagtggacagagcagccaagatatcaggcactcaggcaccaagcatttgaattctgcaacctttgaagttgtatctctgcacctgggggcattttaggtggcctccaggccatgtgccttcccactaataactggtgatgctgtaccgccacaggtgtcagcagcaataactgggcctagcttttagttgctgccacagatgtcctaagggagcggaagctgaatcatcacacttaggtctgggaagctgtaaaaacaaaacctgtgctgaacagcccccaatatctttgtctaccaaggagtctgaactcttttaaagtttcttcttggtaaaagcagtggcttctagaaagacgacctccactctaaaatttctactgataccttcaaatagtgccttgcatcttcaagaatgattggagctgtgttaaaacttgtaaaatttgaagacatttcaaaagaatgcagtgaggacgattaaatgatttgtaaattaatcatttaggacatacaatctccaaaattgaagatgccagccttatttcgtccagagaagagaaagctaagaagaaatacaataatccattgttagtgttgtttatatgaagagtcatgctatgaagggtggtgatcagatggtctccatcctcctcttaagtgagggaaagggagtggaaggaaataggtttaaactaaagcatgcaggatttaagttagataaaagaaagaatttcctgacagtaagattcttaaactccggaatggttatcaaaagaagttttggaatctgcttatctagagaccttaaaaaacactagggactcccatctgtctaaaatggtttagaacagacagccctaaaaggttctcagaggatcggattatcttttaagattctttctagccatatgataaacaagaagattgggagtattagtaaatggccaatcagtaaacatctcagaggccaaaaccaccttggcctccagataactaatctcataatcaccagtgtaagtgggcttgttccaagatttgccaagaagattcttaagaaacccagagtttctcccagtttgttgtcctgctatttatttttgtgggatgccttttctgtgtttgagtttatgtggttaagtttctgtgtttgagtttatgtggttaagtctactgatcctttccccttttactccttttattcttttaatacccaaaccttaacaattccattgttttagttttatgtgatgatttgtaagtaaataaggatggtcactcactgtggtatttatttacgttagcaaaaatggggaagcaacctaaatgttcaacactctgggatttgccacagtaagggtgatacgtctgtgtgatgaaatgcagcagagctattaaaattcaaaagtttgaagaacatttaattacctgaagaaatactttaaatgggggacaaaatagcatacaatactatatccatggcatgattccagtggtggatctttaagaaaataaaggatataccaatactggtgggaaatatggtgttagaatgacaaaggattttgtatttccacttgaaacttttttgagtctcagttgtttgtagtatatatgaatatctgatattatcagatttaaaaagttgtaaaataggccgggtttggtggctcacacctctcatcccagcactttgggaggccgaggcaggtggatcacttgaggccaggagtttaagaccagcctggccaagatggtgaaacctcatctctactaaaaatacaaaattagccgtgcgtgatggtgcacacctgtaatcccagctacttgggaggctgaggcatgagaattgcttgaacccaggaggcagcgtttgcagtgagctgagatcgggccactgcactccagcctgggcaacagagcaagattccgtctcaaaaataaaagttgtaaaataaaaaattcaaataaaagaatagacaatcccctattggcaggtacaaaactaacgttatcattgtgatcttacttttaattacctctctaatatttctaaagtatttgtggaacatgagactggtaggcatgtcgtgtcctcaggcactgtgtctaccttgtaacacaaattatctacctgttctcaattcaggggagcttgggaaaacaaaaaaaaaaaaaacaccccataacgttgaagagctctcgtaactcttctctatgacttgtcttcctcctgactcagggaatgaatcaaaagttagtgtgcttcataacctgtacttcagttctttttcctggcaaaacactctaaaatgtaagttcctgtgttgttaagtttgatgggaccctgttgcatatttcaagtatagatacagctttacctactgaacacttgccctcttttctgtggctgcaagagaaattgggtgccttaaaggcagtattaaaagaatgtgcaactatctactctcaagattgtgtgaaatacattagtaatagtgtgcacagcctatgttgaaatttatcatggacaaattgtgagtgaggattttactcaacactcagttttaccattaccaaacctgctctccagcgtctagtcaccacccttattctcctaattcagacatttattttctctccctagtgtcatgggctcctaactggtctacctccacccagcatctttctcccgtgtcccattttccagtgagagccagcatgatctgtctcacaggctggcacacagctcacctccacacgtagaatgagatggaaattctttaaacagcctacgggcgccttcgtgttctgattcctgtctacatgacccaccacatcttcaacttgttctccacttgtaaattctgcttcttcagtctggaactatcctgtaaaaatagagttaaagaaaaatttcttcccatttttcaagacccaggtcaagtcctctaactctatcctgtggaggcttcttcagcttaccacctcaatgctttaacctccctacattacagataatcacagtgtaattacttgtttgtatgactttttccaagtgggacaaggagctgtttaagggcttaacttttacattcttacttcctgtacaaagcatgcagtgcatcagctgagaagtagaatgtttttgttgactagatatgttaacttattaataaaatagagattatatgcttttaaaataaacaagcaataattgagctctagtcattagctagcagcaagtcagaccatggacctaacttctcttggctcatggctcctcctagagactttgtccccagagcccctccctgctggactgctcccaagaacatcttttcctcacttccccaaggacgtgccttcagagtgacctagagacccttgcaaacaagttaggggtccagagggagaaaaaggcaggagtcacttagtcattttccactttgctttctagttgtcttaatgatgtagtgaaaatagtaatatgttgttttccagaagaacaactcccaaactagtcaatttttttaagtggaggtcatgataaggcaaccaagttttttatttcaccaagtaaaaacataaatgaaacccctcatctactagaaccattgtttcataaacaaaagcatatttaagtattaacagaataggaaggttgtaattgcagaaagtaggagaatcatttcaattaaacaaatgcagtgagatttttatgaagtgaagttgtacctgtttttcccacagcatggcacccatatcctggaccagttcaggataatatgcaatgtgtacctctcgaggaaggcagggatggcctgccaacagcaggcccgggaaagggcaggagtatctcccggctgctcataactgaccttatggatctaccaattgccaggaggaagacacagttcattctgtcctcttcctgatgtttctactgctaagaattgctcttggatgcagtagaggggaacctatatcttgaaagctgaatccgagctgttatttaagaatttctgaaagtatcgacagatgacagtagcacttttaacttggagaagaagagcactttaagtgcattctgtcatcttggttacttactgaaatctgttcatggtagagtgggtggtagggtgatgtttgccttggcttgacagctgtcaactgtctgtgtgtggtttgtcatttgttgcttttggcttgtgggtggtctgcagtccatatttcttgtgtatgtcatttcattcacaagtaactccaggggggcagctgtgggcaccttgctattgctgaagtgcgagcctccaccttctgtgacattgcttggcttctgttggtaccatctcccaccaatatcaaatgcttgacatccttagtcatggaccaatgtttgggtgatttttattttcataattgaaaatcatcttggaaaagtggggatctttcccatcactctattagctaagttttgttgtttcgagagagaaatgaatattcacttttaatgtctctaacatggagtcatttaaaaaataccagtgaagttacagattgctcagccttcagcctgacattgagaatcttaacacatctgtataggaaagttgtataaataaccacacacaatgaaacttgttctgtatggggcctactttctctggtggtggaattattaaatgtggcaggtagacacattcttctaagttttgaactatggtctgtagaacaaagcagcttgtgactgtgatattgtcctgaatgtttgtgtttattgactggccactgtgctgacatggaactaggaagtgggcatcagaggctgtagagttttctgatttgtgtacctatctatatattccaggattatcctccagagaaaataacctatagttagagcatcagtatttggagtttcttccttagaagatcctggagatgatatcatcatctcaaaagcttaaacttcactgtaacccagtcatttgatttggggaagagagggtttttattaagatataattcacatgccataaaattcaaccgtttgaagtgtagaatccagtggtttttaatatattcacagagttgtacaatcattataatcaacttcaggatattttatcaccctaaacaaccactaatctactttctgtcgctctacatttgtctattctatatatttaatataaatagaattatgtaccatggggtctttgcgactggcttctttcacttagcatagtgttgtcaaggttcatccatgttgtaacatgtatcagtacgtgtatccctttttattgcctaataatattctattgtgtgcataaataccacattttatttatccattcatcagttgatggacatttgggtggtttccaccttttgtctattgtaaataataatgctatgaatattcgtgtacaaattttgcatgaatatatgctttcattttcatagatatatatttaagagtggaatttctgggtatatggtgactctatgtttaactttctgaagaactgcaagaccatttgccaaagtgactgcatgtttttaccatcccaccagcagggtatgaaggctctaatttatctacatcctcacaaacatgtgttcttatctatccttgttattatagcaatcttagtagttttgaagtggttttgagtggtgtctcattgtggctttgatttgcatttctctggtgactgtgactaatgactttgaattttttctcttgtgctcattgaaaatttgtatatttcctttgaagaaatgtctatcagtttccagtcatttaactttaggacctgttttcaaatatgaataaatctaaaaggtaaataattggaaatgagaaatgtagagaaaaatgaggaaaaaatttggtttatataaagtttccttccttttctaatattcttatctactaaatgactctgaatatttatttcttatccacactgcataaaattaaaaacatttttaaaaggccaggtttggtggctcacacttgtaatattagcacttttggaggccaaggcagaaaattacttgactccagtagttcgagagcagcctgggaaacatagtgagacttcatttctacaaaaggtccaaaaatcagccagcatagtgccatgagcctgtaagcccagctactcgggaggctgaggtgggaggatcacttgaatctaggaggtcaaggttgcagtgagctttcattgcaccactgcactccagcctgggctacagagcaagaccctgtctaactaaatgaatgatgaattatttttttaaatcattatttcctctgcttcaaaaactaaacttttagtattaaaaatgtagaggcttgcttttatttcattctgaatgaaatcctttgtcagagggacccagttgccatgtgctattcagggaaagatggtcagttctagtgctgagatatagtctaagatgcaggacctggatgtttttctcagattctttgattctccagggggaatcagaagatgaaaatcaaaccttagccctgtacatttcagaagcaaggaaaggactagtgagaacaccagctctctccactgctctgatcctaggtgtagtcactccatacctgttaactgagtaacagaaggatgcctcctaaaactgcgaaccattttatagagaagatatgtctattagaatttttcaccacagcaatggattatgggtttttttctgtgtttctattcatgcctcttccatgcattagatgagaagcaaaggcagaactattagacttcaaataaatttggcataatggttcaaaccattccaagtgaaaaggaaaaaatcaagatgaatcaaccaattaaagccatagttgaagtttattagtaaaatgtaaaggtatatcaaaaatgaatagagaggaaaatcttaattcaatgacaatatttcttatcctcagttatgcttgatactttcatgctacaagaaaagttaatatctagtccttaaatacgttgttgatttttcttgatccgcaactgtgatcttgtttaaacccacttagtatccagtaaaggttgccttcattccatgtgaccacagggatggcttaccccttgctctgtttatgtagaattatgtaatgagattatcatttctgcatgctagaaagatgtagtgtttaaccatttcagatcctcctagcattaaattcatcactgatgtctattttcggtaatctcttttcttattctgtcttctataaactttccatatttacttagcttgcccagtggagagcacacaataactgtcagtagcgatcatgagagtcttgaggattggggaaaagtgcaatgagaaagccaggaggctgaaatagaggtttgaaagcaaaagagaaagagggaaatgtctaagcttttctttttcctatttaaaattaaccacattacaggaaattgaggaaaaatgaaaaaaaaaaaaagatgctctcttcttcataatcccatacaaaacaaccactttattattattattatttttttgagatggaatctttctcggtagcccaggctggaatacagtggagcaatctcagctcactgcaacctctgtctcttgggtcccggttcaagcaattctcctgcctcctgagtagctgggattacaggcacaggccaccatgcccagctaatctttgtatttttagtagaaacggtttcgccatgttggccaggctggtcttgaacccctgacctcatgatccgcctgcctcagcctcccaaagtgctgggattacaggcatgagccactgcgtccggcccaaccactttaatttttatatatttctttcagtcttttattctatatattttgcctggctttatataaatcttgtttcctggttttatttaatatgatattatagctaattttttaccccgttacagtcttccacaaatccataatttttcactgctgcataatactccatcaggtggagacaacaaaatttaattagtagtctttagtatgacagagtttgaaagaactctgcttggaaataaaaaagatagattaagagtgtaaccataaaatgaaacaagccaagaaaattaagagagaaaaatttttgagcagaattccttccagtttttcaaaggttagacatgccaccatgcatgagcacaaagcacaatgaagactgagcatatatgattaagaggttagtttcataatcaaataatttaaattattatgatacatttaatgatatgtaaaattttaatagcactttatggtaattagacataaataataaattttaacataggtaaccccataatgtaattagggatgattttacataccaaacaggattctcaaagttcctctttgttctccagtactgttcttataatcgttgtcaatgtcaagtattaccctgacacttgtctcatccaatgatactggaagatatccccccaaaatgaaactttttgtatttatggataaaaattatttaacgtgcataaagtactgtgaaatacaatgtaaagaacactgagataatttggatatattcctgatttcaggtagccatagagatgaatacttcatttattcattcgctcattcattccttaagagaataataggaactaaggctaaagaagtgagtgaggggaagggtcaggaagagccctctgggtcagtgtaaatgatctgaacttgatttcagaggcaatagggagccgacagagacctttcagcaaggtttaaacacacacacatttatacatttttttagaaatgaacatgggagaagtgtggaaaagggactagagtaggagagatttgtggcaagacattgagtcagtaggagacttttggaaaatcccagagaacacaagggcctgctcaaaggcactggcagcaggatggaattgagagagagagagaacgcacatgtttgtaatttaagagattgtctctctactggaacaagctagaagggaggaggaagaggcttaaagaaaaaggtaagttatgcttttacttgaatttgagaagcctctggacagactagaggagaggtcttatttttaggtagtagactgaaacagagaaggggagaaacaagcccttttaaatgttaagaaggaagaggcagaaatgaaagcacacttgtcctgccagcagtacatttcaagaagtatagaatgctagacagtgctcagctacaacaaattgacaagaataggatccaaaaatggacacaggggtcatctgtgaccttagcaagaaaagtttaagaaagttcattgagttaaaacccagacattaataacaagtgtttactgactgttttctatgggcgggcactgttccaaggactttaccgtagattatcccatttaactttccataatcctgtgatatgttttctatcattatctccacctcacagatgaaaaaacaggtttggaggactgagaaacacgaggccaccagatagataataagaaacagctggggatcaaagcaggcagagtccacaagccaagcagggcctcaccacactaagtaatgggtcggaggatacttaggagttgaggaaacagtgaaaacaagtgtcgacatcccttctaagattccatgggttggacgacagaggctgggagagcagctggcccattacccacccctaggaagaatggcagatccttgagcagcgatgatgtctgaggatgggagaagcccaagcaaacaaacagtaaagtgatctaatgacgtgaggtattgggagaagttggggagggatgaagctttagtctgctggtttctgtcaagaaatctaggggtaatggtggggactttaagcaaaatcatggctgatgtgttcaagtactgcatgcaactgagagtggggtgctgtaggacatgcagtttgatagcagcataaaatccggaatcactgccatgggagatgtaaacgaaagctgtggaggaataagtaaaatcattactgagcagtcctgaggcaagagaaaataaattggaggttgtatgtaggtggctacagcattatgggtgaggtggagggtctgggggaacagctgtaaattgatgggtgtcctgaaggaaagaaagtacatgggtagatggcttcagtgagaatggagaggagtttgttgccgtgttttgttttttaaaaagactggaaaaacacgttctttaagtagtaaaatggaggcaggaaatgctgttacggcctccaagcccagagatgatataatagctaatgttaactgagcaccaaagtatgtattggaactgttctacacactttataacaagtctgtgaaatcagaaccttattagagttagctgggagaatgcacagctcctgtgtgtaaggaccaccagcaaagccaagtttcagttaccataaaaagttggaggaaaggatttagtgaaaggaaatgcaaccttagttagaaggaagagagtgggtagatgttttccctctaacaggaaaacatcagtgtttctcgtcttcacctgaacaaggtttcacctggagttcatggtaaaatacagattctgactcagagttctgattctggaaattctgattcaaagtttgagtgggccttgaactcatttttgaaataagctcctcatgatcatagaagtttgggaaacaccagtaaggggtttaaccaccagtgttagaaactgggtcagcagaagagaatgccagaaatgagggatgagagggagggaagagggaaagaaccagcacccagatgagcctaaaaggatgggagggagatccccagccctatactcaaagataagaggctccaagtctctgatctggtagaagcccacaagggactggagaccagtcctcacaccctaccaactccagtagccaagtggagtctcctggctcacatctttaacaaatgacatgagagcacacagaacatcaggtccctctaatcagttttgatatcgagaccaagtatcacatggtgtaatccaattttttttttttttttttttttttgagacagggtttcgctcttgttccccaggctggagtgcaatggtgaggtcttggctcactgcaacctccgtcttctgggttcaagtgattctcctgcctcagcctcccaagtagctgggactgcagccacgtgccaccacgcccagcttatgtttgtatttttagtagagacgtggtttcaccatgttagccaggctagtcttgaactcctgacctcaggtgatccatctgccttggcctcccaaagtgctgggattacaggcgtgagtcaccatgcccagctggtgtaatccacttttagggttaaaatatgtccttttctgaatcaccacctcaccccacaaaagcaacttatgcctgctaccagacacctaaaatcctttgcagggggaccaagggtccaccaccctctcacagttataacagacttaaaatgcaaaagccaggaagagaggatgcattgaaattccttcacagtacagtgaatccatcaatcaaccagtgtaaactactgatctcagtgccctgaacaggcaggttgaacaaagggattcgaggccattggaggcctgggtactggatacctgttgtcagccacctccctaagggaaacagaggtggaagggaaaaaagaagaaagtttcaagtaagtgtcatttttctttgttttacctcagaaggcccaaggctggcctgtttacattcagaatagaaaagccaacatgagagctgcgtactgaggtattcttactctgccagagcttacccaggcacagcttctcaggagtgcagcttcaccatgctcccagggctggaagttagcagaaaagagacatgatttttttttctttttttttttttttgagacagagtttcactcagtcgtcaggctggagtgcaatggcacgatctcagctcactgcaacctccgcctcccaggttcaagtgattctcctgcctcagcctcctgagtatttgggactacaggcgtgcaccaccacacccagctaatttttgtatttttagtagagacggggtttcactatgttggccaggatggtctcaatctcttgaccttgtgatctgcccgcctcggcctcgcaaagtgctgggattacaggtgtgagccaccatgcctggccttttttttttctttcttttttaaggagaaaagaaccgtctgtggctacttctaaagcagctgctgataggctctgattaagagttatcagtaggttccttcaaagtcttgaatcaggaagccacgaaaaaaactctgagaaaaaatatagaggggagtttgagagggctaaatactgattctcacagactttgattgaaaaattgtactgaatttgaaacacatgagcaatggttgttctcaaaggctccataattcagctacttcactacaaattcactgaactgcctctggttttgcttcaaatccctgccaccaccaaaaatgttagaggcaatcaaataccgggttataattcatggagattaatattgacaggcagacaggtccctcctctctgagtttcatgggattggcctccagtgaacctggacacttgacaactgttaggtgaaatctacatgtgcatgctgaatctttagggacgaatccagaatgtacccatgttccatgattatgatgaagtctaatattattatatttggggttttttttaaaaaaaaagcaaacatagactctgattttgaccagtatattggcaaagagaagatatgagctattattttacattgttattttaaaatataatttcataaatgacttctgtattacccacactctttagcaaaattcactaattagcaaaattggctaattctctgcttactatgtaccatcctagtaattggcaaacaaaaaaagtggcagcatcttatatctctgcattaatacaaattagcaggtattacagtgagagctcttattacttgaatacttgttcttaaaaatatatgtgtggggccaggtgcagtggctcacacttataatcccagcactttgtgaggccaaagcgggtggatcacaagttcaggagactgagaccatcttggctaatatggtgaaaccccgtgtctactaaaaatataaaaattatccaggcacagtggcacgcacctgtagtcccagctactcaggaggcagaggcaagagaattgcttgaacccagaagatggaggttgcagtgagccgagatcatgccactgcactccagcctgggcgacagaatgagactctgcctcaaaaaaaaaaaaaaatatgtatatatatgttaaaaatatatattatacataatatattatatatattatataaagaatatatattatataaagaatatatattatataatatgtaaagaatatatattatataatatgtaaagaatatatattatatattatgtaaagaatatatattatatataatatataaagaatatatattatataatatataaagaatatatattatatattatataaagaatatatattatatataatatataaagaatatataatatataatatataaagaatatatattatatataatatataaagaatatatattatatataatatataaagaatatatattatatattatataaagaatacatatatataatatataaagaatatatattatatataatatataaagaatatatattatatataatatataaagaatatatattatatataatatataaagaatatatattatatataatatataaagaatatatattatatataatatataaagaatatatattatatatattatataaagaatattatatattatataaagaatatatattatatataatatataaagaataaacatatatactatatataaagaatatacattatatatactatatataaagaatatacattatatatactatatataaagaatatatataatatataaagaatatacattatatataatatataaagaatatattatatattatataaagaatacattataatataaagaatacattatatataatataaagaatacattataatatataaagaatatatataatatataaagaatatatataatatataaagaatatatataatatataatgtatataatatctaaagaatatattatatataatatctaaagaatatatataatataaagaatatatatgatatattatatataaagaatatatattatatataaagaatatatattatatatattatatataaagaatatataatatataaagaatatatattatatatattatatataaagaatatataatatatataatatatataaagaatatataatatatataaagaatatatattatatataatatataaagaatatatattatatataatatatataaaaagaatatatgttatatatataatatatatgtggacatttatttgcccatggtatatagtacacacaaaattcacaattttttgtcacaatgacaactgctgctcatatttgcatttcttcaatgcttgctaatcaaaatcaagtgttccataatagatctgctaattacatatgtcgttaagtagtaacttcctcaaaaggctgtgttcaaagtagataatgccaagctttggaaggtcggaaggtactgtatatttatggtttgcatatctactaatttgtctcctctagttttacccatttctgctcgtcatctttaccacttgtttgtactgttttagagtaatccttccagctagcgttaatgccagtcttcccatctccattgcttatgctctagcttcatgtccgtttcctttgaatctagtgatttcccaaccaataaaagcgaacggagagtggtatgtattggtagacaattaaattaataaacctatatctgaaaagctcagaaacatgtagacaatgtatatatttctgtttgggggaggactgcagttaatgagtaggaaaggggaattagtacaaggtctaacaagaaactagagggatgcatcaagcagaacagaaataactatgcatttccttctttaacctttcctaatcatttctctccttttccttcttgttgtttaaaactttttcagttttagactaccagaaatttgcaaagaagtagcacagttttcatatactttttacccaataattacccccaatgttaaaatagtgcgtaacgatggtacagaggaccaaaactaagaaattaacatggttacaaaactattaactaacctacaaaacttatttgaatttcaccagtttttccattaatgtcctttttctgtttcagtatctaatccaggatacaacattgcattatttgttgtaactccttggtcccctgtgctagctatgtgacagttcttccctttttccttatctttcatgaccttgttactttggaatgtagtagtgagttattttgtaaaatgtcactcaatttgggtttttcttaccatgattagattgaggttatgcatttttggcttgaatactgctgaagtgatatactcttcttaggaagtacatgatgttgatgtatcttataactagtgatgttcatcttgatcatttcattaagccatgtccgctgggtttcttcactatgaagttacgatttttccctttgtaattaatacatatcttggggaagatattttgaaactatgcaaatatcctgtttcttttcatgttttcacccacaacttttaccatccattagtggttcttgtcagtagcaatagttaccatggtgtttcaatggtgatttcctgttgcactaattccttctacattcattaattggaattcttatctaaggaagaactatactttctcccaccactaatgtctctattcgcttagttatgtcattatgagattcatggatatttattttattctaagggttataatctaggcctatcatttattttgttgctcagattattcagtattggccactgggagcattttcaggatagctcatgttccattttaacttgtccataccttttgaagaagtttcttattttttggcaccgtgaaatgctgtaagtttacctcataggttccccgccacagcccaggaatgaaccacttctccgaggaagtctggctcctttattgtagaaaccaagatctgagctctaggaatactcattgcttgagtatcattgtttctagactctctcaggaaacagaacctggaaagtttacatagatagatagatagatagatagatagatagatagatagatagatagatagatagatcgatctaaactatgtctacacatatctatatttacttccaaatctatctgtatgcacattaaaaaaccatgagtttatactgatacctccaattctaatccaataccacagtaatcattctagcctcttcctctttcattatttgtaacttctttctcatgcagtaagaaagctgtctctgactatctgcaatataattatttgttcaaccctcatatattcataaattttttttcagaattgctaatccataccctagtactaagcagagtgcagtacttgtgtacatttctttttgcctttagctttgtggtattttctcaaaatacggttttctaatgatacttagttattttctttctcaagcccttcagtgtggttatgttagttatttgtaataacattagcttcacttgttatagtttgtatatctgtttgggttccctccataccttggttgattgttttaatgtacatacggtgaaattcactctgttgtatacagttctatgggttttacaagtgcaaagagtcatgcatccacagtcatgatacagaatagttccataaccccagatttccccctcacccctcaaatcactgatctggtttccatctctgtggtttcatcttcctggtatgtaatgaatggaaccagacaatatgtagccttttggatctggcttctttcattagcaaaatgtacttggtgttcataggttgccgtgtgagtagtatactgttgcatgggtgtttacttccttcttctaacctaatttgtgattcttgcccatgcatctaatgtttatatttataaaattgcccactggcttgatgcttattggattgctcctttgggactctgaaactgacttgaaactatgttttttatctccccttagcacagtttacctcacttcatcttatttactgtggttacttgccacaaccatcagtcattttaacattccaaggagggttacagccaacccttaattatttttggtaagtttgacagagagagaatggataattgaaatcttcacataatctgcaagccttataatagctacttcttcttccctcaactacttaaaggtagcaaaattgactcactttaagttttatatcctttcccttcctttacttatcctctggtaggagcactaatgagtcctcaggtgaccataaaaatggaaagacagagaaaaaggggaagcacaggctgtgggtaatctacataggagataaaaagcctctgagtcactgagaattgatgacactctagtaaaatagatctgagtagggattttgtgtctttgactatttttgattcctatataatgcttggtacttgttgattcaatgatggacttatggtcagtcctaaaagtccacctaaaataatatactcctactcagaaactgccaacctcctagctctattttccttcctagctgtgtctatgtgctctccacggcaaagcctgaggttaatttgtggtatggggagaatcttaattgcattaacgcaggcatttgtaacttaacatacatggataggtatacatagtcttttgggaatctgtgaactcttagaaattataaatagaaatgtatacacatttcctgggagagagaaccatagtttccatcacagttcaaaagtgtaaagcaaacaaaattaaggcctttgaccagcaagatcatctatagaactcctgtaatgctgacatactaaccctgagagccctcatactctgtttctgggagatcttcctttgaactctagaaacattcactagactataaattccttaagagaaaatattgaacctttttttttaatctccagcacctcacattagagcctgtataataggtatttgaaaaatacttcccgaattaatttgatatttttaggctgataggatttcttagtctactgatacaataagaaatctgattagcttatgttgtttgtgagatacataatttagtttgcaggaatccacaaagctttgtcatatatcagttaattagctaataaattaccaaattcaagtgagtttatgcagtactttttttcaagtacttcttatactcacaccacatgcctttctttcctaaatccctgtaaaacctagaaatatattgccccttctcttgctacctgatacagggagagtttgactgatttggaaaagaacaatatgcagtgtgaaatcttaacaaaaacgttttatgttagtgttttaaactttggtacacagtctaaattgcaaaaactgtgtcattatttagaatggacatgttccagcttcgttaatttataaattcctatagagggctttctggaaaaacactgataatccgtatgttcagtattctaaaaaatatacttagcctgagttttggaagcctagtgtgattctacttcatctaccaagtgctacccaatctcttttacatctcgccacgctaatctcttttacatcagataatggtaccattgaaaggtaggtagcacagccccatgctgtctgtgtcatttctgacccccctgactcaacattagttgaggcctaggctagtagctaccagtcagtgaaaagctcaatgagatatacttaaggtagctacattaattaaaatgcatatatacgtacatataaatatataggtatttcagtataccaatactttgcaaattgggatcccacagcctgaatttgacccatgtagaccttatttggaagccacagagtattaatttttaaaaaacatgagccaatatttaaaaatcaaggtatttcactaaacaaatttttaatttcaaaaatatttttaatagaaatcactggctcatgtttaaaactttctctataaatttaagtttcatgataggcttttatatattctacaaatttcttttagagctctagatctgcaattctgcgatattacaaagtctggaatcgtgttttgtctttcacctgtgaaaatgttactgttaatccacatatggtcaacaaaactggcattgagctgtttttccgggagaagtgatggattcatgctgctccatccacatattcttggcaagtgcccttttgaccactggcatgtatttttaagactctctggggttgggaggagagcctgtggtaatggaaaagatccaagttaactggcccacacaggggagccaacccatgaccttgaccccattaccacagtgttctaaccaattgagctaaataattgagtaattgtttcttagcaatctgatcaaatcagatggcttataataagactctgtctgtgaacaagcgtgaggatgtcagtgaacagagagcttaggataaggggaaagttatccagtctgcaggttggttggcattttatatttggccaagtagtcaataaattggactttgtcattatggctaattgcatttctgagcaatgagaacttaccaaaaaaaaatgaaactttaattaagtagagttttttttttttgttgttgaaggattcagatttttcagttcataattgacaacatatgtacaaacaactggggcaccgagcaggagggaaagaactttgtgctgagttgaggggttcaggtccctgtttgatcccagctacttagtgtgatagtgtgaccttaggtaggtcacttgactttctgagctttgggagggattagataaacatgatctcacagatccccctatccctaagaaactacctcttaatttttaaaccaataaaaatattttgcaacagatttcttcctaactaaaaatgaaaatggaatatttttcacagaggtagataattaaacaatatttcgaaagtatttattgaacaagcttatttttgaaatatgttggtgcttgcataaagtcagtcagtatataatatgcatatttcacacagaaatccaatacatttataaatacatagaccatagttctatatactatgtgattggttcttaatggcattttatatttcaaagcacttatgaatccccttgaaaatgttgccttcttaaataatcattgttttagatgcaagacattaatgaaattgctttggaattactattcatgaatcttctgatttgggtccattaatatggcctttgtagaactacctctcctccctctaacttgctaaatttagattaaataatttaagctcaggctttccttaccaaattgttcatttttctggttcttctttcttttctttcttactgatgcactcaaatattacttttatagaactgagataatgggtggatttattgttcttttatccaaagtgattcttccatcactggattgactggattagtgagcatgtggagctcagtaggatgggtcctggagagtgttagggttggtgtaaaatgaatgacaacagcttagtcacacttgaaaaaatatattggctcgagtttccaaataaccttccaaaatgaaaagcacaaatactgtgggtttctacagaatcaaatatgactgtaatgtttgtaaaaaggattagttattggaggtcacttcaatattaggtggggaagtttagaaatactaaaaatggggagaccagaagcattaaatccaaagccaaatacaggttgcagatgctctgggtaatggttgccagtccagccgtcatctgagtgacgctgctggtgttccctgcaccttccagagccgttcagaaacacaggctgccagtttttaatgcattatggcagattatgagacacctctgtcatctgaataaacacgtagctgggcagaagttttcaatatcagttctttatgtgataggatccaaaatttatctcatttttaaaaagagccccagagatgaggaaacactctctggtaaatttacttgattgagagtcacccacatttcttttaaaggtatgctcaccagagaccccatctggaatgttccactcagaggctcagacctctggttgatttaattatgtgcttcctaggattgtgcatttaattatatatacacaacaattcctagcaccggtttcttttgttattctgtgagaacactggcagccattttgaactgtggaagagtattctgcatctgcaggaattactcatctgtggtattgaagaaaggaaaaattagccattggtacaggaaagggaggaagaacaaaatacacttacatagcagaatagtagtttcacagtctagtagacaagcaaataggaggctgatgctgtggacagactataaatcaatttctgatttctttggtcaaattgtaaatcatcactatgcgctaagctaccatgcatttccaggtgagagtatacaatacttttgtgattgtgtgttgtttgtaatagctctttctgaattacaggtgattagaaaaccctgttagaaatcaagttgttgttgtttaattctggatatatttgctttagtgatattatgctgctggagaatggaattatatctacttttataaaactatattaaaatcccatgggaaatctatttctatgaaaaaaaaacttgtcttttgttcaggcccctctggataaaggggaaatgttgttgatcacaatggccccgaaatgactgtcccatcacactaggtcagctccttccagataaggtgctatgggtcctggagggtgcctagaatattcatgatgtggttcaatgaatggataacaactatacttaaaataatgaattactcctcattttgcagttggtaactctgtcttgctcatagatcccaaatttctaaactcaaaggagaagctaaggaaagagggggtggttctaaacttttaagaaacgaatggagatccttgtaggcaacattcgtttgacaaatttcatagaaacttgtgacttgttggccctagaagagtcaatgttgtcttatgtagaatttcatttgagacattcaggatataaatttttttttctaagtttattggtagttgagaatcagttccattttatggcctacttttaaggtacttacacaataaaaagagatattagttaactttaacatcaaaatattgaaatctgatcccttgccttacaaactaagttagggctcatattttccaattacctctttcttcaaaagaactcttctatgaaagagtacatacaaatggaggtattattattattttattattattactttttgagacggggtttcgttcttgtcacccaggctggagtgcaatgacgctatgtcggttcactgcaacctccgcctcccaggttcaagggattcttttgcctcagcctcccaagtagctgggattacaggcacatgccaccatgcccagctaatttttgtatttttagtagaaacagggtttcaccatgttggccaggctggtcttgaactcccgcctcggcctcccaaagtgctgggattacaggcatgagccactgcgcccggcctgttatttaaaattctcttaatggtaggatgcaatctaatgtcaaagatgtgtagcgtcaaaactttagagagcaaagcaacaacttgacacatatatttatttgatactttagattaaggaggccataatttctgaaactctggaatgaaaggtctaagtatgagatagacatcatgttttttatagaagacatcttgcagattaatcatctttaaagatggctttgggtttaaatttcattcgaggaataaatttgagttctgttgaattgagacatctcagaaattaacccccaacaatttcccttattcaaaattgcttttacatttatggaaaacaaaacaaactttttaaaaatcaaagttgagagctttcaccttttaataacagtttcaaacttaatatagcttattaagaattaatataataactctttttattgtttaagcctctcttaccagctctaccatgcattaattatttttcttcttttgtatttatacaataaatgcttgacaaaaaaaaaaagctacataatttaagatttttatgacacaatggaaaagtttcttacccccaggggaaaaaacaattctatgatgttctcattgtctttccaggcaaaattttatatattagaaagaagaagaatatgaaaaaaaaaaaagctctagttatactttctgtgatgtgcagcaggtttggaatacatggaacataaaagaatattacatgagctataaagggttaatgctgtgtgttcttaattttaaatttcagataaatatgatttcagctgtgatcctacatggactaattcttttgtcactcaactaattaattcggtatgctagagaaaagatgcgaatttgggcatcaaagaagtgataattttttttgtttaatcagttataaagataagttttactcccattagactgggtctggagcccaatcattttattcttgtttagtgcagatgaattccatagaaaatgtgccctgtttctcttaacatctgaagatggaacagtaggattcaggattcctgttaaaatggtcctttgcaaggtaattataaaaaaaaaaatcatttcttcatattgtccgtttgttctccatgcataacaaggcagacaccatcatctgttcgttccgatcatggaatatatacaaattgcccatgtgttactttatgctatggaaagtaagttgtatttgatgttttatttagagactgcagatgaggcctccagcttccacagaatttttagttagcccttgttggatttattttctttgacatgagtcagttttttcctttctgggcagtttgctgagatgaccccatttgcctgtcaatggtaacttcagagctgtttcctgtggggaccatttccttctgcaggatgaatctgtggccagtgtggagcaagctggggccaactgggcctgggaagggcaagtcaaacgggcaacctcccacagttgatagaaagttcagcagtgaagtatggtttggtctcaaaacactctttcctttcctagttttcgggtttccggggcaaaggaggtagagaaaagggaaggaaagaggaagaaggggatgttgtgggcgcacaaatgcgaaggcagtatctggctattgactgaagtctgaattccagccatgtgatctgtttaaggcagtgttagggctttatgcacatgccatcagttgtgtctatttactcaaccagccttcagaaaagcccgaagatccacttaaaaatcataatcatgaaaaggaagaagacatattttctactgctttgaaataagtaaacatttaacaaaaagaaaagcttttttaactattaagaaaacataaaaaatgcaaaaagatctatttccataatgttcctgttaaatatctgtcccagaaatcgtaagcatttcatctgagtcactaaggctcttgactaccatgttttgaagccagtgaaagtgtatgaaagcaattaatcaaagttcactgcgctcctgaagagtatttcttcttctggaaagcagaggggtagaataacttaaaactcaatgacagtgaataagctttttagagtccctgtttggatctgaaaatcataccttattagtatctttatctttcttgcccactcattcacgcttatttttatttaattttaatttctggcctttttttcataagtttccctttttttccccctaacagagtgctgctttaataatctcagagtacagtttttatttgctacagaaagctcagcaaaagcaatatccagtgtctaacaaatctcttaacttttcttacaaatcgtccattcagaggctctctcttttgtttgtttggtttaaaaaatattagttattggtgatctgtgctttactttactttctggaccctctagaattatttttaacgtatctggtatttctaaatccattgcatttcctagcccctcggtatggggaaagcaaattagctcagggattcccagcagctgaatttagctagagagctgcttaaggctctccccagcagatgttttatccacttagaagttgtagaacgttataggacctccctgctttttaatcctaaaaacaaacatcaacatatttgagatctgaagattccctgattcagaatgagaaattgccatgaccaccaatttcagggccacattctagaaatgagtgacaacccagagaaaagtagctgctacatcttggctggataaaaaaggttggccttaaagagggtagcagacacagataccagtgggattaaacaggtttgttgttttcatatagcttgtcatcatcttggaaacatataaacatacccaggataaatgtctaaataacatatcaaaatttaaaaatttaattagaaaacttaatttcagggtttaaactgcctgacccagttaggattaattaggaagatttttaatattgagtttgtcgttcgttattaaagcatcaactcactcagtttctacttgtgtacacatcctacaaggcaaatccctatctacttttgcatgccatggaacggatttagagtttaaaacacagccctactgttgtgaaaagcatcctgggttttgtagcattttgcctccctctttaaaagctacaggcatagccaaggcagtgtgggggaccagaaatagaattagaatatttttccttcttaatgaagattgatgtgcaacaaacacaaatctgtttattattctatcaataatattaacataaaagtgagtaatgtccttagggacccccaaaaaggggttgggatgggaactctaattggtcaattttcactgaatttttatcagtctcattaactctcaagtacaatggaaccatgtgagataaacaagaaaagaccttcgtgacacaaattttagaagcaaaagctgcggttcacaaaaccatatgagattacaatacatggaagttaatttcatcagcatatgcgtatgctaattcagaacccaatttagaatacatctgacaagagaaaccttttatagggtgaatttcagaatcaactatggaaataatagtaaagggcctatgaacttctctgcccctatattttgcttgaactatttcaaactgtgtaatttataaaatgtaaggagctatcatgcctagtttgtaagtcagctagttacagagtggacaaacaatcatccaggtccagaaaatactatgactgtgaagtttgtaggttttcacatgtgacattgttccacagatgtcagactttaatagtagcgatgactagatgttgcagttttttccaaatgcatcatagacacccaaagacgtttcctgataggagaaggagatatacagactttgtttcaaacttttcagctctctttggattcatagctaagcagctattttgaacaagagtgaatgaactttttccttgcctgactttttagttctcacaggacattgctcaggatcacttttgtatagtgtgtgcactaagaggatgtaggttggtggtaataactgcataaactgcccagtgtgatgtgggaggaaagttgtagatagacagaatgtagccaccttaagaagtgaactaaatgagagagtagacaggaaaaatgccagaggacaagctgtacatattgtaaatttgaatcattcatcagcgtatgtatgggagtctaggaggaatttgaatgtcatcattacttagaaaacccaaggaaagaaatagaaacagaagaaaatatttgctgagaaactaggagaaaactattaagaataatattaaaatctttattatatagaaaaaataggattctagggacttagtttaattgaggggttagatatttacctgacaatttatgttgttaatggttcaattctgtgtgcattggctattgtgatgtgtagtggctgctcagtaaggaatgaatggatgaatgaatgaacaaaccattatcaaattccacttttccagatggctgttcacaacccccctacctaggcaatataacaacattaaggaggtctgtgtggggggtttttctataaccctctctgaggttcttgtctaccttgggtaattcaatctttgatttcttaaattctactaagagatctcattttgtggatagaaaccatttttcttatacatgctgcatcacattaactgataaattaaatgccctggaattcctctactttctctttaccagctccataaacaagctattttcctctcctaggctgctgatctttctgagtctccttccatctaaggctaatctctccagagacactatctctatcctcctcccttatcaagaactttcatctcctatgccaatgttcatagcagccttatttacaatagccaaaagatggagacaaccccaaatgtccatcagtggatgagtggataaacaaaatatggttgtgtaactgcaatggaatattattcagccttaaaagggaatgaaattctgacacatgctgcaacaaagatgagtcctgaagaccttctactaggttaaataagccagacacaaacgaataaattttctgtgatcccacttatatgaatttcacatagaatagccaaattcatagagaaggaaagtcaaatagcagttaccaggcactggaggaaggagggagtggggagttactatatgtagagtgggtacacagtttccatttgagatcatgaaaaattctggacatgaatagtgtgatggtttctcagtgtgaatgtgcttaatgccactgaaatgtacactgaaaaatagctaaaatggtaaattttatgttacgtatattttaccttaataaagagggaaaagaaatttattcttctctgtcctccatctccgacctctcactctcttttcctttcagcaactgaaatattctatggtataagccaaattgaaaacctccatcttcagcactcgactgcacctgcagctacctccctcccagccaaccattacccagtctataatggttgtacagacacttatacttacccaccattcactcttcagatcatgcctacatggcttctgttcacactactccgctgacccttgccaaggctatgaatgactttatgttgccaaatctaatgaacgcttttcagtcctcacctcgttgggcatctcagcagcattcccatctgttgactttgtccatcttcttgcagcattctttaaactcttttgcaaccacattctcttgactttctttctagctctcttgctgttctttctctatctctgttgtccacctgcctctcccccaacccccactcgtgtctctgatctttaagtgttacagtttttcaggacttaggcatggactcatctactggaatttcccaaagatatattacaataataatcatgttttaaattgaatcttttgatacctcttcattgactcaccatttccaaatgactatcttctcttctcaatggccacttctctagttcaagccactgtcatctttcaccgattcctgcagggatccccagtcagttaaatcactggttttaattatgttactgcttttacttgctgctttttacttcagcatcaggatggtctttttaaaatattcatcacattgtatcacttctgctcaaaacacttggttcctctgccgtttctcctccactaactctgtctcctagtttcctcacctagcttctctgcgccttgaatgactgagaaatgacctcccatcactcttagattaaaccacaagcttctctcacacctgtccccattggcttttccatctgcatcctggcggagtttcctctctcatctcccagcctctggccttcttttactgttttgaatacatcaagccttccccacacatgtcctttgcatgtgctgtttccttcaccctcaagacttttctcccactcttcacttgtctggaacttctcactcttatattctcagcttaaatctatttttttcactgaggcatttcccaggcagtcacttccctgttattgtctcttctaacatcctttacagcacttatcacaactaacaattatggatatatacttgtttggtaactgtctcctctgttagaatgtaaatttcatgacgatattgtgtggttttgtatgccaacataatattaacctatatcaattgcttataatttctgacagctagtggatacctaataaatattttttgaaagagagcgagtaaggaaagaagaaagatttttccatgaatctgtttcatatgacctctatagaaatgaacagagaaatggacaggtgttttaagcaaacttataattcatgaacatctaaatttacataaagcgtatgttgaaaggtgatttttccactttacaaaaaagatccatcataagattctttaaacaggcttcccaggtacatgtaaaaaaagattttattgattaaagccatatgtttgcacagaattttttaggaaaatatcttttatataaagtaaggttgacctctaagcaatttccttaaggcacctagcccagaattgccaactctcaaatttctaaggtaacagataatgggaggcctggaatgcagtgcatatttgaaactctagaatataaagtagtaattttagccattcagggttcgtgacttttctcacaaaaatagctaatgggaagataaacctcctcaattcctctttctatatctcagtaaaagtaagagtggctgtgaaatgatccccacaaaggctgctacagaaaggaaaacaaaggcttggaaagtcaccaagttgaatctttccccctcactctctcccccggtccactactgccactactgataattaagttgtcttattgcaaaatgaaaaagaattcagtgtgttaataaataaaatgcaattaacttctctgggtctcaatttcctcatcttaacaatgcgggagtttttgtttttgtttttaagattattgttttataatgcttttcttgggcctacccaaactttacaaaataaggtaatttgtaatcattttctctggctaataaaataaatttcacatgtatttctgcccttcttattggaaacttgaatcgaggatcatgaactttaaatcaaagcatttataatatttgtagaattgcttgatttgactgttattggcagttcttgctaagaagaaaatactttgcagaatttactttcaactaacatgttttttttcttaccaaacatattccactgtgagggaaggataatgagctattgctgaactgcagtacaagtcaaacattttagctaccagaaacaaaaataatttattgggtgtggtaataaacatcaaggtaggctaggaaatggttagttttacccttcaaaaacaagactgcttttacctcagaaatcccaaaagctgcaaatataggagaaataatatgggacatggaaaaaaaagaaaagcctgatacctgtaaagcttttggcaaaatttttgccctcatcaacctcctaaagcattatttctaccctgactccccaccgtgttgaatattttgcccaaacattactatatttaatgacattttaagcaaaagttatgtatctcaagtgatgtactgagctattaacttctcacgtaaacatacttagagtaataatgttgacccctaagactcttctgcatgggtctggaatgctaaagaatgtattcatgaaaacattatttagctatctcctgctttgtaggttaaggagaagtcttgaatgtatcaggcaaatctgaattatatttgaaagttaatgttctggccgagcacagtggctcacacctgtaatcccaacactttgggaggccgaggcaggcagatcacctgaggtcaggagttcgagaccagcctggccaacatggtgaaaccctgtctctactaaaaatacaaaaaaattagccaggcttggtggtgggcacctgtaatctcagctacttgggaggctaaggcaggagaatcgcttgaacccgagaggtggaggttgcagtgagccgagatcgcatcattgcactccaacctcagtaacaagagtgaaacaacgtctcaacaaaaaaagaaagaaagttcttatatttttgtctgtatttttctcttttccgtacttctgtaaatgatacatggatatttcttcagtgaaaaaaaaggaataaattcagaaagggaatcaggaaagagagaaaaggacaaaaaactagactgggggatgatagcattagagctgacagttggttcgccagagtcccaagactagactggctacaaccaaaaaactacagtaggagtagagagagatggagagatggcaatggagggagaaaatttaggaaagaagacttgctaattgaaatagtaagttgagaaacatgcagaatactggaagaggcttctaggaaaggcaggaccatggcacaattatgaatataagcaatgccaccttccaggtgtgatactcagagctccgacttgactaacatcctctactatgggtcaaaacacagtctaggaagctgcaaatagatgcccattgctatgggattctgaagaagacagaaacatgtgcttgttttatgattcttctattattctgattgcttacagtacaggactttcttcaaaatttatatgtcaggtcctcatgtgaggagactctgattctctgtgtgtgtgctggggcagggttgggggtatgaagccggcccatacatgtataatttgaaaaagtctaagaatcgctgggcacggtggctcacgcctgtaatcccagcactttgggaggctaaggagggcagatcagctgagttcaggagttcaagaccagcctggccaacatggtgaaaccccgtctctactaaaaatacaaaaaattagctgggcatggtggtgcatgcctgtaatcccagctacttgggaggctgaggcaggagaatcacatgaacccaggaggcagaggttgcagtgagccgagatcatgccatggcactccagcctgggcaacaagagtgaaactccatctcaaaagaacaaaaacaaaaaatctaggaatctccccaagttttttttgttttgttttgttttgttttttgtgtgtgttttgttttgtttgtttgtttgtttttgagacagagtatcactatgtcacccaggctgggctgcagtggtgccatctcggctcactgcaacctctgcctcctgtgttcaagtgattctcctgcctcagccttctgagtaactgggactacaggcatgcaccacgacgcccggctaatttttgtatttttagtagagacagggtttcactatgttggccaggctggtcttgaactcctgacctcaggtgatccacctgccttggcctcccaaagtgctgggattacaggcgtgagccaccacacccagctgcatcttctttttttatttcaaatgtgcagttttcattttcctaaaagtacaaaacatatatggtatttttgtaaagcatcataactgccactgtgcccttgtaactatatacatcccaggcactcaggaatgctcagaacatactaacccagagaaacctccctttctggggaattgtattatattttcattgtgttccagagctgactcaggaagctggggctgcattagagagtgattgtgcataaaggaaagcgtacaggcagagatcgggttctaatctcagccctgccctgactctggtgggaggtcttggtcaaggttcgacacctctcagagcttttggttcttcactggtaaaatgagagcattgaacgaggtgttcaataaggcctctcgtggcactgtcatggtgtaattccaggagtttacctttaagtgccaatgacactggagctcgggaagcctgcttaggagattgataagcttttatttatatattaatgataattctttagtttctcactctctattgcattaataggtcatcataattagtcttgaatatttgtctatctaaataataaggaaaattttcaaattatgtatgcttaggctgccccttctcccctaccttctgtcgacacatacaaagggaatcagaatctcatcacaggaggacctgacgtacacattttaaagaaagtcctggcagtagcttacatctataatcctagcactttgggaagccaaggtgggcagatcacttggggccagaagttcaagaccagtctcgccaacgtggtgaaaccccgtctctactaaaaatacaaaaattagctgggcatggtggtgtgaacctgtaatcccagctactcaggaggctgaggcacgagaatcgcttgaaccccgggtagcagagatttcagtgaacgaagatcacaccactgcacctcagtctgggtgacagagtgagacgctgtctcaaaaaaaaaaaataaaaactaaagaaagtcctacctctaagcaacctgagtaatagaagaatcacaaaacaagctgatgtttctgtctttctcagacttccataaaagcacgtgatattgtgcatgatgcatgataaatatgagtgaaaagaaggaaggaaggaaggaaagaagagagaaaagggggaatttcataatggcattatttttctgctttcattatcttattttagttccattttatgcaaaatgatcttgacttacttagaataaagaagtatgacttaatgagctcatcccataaatatcttagctctaccgcaaaaacaatgtgattattgttaacagccttctccttcacgtttcactagatttggaaagaagaaagaggataagggtggaaaggctgagcagaaaggtactctgaaacatggtggcctgagagaagaagagctggagaaaatgaaagaagagcgtgaaaggtgagcagaagtgccgagaccttcattttctttgactctatggtctgggtttaatttagatattgcaacagtcaactggagaaatttcattttaagaagtataggggttgaccgatctgaaaggaaaggtgtctgatacaaaaagaacctccctttctggaaatttttattctattttgagaagaaatttgcttcatgtttttactatatcagtgcctataattccataacacactaccacctgttttgaccataaaaatgcatattttctccatgtctttttttttccaaagaaaggtcatttggatattgatgtttagaactatccagttcccatagtctgttcctaattttagtcaggctgttgtataccttcttaattttattctgcgcaatccgtttgggtcctgtaatttgagaagtgaatgtccttcattctttaaaaagacactgtcttttattaggctatcagcaagctgaagagtatgttgcccatctgttaaagggccggcttcatttgctggaataatgctggtttgcaagagctgaattctcctgcttgaggagcttaatgttccatttggacaagaggtccttcacgtatctttgatgttaactctggcacttatcgcaagtggatgtgtaaatgtctgattttcaaacatgtaattgaatgttcatatttctcctgaaaattctttgccttcacaactaaatggagcttggagaaagactgagattatgacaaaaccagcatataattctaagcgtttgattctgacttcatcgtgtatgtactcagatttacacaacttttcacttgcttattagttacattagttcttatagtttctaaagagaccattcttgtattgattttattactttagtatgtgtactaagaaaatcatatctattcattgtgttttctagcacagaggagtctaagagtatctactgttagcctttgacccctattttgtagtctgttcccgttgagaaggctgactttttcaatagcaaggaaaaaaagctatttagtcctttctcatttttgagaggttgataagctgagttctaaggtcactggagcagttaaaaggaaatcaagtgttttacattgttgttgactattcacctgacagagctatcctgaagacatgaaagatattctccgtcataacctaagattcagcaatcctgtaatgtaaaatgtaatccaggctgagattttaatgcatatattggcaaaggcatctatgtggggagcctacatcatagatctttgctgctcccttgacttctcttactgaggttacatcccatgcctcatcttcaggaaactgagctgttttctagaatgcagactttacatttttttgtagctcatacttacttgggacaggggaaaaaaactcttagtagctggggaactgtgtgccagctagaaaattgataacccataaaataaggtgagttgtctttaagcaagggttcatttcctttctggttttgcctttagtaggcaggtgcctgagggagccttgttcttaaaagctgagctgtaaattcacttcagctggctgtataggcttcggatccaattttcttaaaatatgtctggtcaaaatagtgaaagaactatactattagcctccacttaggccacttcccacacatgaacacataaaacacatctgataggggtttcctagagacaacattgtctcaatcatgtgctagaggaagaagttgaggagttgattttatggttgggtgctatagaattaatgaccaaaggcatttcaacagctcaggggctgagagccacggatggtggaggtggaggctgaacatctggcattgctcccaaccctggagtcctgatccttagctctccatcatctatgggaaaccaattcacaactcttaaagaactcagcgagtgtatcactcttcatgatatggcaatgaaaaaaaatagaatagagtaagaaatagtgataaaacctattatacttttctcctaatatgtttgaaatttgtttctttgacgtgattcaagccatcctgttgcttacttgtctcatcctgtcataggtatcataatagatttacattagcatatctcattttcaaaatatttaatgcacctaaataaaatatataccataaagtactggagccagcttgtaccagcttataggaaccaattgttaaactttcaagaattttgtaagctggctgataagccattggcagttcgacattggctatagtgagtatatttatagcacagtttctctgaagacctagtttaccagcacactgctacaggtctgtgacagctatctttagtgcatatccaggaggcaattatccaaagaggcaggaaaaaaaaaaccaaattcaaccacatgatttcttgtagctgagtttctcaaaatgtggtccagggaccaactacatcagaatgaatcattagaagaccttgttaaaaatgaagattcctgagccccataccagacttacagaatcagaaccttgggagttggagcccaggaatctgtgtttcatacacaagcccaaggtgattcgtcagcagtctctaaagtctgagaaccactgacttggaggagcagaatttggctataacataaaactattcttatttagtgaaaaatgatacacaggatttttttctcaaaaggactgagtggcccagtctacaaatattttccttgttcttcatgtaccttctccgaaatatcttttcttactggtacaatcttttgtaaacaaattagaaaccctagccagtgctcactcaattaagggaatatgggtcacttgcccccagcacccctcatgcacacaaaacttacaaaagcaatatcagttcattaagaaaattttggaaacataaaaagtataaaaactattaaaaccatacataactctaccataatcccataaccactactaatattttataatcttttttttatgcatatacagttggctccatatccacgtcttccacatctgtggattcaaccaaccgcagattgaaaatatttagaaaagaaatttcacaaagttcccaaaagtaaaatttaaatttgctgtgccaagtactacattgaagctatgcaaatgaagtgatgtgtaggcactgtaataggtattataagtaatctagagatgatttaaagtatatgagaggatatacataggttatatgcaaatattactccattttatatcagggagtcgatcattcacagattttgatatccacagagtgtcctagaactaatcccccatggataccaagtgacaactctctttgaacacttgatatccaaaacctgcatctataacatcttgcttttttcatagcattatatgttgaacatttttcccatgtcattaatgttttaaaatatgtcatgttgatcactgcctaatattctatgagatcaatatacgataaactatttaccttccattgtcaaacatttagtctgttcccatttttatcccttttttctttcctttaaaaaaaaaatggagacaaggtctcgcgctacgttgtacagactggtctctaattcctgagctcaagtgatcctcctgcctcagcctcccaagtgctgggtttacaggcaggagccaccatgcccagactgttgccatttttcactgtttcaaataatacttggatgaatatccaggtacaaatgtctttataagttacctcctaaatcatataatcctattgaagttttaatttccttgtaatcattttaccctaggattgatctaacctcaattctaaattttaggattttatattctctctccccattcatctaatttttttgtgctgattttcatatctcattttaagttatctacatatctaattcctgatccgaaaccattttgctgctatatatggatagtttatctatagctacatgtactgaaaaagtccaaaaagccataaaagatgagttgggttactagattagattagaggaatgcagagtctagaacagtggttctcaatgggagggggcagttttaccacaagggcatttggctatgtctggagatatttttgattgtcataactcgggaagaggggtgagcagttactgccttttactggatagaggctagaaatgtagctaaaaatcttacaatgcacaggacagctaccctcccccacaacatgaatcatccaacccaaaatgtcaatagtacagagtctgagaaacccttttataatctccaggcttcacaaagagcaaggtactctcctagacatcagaattgcattgtgtcatatttcctgtggataatgcagagaaatctagatcagatgatataaccctagaaggattattagctatttgagaatggtacccaaacattactgatgaatatcccatcaatctaagcttgcaagaataatttttttcgttaaaatttatttttaaccttggcctgctgagcatcggcgttagtgatggtgacccgttgatcagattgtggttgccacaaaacttcaggggttgacaatatgtccgatgacagaatcagcaggaacaatggactgaattaaacgtaaagaaagttaatggaaataaatgtaaagtcttgcatttaggtccaaaaatgaactacacatacacaggatgtggaaggtttgatttaataacaaatatatgaaacatttgcctgatggttttagttgagcataagtttagcatgagtcaacatgtggatatgcctgccaaaagcttaatctggtcctaagctacattactggaagttcatgtacaaaataaaggaagcaacaataattctaattttacactgcttagatcacacctggaatatcccgtgcctctctctcacacagagcatgcgggtactaaatccaagtcttattaaaaatgttgaaagacctgagaatacacagcttacagaatcaagactttgtggatttctcatgcttgaagaactgtcacatagagattagatcggttttgtagcatccattttattccgttctactttatcagtttatttgcttattcatccattcatttatttacttttttgaaaacaaattatttgctttaatatttattttcttatttatgtatttgtctcttgaagatactaatggagcattattttaagagaggtagtattcagcttaatggaagggaaaagtccttaaaattagggtgcagtatgaggcagtgagtttgttgacactgaaactgttgaataagaagctaatgaaatgattacatttagaaagcattagttcatcacataaatattggactagatcagagttgtataaatttcagtcactgatctatttcctttattgtcttaattatatttatacataatcaaataaataaaatattataaaaatcatagccatgtaagttagcttatctaattaagtacattaagccacatagcacctaaaatcttcttgtgtatctttttttttttttttttttttttttttttaaagacagagtctcactctgtcaccaggctagagtgcagtggcatgatctcggctcactgcaacctccacctcccaggttcaagcgattcttctgcctcaccctcccgagtagctgggactacaggcacgcgccaccatgcccagctaatttttgtatttttagtagagatggggtttcatcatgttggccaggatggcctcagtctcttgaaattgtgatccacctgccttggcctcccaaagtgctgggattacaggcataagccactgcacctggccttctagtgtaccttaaatgctactttgtccttagatgatctctggggttcttttcagatattccagtatgagaaatatctaaatatcttaagtatggaagcatttacttttacttttctagagcaataattattgaacttgtcatggcattggtttatggtagtgcatacaccattgttacctgagtgtataagcccaagtttcttgctcaagattgtgtggtaggattttcttaatctcaagtaagagatttctcagcttatgatgtgtcacctcctgttacaagtcaaacagtctattgcaatgaagccctgcattaaataaactcatcattttgttcatgcttcagtgagattagccataataaaagattagttccaaaggcccatattcattgctagagatatgaacccagtgttatattcaaagatgatttcttccaacatttttcaaactaaattaaattagcatttttcacacattcagattatgtaaattagcatcttgagctgaaagcaagagattgtcttaatatgtcagtaagtatatattgttgttattcaattctaagacctaagtttgtaaccttttacaaagtatgaaattaatcagaatcttggacctgtaaaataccaaactaaatacctgtattcttaataccatctcaaaaatccagtggagattggttaaaagaaaaatatgtccccctcctcatcattaatttagtattactatcctgagaaaaatatctccactgacaccaaagactgtcttccattgaagtcccatattactgaccctgaaataatacttcagtaaatgaagttttctcctaaaattgaaaaaaaaattttaataacatgagttatatactccaaaatcttccattactcttataccatatcagagtttattttgcaggaagctcatttgttgtattaattaaacattgctttcgtagatcttactagaatcttagcaggatacatgaggagatgggagaaaaaaaagatccaacctcttcagcttcagcattgaaaagtatgaaaacatatggctcttgttttcaacaactagcctgaacggaatgtctaagtgagagtgaagctaagatttaggaaagttaatcggtttcagtgtctgaattcaaggttcttagttttctttccttttgggaagccttccaagaactgcagacttctcccttgccttatcagctgagctgcttgtggcctgttccctttagtttaaatcaatacatgtgtttttgatatttggcaaaccaagatttaattatgcagctgcaagttccccacataaacgaaatgcatcttagagatataaaaacattcagaaaccatttatagtttgagaattcaagtgggtgaaaatctattcccaacctctcagcattttatttaattatggaggatttttatgttactggaaattgaaatgaaaaccagagtaaggctagagtttatccaacatttgttcatattgaaaaatgaagatgcttattagagtcgaagaaggaaaaggaaagtattacattctggaattaatattttggttgtaatctacacacatataacgctcctaaatatatacagcaacaagtgaattgatagtattttgtcattattgtacactcaaaaaaggatgtattaaagaaaccagaaggttgatttctttaatttgccaagcaattctcaataattaattatttactgaacttaataactttggcactatttaaactgttgaaaacacccatgttttggcatgattacatacacatgattaattcagcatggttttactcatcactgaatatccctatcttttgcagtagaattttctaggtcctgtggtttgggtaaaatgttggaatgattcccagttttaatagtcccaatttattattactagtgaaccctgatcagatcatgggctggattagatcccagtttttcaaaatgccccaatttatggctcccttaaaatgctggtaaaaatgtgtatttgaataaggctttggttggctaaaaaagatccagttaattacttttagatccttattagatcatcactgcatggaagttatgaaaaatcttacttggtggtgtttctcaggacaaggacatgttctctttttatgctgacagaaagaagctatcagatttctgtttttcatagtactaaccaactcagtgaatgaaaagagatctttctgtatccctgtgattactattgatgctcgtgtaaaggtaaaaatatccatctttcctagaatgagaattaaaaatatagagagagaaagaacataaacacaatggcatagtagccatacacccacactactctttatttgggggccatttttcaaaatttgcctctgatttagagaaattagggatttagacacagcccggggtgaaggtagctttaatatctttacatttatttgatctctgtaacacctatcttctcagaaatgcttgcggtcaccaacaaaacttggcacattactgtatttctatagaccagagatggaaacacctacatcctaatgccatgccagcattttttatgagccaaaatccttttatgggacttgaatcaatgttagaagtgctgtattagcaactgcttgtcagccgagctggattaatacataaaatgaatcacttgactggcatgctttccaacagtcatttaggcaaacttctatgaagtacaccagctctctacaaattgttttaaataattttaaatatttttaaagaattcatgtaccctggagtgatgtattactttatcgtatgtagttgcagggctgttggaatacattctgaaaaggaattatactgaattacctagaacgattccacagaactgtttagagtatctgacctgataaaaatgtggaaagaaattttaaatttcgctgatccaggatatttggttgtaatataaacgtattaaatacagaaatagatattcaatgtaatccataatttttttgtaattcactggattttatgccaatcagagataccagagctgtacctcagagatacaggttgaatatcccttatccaaaatgcttggaaccagaagtgtttcagactttgatttttcttttattttggcatatttgcattatgtttaccagttgagcattccaaatctgaaaatctaaaatcaggaatgttccaatgagcatttcctttgagtgtcatgtcagccctcaaaaagtttcagattttggattttcagatttgggatgctcaacctatacagataaatttactttaatggggattaaatacagcagtggcagaatttgagaagagcattttctgtgaaagctttgggggactgtaagtaggtagaaggctgtttggtgactagaatttaggaatgagagcttctgttttattattcattttcgtggcattggataagccacttttgaggatgtattcttatagtttctatttttagtaccatgaaataaaatggtaataataatacttaaaggccccagtttcctacattttgtttggataaaatgctttttaacttctaagatctttagaagaaaaaatttgcgtaaataaaagtttagtgaacccagaatattttctgtaggccggtttggggctggataatatactagtaatcttaatttgctgaaactggtctctgaaaactgtggatatatcaaacttctgtaaatcaaatattttaaaagaatttgtaagtctctcatcttctttccttatttgaacatttgttatatcctgctttgggaagctttcatgacaggccaagtgtagttaatgttcacataggttggcaaactctatatgatttgaaaggatgctcaatctattgtcttctggaatcttctcccccgtcaccacccggcctccacccgccccatacccttcacatagaaatactaacctaggcctgtgatttacaaactccaaactttgaatatgctttttctgcatttcctggacagctttttacatcagtggttctcaactttgggtgattctgaccccagtgggtatttgacaatgtctgagaacatttttagttaccatactatgggggaagtgctactggaatctagtaggtagaactcaagcatctttctcagcgtcctatactgcataggacagccccctgcaacaaagaattatctgactcatgacatgacttgtgccaaggttgagaaaccatattttagatagatagatagatataatagaaatatactacagatattttagtaagtctgtagttgaacctaaggatatgtattttgaaattatttctcaagtgattgtcatttatagccatgtttgggaccaactaatgtaggtgatggccccagagagatgcatggccaaatggaaagattacaaggcccaggagtgggttaaagatgactctgcatgaacaaacttatctgcttcaagtctcatgtgttaaatgagaaacctgtctttcagattgttgtgaaaattaaaagcaatatttacgaagcacgcactggttcagtctaggtgctgactgttattttctgacctgctttgggaattaaaaccccagataacccatacagtagcctttgggagcctagaatgctctgagacacaccatctgtgaaagttgctgaattggatcctgttatgatgaaggaggccaagttgagcggagactttgcccagctgggagtcatgccagatacttccattcaagaagcttctcctcattttttattgatcgccggttggaagttgctcctcaagcatagtgagcttggcatgagatggcagcacagtagtgtggggggtgctggctgcagccagttcttggcagccctggaaacacattcagggagaagggacacaaatggtgtgggtgactgccagcctctccaagtccacagggcgtgtgactgcagaaaacacttgtaaccactgtcattaaattcacaaaattctcatatttgcatttccattctatatattacattaagggggtggcaactccgatctgctaatatttggaatccagtctttggaggaaatgggatgaaaatgtccttttcttcccattccactctttcccagctacctgcctttgccctggagtataattacttaatgaccttacagtgcatctgaaggaaattcagattgctgtcccaaggaatctgacccctttcccaggcacaaactcctgcctttttctggtttgtgtcctttgttagcatctcatattgagagttagagaggctgaagtggtttgggctgtgcacagaagtggcacagaagcctgcttctccaagaggtcgtggaaaagccccctcaaccatattaaacaacagtaacaacaatgggctgtttagatggaagatataagtattcatgttcttggagaaacttacatagataatttctgaagttatgatttcttgaagcagagattattaaattatgacaggttggagatgaatgaatcagtgataattgctttgatcaaagtcattcctctctctcaaactttcagtggctctctattgcctactgcatacagtgcaaactctttgtcctaacacatctgactttaacctttctaatcataatttccacccctgaccaatatgacccctatactcagccaatctggaatgttcatactttctgagattaacactttccaatcactgtgccatttctagtaccatttctgctgtctggaatgctcttctgtctgagttggtccgaatgaatggaaattcaatgaaacctcgctttctccattataccttctcaaactacctaagttggaagagaattcttccattacctatcctgggtcaagttgcttgattgtggtaattttcagtttctttacctacaaaatgggtatataacatcataggaatgttgtgagaattaaataagactctgaagtgaagcattcagaatagtgccaggcacagagacagccaataaatggtgaacttactatttttcttcgtctttctttgaaagagaatgaacatgagtatcaaactgttgggtttgaagcctagctgttccctgtactagctgtgtgatggtgcatgttctgagaaaactttctgatcttgatcatttgaagaagaaaaaaaggataaaaatatctagccttcagagttcctataaaatttacataacatgaaatacttaaagtacctagaactgtgcttggcacataatagatacacattgtcattattattgttgttatttttctgcatggaatcgtagatgtttgtatttacaaacatgccttctctcccttactacctcaccatttccttggggtgaggatgatattgtaatcatttttctgtttctctcaggatctaatacattatgtttcacagaataggcactcaataagtagttgctgaataatggatgaatgaatgaacaactataaaaccgtactgattttaattttatttttcaagtgaataattgctgcaatggaactaagagcagaataggctaaatcaatggtagacaaagctatagcgtttagagatataagactttccctgggctatgaaatggtgtcaagaaatatgaggttatttgtaactggcagtaggacagtggaaatgaatcattgaagcatagtggccagtccatcaggactatcaacacttgtttccctgtggctgaaccagatcctgagagacacagccttaaagtgaatgaaatttcatccacttcacagggaaatgaaaatgctgtgggcccagagagctgttgtttgttgttgttttcaaattgggcttgtgtccccatcccctttcattgacttaaatttaatcagttgaaattagttttaagtaccatttattttaaccttttaaaatggaagatacgcctttttagggaaaattgaatttggttgtatggatgagacacactgtccttggcttattcttgtcaaatgaggatatttttgtgctgtattttgagctgattcagtcagaattcatggtgctgattgtattttgggggcaggcataaaaaactaatgtagatggaagatcatgaaaaatggcaacagccatttgtgatgtatcagatgccatcaagctactctttcaaggaggcaataggactaaactccaagcccgtgattaggagtccatatcataattacattagagcctttgtcttgtaaaatatttctaatctatattctcctgcaattacatgtcttttcttcatgtctaagtcctaattctcttgaggcatagattgtaacttgtttcattttcttacatctcagtaaagagaagatattcagtaaagtcctggttgacttaaaagtataaaacagcattaaattttgagtaagttacttagataatttcaaaaactgacaacattttattaatcagtaggaaaagaataactatctattaaaatatcttgccaaacattcttgcttatttttgaaagtatagtggcctccttaaaaattaccttgattataatagtatgtaccagttttttaaagtaaagaacaaatgagtagatgaggaattgcttagactaatcattttttgaaataatagtggactctattattgacagcatcaacagctaattaaaaattctattagtgaagatgtaaaagatggcacatttccaatctagattgacactgaggacatagacataattgatatttgttcaataatcctaaaatgtttcacagtctctaatagaggctgtgattgccaaagaaagtttcaagtgctaaaaatatatatattctaggcacttaaagatattttcagatcaaataatgcacctttaaaaaaaagtaaaattttagctgaatgagcatcaaaggatattttagtgggttgactttgttttaaaaaaaaacacagagtcaagataatgtatggtgtgattcacatgtttttaatctggttatagtggatgtaataagaaagtcaaaagaggataatttgctagttggacttttaaattttagagaagtattttgtaatggtcacataaatgaatgcatattgaaaaaatctgcaatgaccattaaatattccactttggaaaaacaagatcatagctttaacaaaatgcttcaatattatagttcactgcttttgacaatattaaacccaaattgaatatgtttctatataggatattttcacacggcaacttaaaaacttggcataataattttcctacttttgataatcaattctgctcccaataattatagatttacctcaccaattatttcaaaggatggacagagaagtaaagccttgccgagaaaggtagtaagtgaaaccagaacattttacaaaatgttaagaaatgggcacttaattcttgaggaaacataactcatttcaccagcaaacaaaaatccaatgccaagaaaactgacattatgctaaaatattcaatgtctcaagtgtgtatacgacttaaggtaaaaatggatgcctaatatcatcagtgaccaattcatcccattgaatgaaaaatattcagaggaataagcacactctactgaagctagttgtgcaatcctcattgatcaatttgaaataaccacctacagatatcaattaccttggtccatactgctcttgctcacataagcttgactgtgcctcaattcaaagaaatttttttttaattgtgacataataaactaatatgatgtgtgaaccaacatgggaatttaagttctcaaagatatactgaaagattttgcctctgaggagaaacacattttactaaaatcatgccaattgacacaggaaatttgatgaagatctccaaatatcacagattaaacccgaaatatgtagtatgtttttacaacttttctagggcatttgaaaacatatgcaactatgtagacatgtttatgattctatttacacattcatttttacattgccctataatcagatgacacaggaaaggaattttttttcatttgaaggaatatgagaaacagtttcaagcatagactagctgaggagtagggggctttattttattactttgtgacatcctgagggcatgcttctggtatgaagaagacttagctgtctgaaagtattcctgtttgtgagaatacctttaatgctgtgaccctgggtgtgcctgcatgtgtgtgtgtctttgtgtgtgatatagttacatagatagataatatgtatataggcttaatagtgtctggtaataccctgctacatcctcttatgagcatctgataaccattccttaatgaattggaaaagtattattttagttaaatgaatgattacatactacctgttttcatgctgtgtataaaaggataccagtgaagagaattaggttcttggagaaacagggagatgttgaaaagcaatcaagaaaaatgttgggggtaaagggactggaacacctgtggggaaggcaccattcctcctcacatatgtcttcatccctgaaaatctgctaagcccttggcctgcaggtgagcagcatgcacaaaagtagatttgttaattttctgaaaagaatacagctggctggctcaaagagttaaggcaacatgataataaggctgatatcatataaactatgcccctttatggaagattgatgcattaaaaaaaatcatgtaagtatccactgtagtgcaagtactgtaatagatgctaaggactcaaggattaattttttttttaaggagaaataagatttcttggtcttcttacaaggagctcaaaactgcacttccaaccccaggtaaacatctaaaaatatattctgttggaccttcaaggccttcaggctaagggaacaactgaacctttcttttcttttcttttcttttttattttactttaagttctagggtacatgtgcacaacgtgcaggtttgttacatatgtatacatgtgccgtgttggtgtgctgcacccgttaactcgtcatttacattaggtgtatctcctaatgctatccctcccccctccccccaccccccggcaggccccagtgtgtgatgttccccaccctgtgtccatgtgttcttactgttcaattcccacctataagtgagaacatgtagtgtttggttttctgtccttgtgatagtttgctcagaatgatggtttccagcttcatccatgtccctgtaaaggacatgaactcaccctttcttatggctgcataatattctatggtgtatatgtgccacattttcttaatccagtatatcattgatggacatttgggttggttccaagtctttgctattgtgaatagtgccgcaataaacatacgtgcacatgtgtctttatagcagcatgatttataatcctttgggtatatgcccagtaatgggatggctgggtcaaatggtatttctagttctagatccttgaggaatccccacactgtcttccacaatggttgaactagtttacactcccaccaacagtgtaaaagctgaacctttattttcaggaggaatacctgagagatcaccaaagggtagagcagacttgtcatctccatactcaaaaagttgcatagtctctcccatagtttattggatgcctctctttgcatctcatcctcatggcccccagcctgatctccacaggctagagccttccttgcaagatcaatccagcccccttaacctttcactgaaacacagaaatttttctgaatctgctctgcatttagcagttgtaggcaccctgcagatggggcctcctctggaagctggccttctccgggaacccccagtggaggcctttattgtgtcccacccactttgtgtgcacttgaaaatctaacaagcatgtgttttcctaataggcagtactccttggataaactattgttaatctgtatcatcttgtattctcttgtgtctttttttcttctttcctcatttttcattttttacgttttctcatatgaaaggtcacctttacttggtcacttcagtggaatagttcccaatttcaggcctaaaagcttataagaaaaatgtgtattttgatgaattttcatacttttgatcatctggagaactaatgtaatctgttttaggtccctggacctttttccttgagatgtgctgtcacacctttgaatctgaggttaaattgaagttatatgaaatttttccacttagaggatttgggtagatatcttctgctatgattcacttttgactttttaatttttttggcctgaactcttcaataattcagcaaatattaattgagcatctaggcacatgagggaaatggcaagatgcgtaaaacacaatctagtccctgccctcaacaagttcatgattaaggagagagcagagagaccaatacactaattataataaagctaactatgataaatgctgaaagggggtttaaaaatgctatatgatcacagagaaggcagccatgagaaaatagtgttgtagctgggacaataggacacaccctctttatcacccagtatttccagacacttgcaatgaaatcattagattcaattataaagtacaacttaactgtgcagcaaattagaagagactttaaaaaatttaaattcttaatcccatcaataatacatgatatttttgctgctgactagagagaaatttaagactcagggaaaattttcatttaaaatctaagggattttccaagcaatcagggtgttttccattatagtttctttctctaaagctgacagaatatagtaaaaagtttagggcaaaactttctgggaaaatagcagttgagacaggcagataactttgggtcataaatttatattactgaatattctgcagatacatacaaaatttatttaaatattttaaactataaactataatcttagtagcctagaatgtttggccaaaatatttctatacttataagtgggttacaaactattcatttgtatatagtactatgtaatatatatacatacagtaatacagcactgatatggtttggctctctccccacccaaatctcatcttgaattgcagctcccacaattcccatgggtcatgggagggacccagtgggaggtatttgaatcatgggggtgggtctttcctgtgctgttctcgtgatagtgagtaagtctcacaagatctgatggttttataaagaggaggagttccctgcacaagttctctctctttgctggccaccatccatgtaagatgtgacttgttccttcttgccttcgccatgatgtgaggcccccactagccatgtaaaactgtgaatctattaaacctctttttctttataaatcactcagtcttaggtatgtcattatcagcagtgtgaaaacagactaatacaagcaccatagtaaaaaatggtggagcaaattgaactttctttacagttttgaaaaactgaagaggccaactagggtgaccaaaggtcagttttcccccatctattgacatagataaggcagaccccagactgccagaaaaaaacaagttccatattacatacaagtcacttactctttaaacttctcaagttagtaattatcccaaaacttcattaatctgcagtctcttctgaacactccactagccaggagggaaacggggaaaggggagaatcaggaagaaataagaaatgcttcccagtgccaggcacatagtagactctcagaaatgtggattaaatggatgaggtcaggtcacagctaatatttagttacttcattgtgattcctccatacctcaagggttacaggatgaaaactgcagtggagaaggatggtcttcaaatgatgtccctccctcttcaaaaaaaaatctgttcagtgaatgtggctaaagcaaattaaaggattcatatattttcgaaagatttgcggccaagagattcgaaccaaaagcatttgctgctttactctcaatcaagcagaaaattcaattaaccgtaacacacctggtcccctgagcattctggccaatccaggttatacagcattgattaaaagtatctactctctgtctagggttccaggtggaattgagaaggagctaaaagaagctgtgtttatgcttttcaagagctattagtggtgtgtgcatgtgaagactgcataagtatctctgttctctgctctctcatctcccctgtctcagatgtggataactgttactgttattcctaacaattgctatgtacgtgccagccacactcttctaatagctttagtagtattaggtcatttagcctttttcctttggggcaggtactattatatctctcatttgcaggtgacagaaaggttaaataatttgtccgtggtacaaaattagaaagtggcagagctcagtttccatcccaggctgtctggctccctacatcaccttgcttttccatttctgaaatagcagagtgttcacatatccatcaacacctgcaggtctactctgaaaaaggctttgcttcagtggaactgtctgggtgaggaggatgctgcctcccatgaagatcttaaggcagaaatataaatgtaaattttgctcattaaaaccataattaatttattgaaagtgaattgttattatttcagggatgaatgcatattggaatatgctgattattttaatgaaccaagagcctcttctgggatacttcccttgtattatttgcaagcaggtcaccgtaaattttctaagagagagaatgaatagattgctgctcattttcaagttttgccttatgaaaaatgcaaaagaggctgggtgctgtggctcacgctgtaatcccatcactttgagaggcccaggcgggcagatcataaggtcaagagatcaagaccatcctgaccaacatggtgaaaccccatctctactaaaaatacaaaaattagctggatgtggtggggcgtgcccatagtcccagctactcggggggccaaggcaggagaatcacttgaacccggagggagtgagccaaggtcatgccactacactccagcctggtaacagagcaagactccatctcaaaaaacaaaaaaaacaaaacaaaaaaaacggaaaagaaaatatgtgctgtatattgggagatgataagacgatatctttgtttaggaaagaaaggcctaacatcatctgttttagactcactattctcctctaggtggccatttcttgcactacagatgtcagctgccgggaccagtttgtgtggtgctgtgcctacacaatgcaggcacattgcaatgtctccaatataattgttatgtttaacatttagagccatttatgtgggtttcctctcctgtgttccactgtattccatttttaatctcctcaagacacacagtagaaaagctgccagaatttgttttttctcttcatatgttatagggtctgaggtttcatctttcatatttccacattgcaggaaagatgagcaatgacatattgaccaaggctgtgaatgaaaatagtgcatacctaaatacttctctttaggtctcatcatcagttccattcattcataatcagcattagtcttctattgctgctgtaacaaattaccacatacttggtatcataaaacaacataaatttattctcttaacgttttggaggccataattctgaagttagtttcactgagctagagtcaagatgtcaactgagctgattccttttgcagactcattgtcattggcttttacttggctgcctatgttcctggctcatggctccttctgccatttttaaagtgcatctctccaatctctgcttccgttgtcacttggccttctctctcagaccttgctttgtctgtttccatcatcacattattgagtgcctactgtctgccaggcactgtgctagatattggagttctatcaatagacaagtcaaacaaggacgctgcttccatgaagattccattcttgtaaacagataaataaaaaagataaaatcaagtaatgataggagtatgaagaaaataaactagagcaatgtgatagaaagatggggctgggaagaatgcctaagatgccaagattcaatctcagcgatgagccagtcacaagaagtcgatttcagacagaaagaactgcaagagctaatcaggcctgaggcaaataaagctttgtaattggagttgaataactaagggagagcgtggcataagccagagtcacagaggaggcggtgaccgagtggatagcgtcacagatcatcgtagggagcttagattttatctaagtgttaaaggaagacatgaaagtgttataagcagagaaacagttaaatatttactgtttaagagattgtctgggctgctgtttaatgactagattctccatgaagggagctatctggccacaccttgcctccctcttaaaaagtatgtttccttactgtggttacatagagcctgaataaaatctaaatcttagtcatgcaggtaattgaaggatgtttccccacatctaaaacttagacctctgcagtaccctgctaaccacaataaaaaaaatgccaattcttcccttttttccaacattttatggatccattagcaatttgcagttcccataggagataaaacaagtctcttttcaaacatgaagagatttcctatggtaattataggcaaaacctggagcaaagggccactaggtaggccaaggaatagggagccagctgagtgatggaatgccatggtcaggactgagaataggccctgaaaagaatagcttggtgaagggacagtgagggtagatcagacagtaggctcccatggacaaacagtcattgcctatcctaacaaatgaaacatcctcattgtagttctcaaaactatgtgcaagtagcatatggtcgtctataaaagcctccttcatactccttgacacccaggtttgaactgatggccatggtagaacctttctcctcgacatccagtggagtaggaatgaggtcattcctggtagtcatcttgtgccctaactgcacaacagtctgacagaatcaccatagacacagcagacatcatctggattagcttgttggaccttctctgatggttgctgagcggcgattgcctaaggcaaatgttggcccagccagtgctgtgtcctcagtgtgcatgcggtagagggaggaagaccagatgatgaggatgctcacctcaggcttggacccctgttaaggaagaccctatcactatccttttggaggtaggaggggaccttagtttgcagacctgacggacaagcctgtggttctttcacctgatactcatgtgtccctggtccttttcatctagcctagtgcagttctaagtacttagtaaatactcaataaatgttggaatcaaaccaaattggctgacatgccccatttcttggcatatgcctggacatgtgagaatattctatatggtttctccagaacaaagtcccatcttaagaagccaaaaatggcaagcctaataagcaccatagaaaatactgtggtttacatatgttcattgcaaccctattcacaatagggttcacgacatggaataatattcacaacatggaatcaacataaatgcccatcagtggtagactggataaagaaaatgtgatacctatacaccgtggaatactctgcagccataaaaaagaacaggatcgtgtcctttgcaaggacatggatggaaatggaggccattatccttagcaaactaacaccagaacagaaaaccaaataccacatattctcacttataagtgggaactaaatgatgagaacacatagaggggaacaacacacactggggccttttggaagatggaggataggaggagggaggggatcaggaaaaatagcttatgggtactaggcttcatacctggatgatggaataatctgtactacaaaggcccataacacagatttatctatttaacaaacctgcacttgtacccctgaacttaaaagtttttaaaaaagaaaatactgtagttgaatacaatatttttgctgacctgtttaaagccttctgcgtgagttggataggagggaaaagactgtaccctctgtgtctttttaaactctctatgatgcagagaacgtgacttttcagaatatgagtgccctatacctttgaactagatggaaacctcaggtatgaagggtctgtgtttatccctgtcctaggtatagtcatggttctatacttaaggtggtttttccgggctctgtggaagtcggtggtacttctagagcttttcatgatcccagagttcatttaatgaagactctatgtaacctggggatgagtgtccagggccttgggaagtgtggcatttagggccaagaaaacaaaggaaatagagcagcacatgctgtgtggacagccgtgatccccatgcttcagcacatttttatgtgagtcggctttgagagataaagatcaaagacttgtccaggagtgcaccagccaggtgtgaaattccaggtgacagaatggaaagaaaagaaaggtttaaagggaaaggaaaggaaatgtagttagtttccttttattctctttatttttcctgtttcctcttcaggaagtttatgtagcttacaataccccagacattcaacagaaggggttgatcctcattcttttccagataatgataagcaccgagggcctgtcgtttagttttcaggtataacccttggcagtccctagggttaaacaatgctgtgctccagaaaattttaatacagaaaacttagtttgctttctgctttggtctgtgctacaaaaagtgggcaaatataaactgggagaatataaataaaataaaggctacttcttgccacttacaaatgtcattagcaataagaataaagcacatcaacaagttacaaattttatccaaccggcagggctcccccaggggcagattcttacagctctttcttcagtgttagtttggccagcagcctagggaacatcatttaatgtcttcaacactaatgacaccttttgtagggggactgtctaggattgttataaaggaattagttgttatcagagaatatcataagcactctgtaggttgttccccgtcacatccccacctctctttggggctaattttctaaggaaagctaaaaatgtttactaagcatttctgagaaacttgtctacattatgagaatagaaattacaggaactcagtgcattagcaatgggaaaggcttaatgggtctgggaaaggtataaatttagggaaaatgtaaattgcaatagttggagagccttcaagggcagttttcttgaaatggcagtgtttagtagcaatggaaagatactcaaggatcttgccatttggcattgtaaaaaatgcaactcgtaggtaggaattgcaaatcccattagtttagaatatgaaatagactcggtgtaaaaaaaaaaaaaaaaaacaacaacatttgatttggggaatgtgcttggttccaggccatgtaggatatggaagtcttttctgtggtcatcccacctagacaaagaaccagttaacttttcaggattctctagaattaggatgttctgagtccacgcctgactctcagaagcttcccaaactctactgccttgacttactttaatgagcatttaggatttagagaaaaagaacatcaacatgccctttgctccatgatctttggcaaaccatggactgtataagcacaatatccacatattggattctgcaaaccatgaagaattcaccgtgttatttgtgtgtgcacagaggaaaacataaacaaagagtcaattaatgacattaaaaaatttgcatgtcagtattatagaatgtcaaatttactgtacagaaatatatgtattatttttttatttatatcaagaaaagtgataaattatcccatcaatctagttcccttacaatgtcagatctggtttaggctgacaagaaaaatgggcggtactgaaggagatcgtttagaaaatattatagacacccagagaggaatgaggcaatggtgaaaaatattaatgcagttaaaatagttttgttgaaaaaatgaaacattgatcacaaagattgcatgtaacattgtattggctgttcagtataataattttaatactactactactaataataataataatagtaaactcacattgttcctgaccaggtacagcttgtagctttaaaactgcattgatagggaaaagctgaagaaactgagcctgttctctggaacaaaggataattatagtgacctaattgtagcttctattacaaaagcagaaatgatagccagacaaattatctctgctgtcaataaagaaagctgtacagcaggtagtttataatctcttttaatgatactacttcttttaccccagagctctccatgaaaaaccttttctgacctcgactaccattaccactatagggagcaaacctcctctttactctctgttcatctctgactctgttgtttgggttcatacagtagcaacaaagagaatttcactgcctacaacttcctagcactggccaagtcagtcagagctatgctattgtggacacattctgcatgagacaaaataaatcaagaaatagtatggaaaagtagcaaaatgttctaaggcttttgaggagtagaaaatatgaaacactaatcaataatcatttaatgaatcataaaatgcaaatgagaaaatcagaaaatatagatgcaatttataccacagataaagtgctaatattgctcctattcaaaggcctttgaaaaatcaagggggaaaatggctagcaatctgatagtaaaatcagcaaaagatatggacagctcacagaagaggaaatgaaaatggcccttaagcatatgaaaagatactcagcatcatataagaagagataggctaattaaaacttcaccgaaatatgacttctcacctatggttatcaaatttcccaaagttcgacaatgcactctgttgatgagactgtagagaaacaggcatcctcttacagtgtaggtggcaatgcaaaataaaagaaatgtggaaggaattttgtcataatctagaaaaaagtatatgtgtgtttctctttgacccagcaatcctgcttctgtgaattcctcccaaagccacagtggtaacaatatggactgacgtttgcacaagatttttcattatgacattatttgcaatagcaaaaaatcagaaatacccaaatgttcgcaaatgcatgactcgttaaataaacaaaagcatgtccacacagtagaatactatgaagcattttaaaaatgagaaagatatctaaagaaattgtagtgtctatgatttctttgctaatatggaatgttcttctgtctattactatgtaaaaaagcaaagtatagaaaaatatggacagtatgctaccttttgtgtaacaaagaaggcatctaaatatataaacatgcttgctttttttaaagaaacaaatatagttatattgcatgggatggagaagacagaaatgaaagctatatattatattttgctatatttaaattttgaaaaatatgccttacatatagcaaattaaataaaaaggaaaaaacaatccctaaaaactgaaaacaaacgaaaataaataacctaactgtgaaacaaattggttgcatagccattcaggaaaaagaattacttcaagtgacattagaatacacgttttgattatacatatttagtgtaatatattctagcaaaaaaatagagcaatgaagacatcttaaactttagtagtcaaactgttagtaattgctgtgatctgaatgtttttttcgccatccccccaactctgttccccacagcaaattcatatgttgaaacctaatcatcagcgtgatagtattaggaggtggggcctttgagaagtgaagtgctcatgaatgggattagcgtccatataaaagtggccccagaggctgggagtgtggctcacacctgtaatcccagcactttgggaggccaaggcaggttgatcgcttgacctcgggagtttgagaccatcctggccaacatggaaaaaaccccatctctacaaaaaattacgaaaattagccagatggtgtgcacctgtagtcccagctactcaggaggctgagatgggaggattgcttgagcccaggaggcagaggttgcagtgagcagagattatgcagtagcattcctgcctgggcaacagaaccagactctgtcacaaaaaataaaataaaataaaaagaggccccagagagctgcctcacctcttctgccatgtgagagatccagcaagaagtcagcaatccatcctggaagaaggccctcaccagaacccaaccatgctggcatcctgttatcagacttcccagcctccagaactttgagaaatccatttctattatttatttataaggcttccagtctattttattatagcagcttgatgggactaagacaataatattgatattatcattttaaaactatatgataaaaataattatatcagtgttaagaatcaagattttgcatttaaaggagggaggaataaatatacaatattaaaattttaaaagtaaaaattctgtaatgttaaatttgaatcagaaatattagtataaacatatgggctttttttcccccagaaatatgtatttcctaactctattcagagaaaaggctgagaaataataataacccagtggcagtgagcacgcctagggcccagattgtggtctctagatatcattccccactaaaaacaaaggggtccttggaggaatgactgcttccaaattaggaatacaagatactcaacataaacctggaactacttatttgtggtaaagcaaggaagcaatcaaaggctaaaggttaagccagaagaacgaaagagctcatacaatgcagtctcttgactaaatatggacaatatgtgcaagaaaaagtataaggaatgcaattgaataaaaatcctaaatatgttattacaaatgtgtattatatattatggacttacataaaaaaccataagtttataattatgttcacaatcccgtattcccccaaaaatgttcctaactactcgtttgtcaccattggaactatctaggacactaactcctgactctgaaaattagcagtgaaaaagaaatatttaagcatttattcagatttcccaatactaagtacatctcaccataatcaaaatgccaaaattgttgaaagattttctttgcagaagaatcccagctaatacatttttaaaatggccttcaaaaatgaccattgtgcaacccctaatgaaataattaattcagtcaaacatcatcagtgaaagaaatgattaaatgaaacattgataggggaactttacaatggagacatcagtttgtctccttagcattactaaagacaatcagatatttaggatggagaagacagagatgaaagctatataactgtactttgttatgttaaatttagaaaaatacacatttttccaaatttttgtgtatgacacaatttgaagcatatgtgcttcctttaaggtatttatattggtttcatagggccgccatttaacagattaccatcaacttggtgcctttactacaaatttgttctcttactgttctggagaccagaagtctgaaatcaaggtgtcagcagagttgcttctttccagaggctttgagagagaatctgttccatcttcttctgtgcttttcttggctgccagcaatcctgggtgtttcttagcttatagacacatggctccaatttctgcctctgccttcacattgccttctctggctcttctcttccgtttatgtcttctcctttataagaacatttgtcatcagatgtagagcctatatggataatccaagataatctcacaacaacatcttaaacttaattacatgtacagagacctgtatccaaataggattgcatcaacagattccagatggatatacaatttccctcgatatataagtgaggggcctgcagaactcacttatatgaaaggtctgccctccatatatgcaggttccttatcccacaagtaccatatttatccgggtttagttgaaagaaagctgtgtataagtgaacccgtgtagttcaaaccctgttgtttaacggtcaactgtctgttttagggagccaccattcaacctaccagagtactcctcctcaaaaatgttgaatctaactaagcctccagatgcactgtccaatatgataaacgttagtcacgttgaaatttaattcatttaaattttaattaaaattttgtaccttagtcatactagccacatttcaagagttcagtatccatgtgtagctagcggctgctgtagtagatagctcggatatggaagatttccatttccatcatcacggaaaatcctattggaaagcactgctctagaagttactcttcataaacaagatatttggggggatggaggaataagttaaatcatttcacaagaaagtaaacagagaaatccagcacatgggaccaactacaggaagatcaacttggtttccgcaataacccaaaggcatggaaaaaataaaaagcaaaaaggaaaaagagtacagttcagtacatttaatgagacttaagagaacaccaaatgtaacgtacaagcatttttacaacctgattcaaataaatcatctggggaagacagacatttttaaggcatttgggaaaatttgtttatggagtattagatgataccaaggaataattgttaatttttaggtgaaataatggcataataaaacattcatgatattttgatatgcctttggaagtatgtagggggatttactttcaaaatgcttggtaaaaaattaatagaaaaatatatttaaaatatgacagaatcttgattttatttatttattcatttagagacagagccttgctctgttgcccaggctgggtgcaatggcacgatcttggctcactgcaacctccaccttccaggttcaagcaattctcgtgcctcagcctcccaagtagctgggattataggcatgtgccaccacaccctgctaattgttgtgtttttagtagagatggggtttcaccatgttggccaggctggtcttgaactcctgacctcaagtgatctgcccatctttgcctcccaaagtgctgggattacaggcatgagccaccatgcccagcccgaaacttgataattattgaatacagaaatgaaacgtatatgggagctcattgtgctattatcctacttttggatatctgaaagttttcattatatcaattttttttttttgagacagagtcttgcactgttgtccaggcttgagtgcagtggcgctatctctgctcaccgcaagctctgcctccccggttcttgccattctcctgcctcagcctcccgagtagctgggactataggcgtctaccaccacgctcagctaattttttgtatttttagtagagacggggtttcactatgttggccaggatggtctcgatctcctgacctcgtgatctgcccacctcggcctcccaaagtcctgggattacagacgtgagccaccgcgactggccacatcaatttttaaaatgtgatcatgtttagattatttataatctaacataaatgaaagaaacattaatgttgaagacaaacacctcaacagaattcaataattcaattcctaccatttagtaaatgttagctgtcaggcaaagtgtgtagcctctctaatctcagctgcttcttctctaaagttaagacttctgtacattatgagaactgttatataatcatgagaaaatatatcactaatattattattgatgtcagttcatctttttaggtagatgaaatactggacaggatgggctcttgtgtgttgcaaacttttctattttgaggcatttgaagggcagtcttaattacagaattttgtttttaaaccagttttatttttagctcatggatccaattgcttcttaccatctccagtgatacacctgtatggacaaccaccaccttccctcacctggcttattgtaataaccccctaactgttctccacagtttttctctcacccagaaatgcccacttcactctgttctcaacaaagcagtcagagagccctttaccatgtaagtcagagcctattacttcactgctcgcaacctctagtttgcttcccacctcactgagagtaaaaaccgaactctaccatggacctccaggccctgtttgccctaagtccctgcttcctctctggcctcctccaaattctcactccctcacactggccttgctgtttttagcacatgcctgcctcaggggctttatatctgctgtctctctacctggaacactcttctcctgttatctgtatagtttaattattttcttcttcttcaagccttttattttatattttcagtagtgcctttcctttaagtaaatttagtgcctttaaataaaattaatttatttaaactttaattaattaaaattttgtaccttggtcatactactcacacttcaagagttcagtatccatgtgtagctagtagctgctgtatttaataatatatatttaataatgtaaactcccttcaaaaactcctactacctcttcctgtttcactttcccctatactacttactaaaaacatattttttcataaagtaccaatttgtaggccagcctttgatgttgacaatacaaatcattcttattgattcataaatacctcctctaaagactagacagcttgttttacatctattacaagtttctgcattcatcattcaaaaaattttggaagtgttttggttgcttgagaaggggtgtgtttgcttaaggaatttaaatattttcccagcaattgtattctgttaatttgttataataactgcttttagataatgcatttaaaagagaattatatataactcaatttataaataatgaatctaaatttgttagtttataaaaggtataagtagtataatcagcatttttgccttttctttttgtgttttctttttaaattgagatataggctgggcacggtggctcatgcctataatcccagcactttgggaggccaaggcaggtggatcacctgaggtcaggagttcgagaccagcctggccaatatggcaaaaccccttctctactaaaagtacaaaattagccaggcatggtgacaggcacctgtaatcccagctacacaggaggctgaggcaggagaatcacctgaacccgggcagtggaggttgcagtgagctgagatcacgccactgcactccagcctgggcaacaagagcaagactctgtgtcaaaaaaaaaaaaaaaaaaaaaggtaaattgaggtataatttacataaagtgaaatgcttagctctttgaaaacagagtaatattctcttttctcttttaatgaatgtatgtcaaattacagaacatttctagcacccatggatgttccctcatactttttcccattcataggtaaaagcctgatctagaattgcttacaaatggaattatatagtatatagtaaatccttttttctgtccaacttctttcactaaggatgataattttaagattcatccctgctgttggctatttttgtagtttatttcttgttattgctgatttatcttctgttgtgtgcataaaccatagtttgattatccattctcctggtgataaacagctgaattttatgtctaatttttgctatgatgaataaagctgctactgaacactcttcgtggatttttggtaaacatatgtcgtcatttcttttttcaattcacctgaggtgaatcactgggtcctaacatcagtgaaagtctagttttgaaagaactcctagaccttttccaaaagggattatgccattttatacttccaccagcagtgtgtgaatgttctggatgctccatatcctttccaacatttgtttttgtcattcttttacactttagtaaggacatctcattgtagttttaatttgcatttccctgatgatgtatgatacatttttcatttgcctattaggcatttctagttattatttattttttcattgaatgataattacttgtttatgtctcccttgatagtaagtcagagactattttttgctagtatatagtataatgtcagtaaaatattgaataaattaatctgtcaaccaaatattagcaggaagaacactcgtgacgcattcaaggagcccgtaatctagttatggaagcagaaggtctagaaaaaatcataaaagttttttaattggttttgttttctacaaagtgacatataacagtttcatattaatagagaatttactggatgtatgagttgaagaggagacaaagaattgttaaggtcattgtggagctgtttatgaataagttaagtccttatgccagagaaaactagagttaaatatttgattaatgggacatgagtaatattaggaaaagcagttgatttaaagagaccaaataaaagttcagtgaacaataatttgaagaaaattgtcataactgagttgacaaagggatcatgagaaatcaagtttacaagaaataaagatgccttttggtacagggtatttaatgttttcaaaaacatttttattcactacaacttgtagttgttaggaaattttttatattttttaagtttttaaaattttcttggggagggtgggatgggggtgagagttgagaaactacctgttgagtattatgttcactatttgcatgatgcgttcactaaaagctcaaactttagcattatgcagtataaccatgtatacccatacctgcacatgtaccccctgtactgaaaattaagttaaatttatttttttaattatcttaaaaatatagaaaatgcaaatagcacataaggtataaaggctacctctaattccactctctagatgcaaccacttaggaattttttgtgtattcttccagacattttctatgtatatgtgaggatatatatcatataaatatttatatgtgtagtaccctcacccttacatacatcatcttctttttagtataggaatagtatgaccctatgttctacagctgcataatacttttctatattcccctgttaatgcatatttagactgtttcccatcttttactattataatagcactttgtgtgtttttctttttgatacctgggatcctttaattataataaagaaatttattccatttacatttattttcataacataaatttggtcaacttatttttttgttactttcttttttactgctatctcttttttattttctgctatatggtaaagagtttattttgtgtatttctctcctgctgaaaatttgggttttagtggtttctttgtaattatatttaatatattcaaacctctgtttcttgatgtatcaattttagacagtaactactgatgcctgctttataaagtgagaaaatgaagaagggtgaaaataaagatagggtactctctcccaaattacttccttattaacttgtgattttcattagttttttctatattttatattatcagagtttataatatttacattttttctgtaattattgttcccacagatatttagtcttagttttatatttaaatgaatgtattgcttacctccagacctgctattccacagcttcaccattatcttagtccatttttgctgctataacaaaaccctgagacagggtaatttataaagacagaaatttattttctcatagttcaagagaccgagaagtctaagatcaaggtgccatcaggttcagtgtctggtgaggccctgttgcccatagatggtgctgcctaggtttcctcatttggcagaagaacagaacaatggaatagcaaagagggaccttagctagtgctctgtagcccatttataagatgttaatcttttcacgatggcttagtcacttcccaaaaggcttagtcacttcccaaaacctcctcttaatactaccacaatggagactgtatatcaacacatgaattttgggagacattaccgccgtagcaaccatgttgaattcttcattttgatgcagttcttagtttgctgttttccattattaataagtttttcaagatgggtcaataagtaccatattccctctatgttttcaaatgtttgagagtgtttttcttttatttgtgttagaggccagcatgagtttgcctgcatttgtcgattacttgattttcctccttgagacagcacttatgcttactatatgcaataagctctaacattttcttttactgtatttaagtatgaccattaaatttatattatcttctacggaagttttttttaattttctttaaaaaaaaatctgtgctaaaatatagtattaaataacatgggcatagtggtctaaggttaccagcagcttcaattctacatgatctctcaaaatacccttttgccagatttgctgggtactctgccctggtggcttcttttctacggttttctgttttgggagagctagtctgagatcagcctacttcttagtgaagtcacctagattactggtcctattttgatgagtctgggttatataactctgctaattctgcctatcagatacaaagcaggttcatacttctcttttctcactacttcacctccatgaagttttttttttttaaggtgggagacctgctcaggggaaatatctctcttctgtctctgcctctcctccattctgaagctggatccccacaaagaattaccgtacaattccagggtcctattcctatccttagactatattaaagtttattgactgtacccctctagactccctccttattttcagtgaaatgtatacatggctggagatgcagccatatatcgactggtggtgcactccgcctttagggctgagtccaagtttcatagcaaggcatgagattatggtcgttttctaattccactgtagatagaattttcttcccaatttctcaagtgtttgttcacatagagtttcagggagggaagtagagtcacttacttgacttcatcatttattatcatctcttattagagatcctcaatctgacagatatgacagaaatactctttaaggaagattattccagagccttttaaggtatatattaaagtgggatgaggtgacataccaaaaactctcagaataatctaggccagtacagtccaatagaacgctctgcaatgatggaattagtctctatttgtgttgtccaatatagtagttactagccacatgtagttactgagcacttgaaatgtggtttgtgaaactgagaaattgatttgatatgaattatttcaaatttaattttatagggccacactcagctaatggccattatattggacggtgcagatctgggcaacataaaagtctgaacattagactgtgatgaaagaaatggaaataaaagaggatacccaagaggtgttatggagaaaagaagcagcaatgttcccatagaggaaaagagaaagaggagatttaaacaattcaaacgcagtttgctcagaagaatggggaaactggtagtaccgtcaaataaaaaagggtatcttttgaaaaataaatattttaacaggttgagttcccagtggtaaggaaacctctaagtggaaatgactataaacaagtaaaattctcaatgaattgggggtgggggtgagggtcaaagctaccaaaaaaaaaatttccttgacacttccgtcttggtctcttctgccaccatacactccttttcagagattaccttgtcctcctcaacatggagggaccctgatatatgacataataatgattgttcagagaaattactattttacctgttgaatgattaatatgaaattagttactgaaacactcactggtgcagagtatcaaagaaacggttttgtttcagaaaggaaaaatataagataaaatattgcttggcacagacgtagtacttttcatctgagattctccacgtactcagcaagtttaattaatgagaaaacctctaagaaggaagtgatgaaataaggaacacagataccagtgttctatttctgtgatttttaaaaatcaagcttagtattttcctcttccattaatgcacacaagtattgccccatgaggcagccatgagatattcatctttctgctgaatgatttctcttgaaggcatctcacttatgagggatagcaaccacacagaatcctaccccctaactttattgatgtcctttgctctatttgcaatggaaatccatccctatcatcagggtgcagcaagcattctctgataatcgagtctgcactgtctctggaaagattgttttgttgcagaatggagcaggttatcttctttatcaaaaattacttaaaacaagcatccatgaatctaggactaacaggcattgaaagggaataggcaaggcccttaacgggtaccctactgtgtaatcttcctttcatcttaattcagaatcccttggaaattcaagttgccgtatgcaaaaatataaattcttctaattacttctgtgtagggcacaggtttggcctaatcaaaagagatatgcaataatatatcctggcatttgttttcatctgttgtaacttgaggataggtgctggggttttgttttggttttggttttggtctcatgccttcttattctttttgttttgttttttgctttttgcttcccaattgaaattgcccaatttcttttctgctccttactcagaaaaataaaaaacaaaaatgttgttctgccaaaagagaaaaatacctcagaaaatcctgcgttctaaagatttttacaaatgatttgatgttttgcaaaataaaactagcttccatgtgcaaaacagctgtttttgttcgaataggggaagatactgatgggtttcagttgtttttttaactcgtcctggcctcccgtatgtctccagtcatatacagatcattcacttctagcccacagccctcttatattctctgggcccaggacatcaagtttgtcccatctattcttgactttctttagccgcctgagccagcatcgtcttatctctcctcttgtacacagtgccccttctttgtccagtgacaaggtttacactcttttctcattagtgctgaagacctcctcacaccatcaagatcaccattgtccagtaagaggctatagtgacctttccattttaatacattactgagaatttagtagagctgatttaacactttccagattaaatgtcaaattctcaaaattcagatggatttggaatccacctaagtatatttttctgcttccattcccagtagactgcacagtggcactgattagcactagcattttgtaatatcacttaaggctttagcactgtggagttctgccagtaatggtgtttaattcacttatatgtgccaattcatctctgtcaggaacctattaatttcttcactattttactctgtccctagcgcctatataatgagacacaataatccccatttgtataaccaaaaaacttagagtctcttgtaaattatccctgatcccactgcttttagtgaccagaaagcctctgtatttctttttcatatttaaatcaattttcacaagttcctttctttagaagaatacacaggaactctagggcactaaattactgaagtcgtagaaaaactagaggattttgatgagtttgttaacatgcatccctgtcccaagaaaggcttctataatatcgaaccaaagatgcactgttcccacaagcacatgccatctgtggggagggaatgtgaatgaaaacagcctctgaagctactatcagcctagtcatcagtgggcaagatatcaaaatacccatagcattgctatcaaagtaaagaccctgtaacaaataaagatcagatatataaaattaatcttcttatgctgttggcatttctgcatgctgtgatcttgagtaaacaggagaatgacagctaagagacgaggaagagttaacataaattcaagagagtatttcattgtattattatatgaaactcacatacatctttgctacctgtactgtatttttcaggattggagcaaaacatcaggagctaagggaaaagcaggcaagaggtcttcttgattatgctactggtgcaattggatcagtgtatgatatggatgatgatgaaatggaccccaattatgccagagtgaaccactttcgggaaccatgcacatcagcaaatgtctttagatctccatctccccctcgagctggaccatttggttaccctcgggatggccatccactgtctccagaaagagaccacttagagggtctctatgccaaggtcaacaagccataccatccactggttccagctgacaggtaataaacttagtgaaagataaatgtagctttaattcagtatgtttcaaatcatctctactgctgaaaccgataaaaaatgtctccttcaatcaattaaaactgaaacgagtcagtaccctagacaagtgccatcctttgaccgacctgtaagatatccaccatcaaaaataaaacaatagccaattgtaaggtggcatgaatgaatagtagtagcagagttcatgatgcaatagggagccatttttgaaggagtattgtgacagacatctcatgaagaaaactttgaacgaatattgtcctttctcctaagagaccaattgtaaaagatttattcaggaagatggcatggcacatggaggtggagagtcagaaaagagaagatgatagcttccaagtaggtgtaattgaagtgggaattacagaaagctgcagaggagcaggggcctttgaaaagtaagatgggggttttgtactcaagggaaaggtgaccctgtatagatattcatggatgatcagaggtagaaaaagaaataatcttggcaataggagtttgatgaagtagagaaagataagaggtgacaagtccacagatctttaggtttagcagctaaggagagagataataggactatctgtcagtacaattgaagtaggtagaaaacaagatgattccaaccccacctcctgccaaaagtaaaatgcttcatgtcttgaaagactgatgtaagagagttttagtcgatatacattgttaggtgacccttggaattacacatgcaaggaatgagttgactgatcttggactaatctgactagcttgacgtctggagggaggtggtggggaagaagggtagcaggcacagagggctctcattctggatgaagaaaagacttgttttccagacttcttagggtcctgacaaccacccagtccctattagtaaccagcctttgtgtgatggcatgatatattgcatatgtttaccatttacatttccccagctgggtgatattatgcactttcaattaggttggggagaggaagggaaatcatggcatttttatgcagactgtaaagtgtagcttcaaaagactgattacctttcagagcctttccaataaccaagtgggaaggaaggagcaatttttaatccttactgtcaggcatccaggttgataatattaaagaaagatggtgaagtttttctttgggacaaaatgaaaatataaatttttatgactgtgatatagccataataactaaactgctaattcaaagaattgattaagagttggatttttctccccagccttcatagaggattgaattttattgtataaataataacaccaggcatgagtctcttctcacccaaaccatagtcaatcttaccttccctaaattagataggtcttcataacaatcctctctgcgtattccacagctagaatcccaacacagagggactgtttataggaacctcttaagccagtattttccaatactaattccatggaaataaatgtgaggcattttataaaaaaggattcacaagtccaatacatatggggaattctaggaattctagggtaagccacaaggaacaggttttccttttttttttttttttttttttttttgagacggagtctcactctgtcgaccaggctggagtgcagtggtacgatcgcggctaaccgcaacctctgcctcctagttttgagcgtttctcctgcctcagcctcccgagtgagtagctgggattacagatgcctgcaaccacggctggctaatttttgaatttttagtagagacagggtttcactgtcttaaccaggctggtcttgaactcctgacctcatgatccacccacctcggcatcccaaagtgctgggatttgaggcataagccgccgggcctgggaagaacgggttttcttattgcagtctttttatgcctaatatgctgacatgcattctgagtttctaagaggaccatccaacaaccagcatgcatcatcccccaaatttttgtcacctaaagcatatgtttcccccagatctttggaacactatttaggaaactctactaactaatctatgtcgacgtgaccagaaaataagtttcttatgataatcttaactgcagccactataaaatgatatttaaaaaattattgactgcccagtccagacatatgtgtaaaagagtgttacttttggctctgacccctttatattaaaagtgatctaaagctgctttcaatagagttttcaccgctgtcctatttttggatagcagatcaaaatgtgactctttatactcagaattatctttatcctgctcttatctttaattatgcttaaagactgccctgctccttgttcttcaagtcttcaagcaagccgattttgtcctggcacatagtaagcattcactaatgttaggtattatcatcatcattgttactattattattactctcctttttcaatgaaaatctgaacttccctgatatgcctgtgcccagataagtctaagaagagttgctatggcagtttccctaatagtatccgtaagcaggaacctacaaattctaaacataccatacgtactgttagagggcaatgccattcatccattcatcttttcattccttcactcatttagtaagtatgtatttgacacctaatgtgttccaactactatagaaagctttagggaagatagagagatgattaagaaacagtcccaggccagaagaggtcataatctagtgaatagaggaccaacacatgtagaaatggatcattgcattgtcttgtaaatagaaggaaaagaagtttttcctttctaactctgcctaagctagtcaggaaagtcctccaaacagaggtgatatttgaactggctctagaaggcttagtaagacaggagcaattgcagtggaagaattgttttctttgcagaataattaagcatgcacaagagcaaagtggcctgaaagagcaggcctgttaggggagctcagaagcacccagacacggagcatgggtgggaaggaaagtgataggaaaagtggctgcaaagcaggctggggtcagtttgtgatttaatgggttgtatcttaggctgctacttattgattggtagtggctgtccagaaatctgtgttaatgaaggtcctgaggcaaggcacagtataatcccagcactttgggagtccggggtaagggggaatcacttgaggccaggagttggagaccagcctgagcaatatagcaagaccccatctctataaaatattgttctttctttttttgtgtgtttgagtctcactctgtcacccaggctggagtgcagtggcatgatgtcagctcactgcaacctctgccttctgggttcaagtgattctcatgtctccacttcccaagtagctgggactaccggcacaagccaccaacccgactaattttttgtatttttagtagagacggggttttgccacgttgaccaggctggtctcaaactcctgacttcaggtgatctgccccccttggcctcccaaaatgctgggattacaggcatgagccaccatacccggcctctacaaaagttttttttttaactatccaggtgtggtggtatgcacctgtagtccaacctactcaggaggctgaggtgggaggatggcttgagcccaggagtccaaggctgtagtgacctgttgattgtaccactgtactccaccctgggtgacagagaaagatcctgtctcaaaacaaaaaagaaaggttctgaagttatgcctgaataagggtatttttcctggactccagaatgatgcgtggtagcaagtgtgtagtgggttttgatgtatttgccaatcccgtagacaatgggagccactgaagcgtcataattggggaatgagctgatggatttgtgttttgggaaaatagctcttccaacttgatggcagacaaagaagaagatggttagactaagagacagagtaagagatgattacagtagtaaatgaggacaggagcttgaaataagagagtggcattggagacaggagagtataagaagcagcccaaaactttaacttaaaacaaagacaaagatgtttagcagatatcacagacatgaggctttcaaatgcttcagagagctcagtggaataaggactaaaaagagggctttagatttggccactaaaaggtcatcagttaatttagagagaacagttttagtagctaagtaggaccagagggagaattataatgagaagagaattgattaagaggtgagaacttaaggagtgagctcttggtgacaaagagagagcagagttatagaatggaaaagttgcagctttgaagttccttctgtgacagtatttcagagctaacaagagaattcagagactgtctagagtgaccttctcatatgattactgcagaaactggggcccagagaagatgagtgacttgcccaaggtcacacagcatggaatcaggactttatcctagatctctgtgttctacagtcttcttttccctaccccacactatgatatagacccacactctcatttcctgcttgacgaatgtattagtccattctcgcactgctataatgagatacctgtgactgggtaatttacaaagaaaagaggtttaattggctcacagttctgcaggctgtccaggaagcatgatgctggcatcagctcagcttctcaggaggcatccacaaactttcaatcgtggcagaaggcaaaggggaagcaggcaggtcttacatggcaggggcaggagcaagacagagaggagggaggtgctacacacttctaaacggccggatctcacgagaactcactcaccattacaaaaacagtaccagtggggaaatccacccccatgatccaatcatctcccaccaggccccacttccaacactggggattacaatttgacatgaaatttaggcagggacacagatccaaaccatattaaggaaattagtacctggataagtaaagaagcatccatctgggctcccaacatataatggcagattaaatcatgggtatgggaatgaagctgatatgggtccagtccacttccaaatactgctgcatgagctgcatgacttatccaagatgccattttttattttcatgcatttaattcaacaaatacttattgagtatccactaagggtcagggcctgagttcagtactggactcaccagggaactgggaggaagatgactatgctgccttcattatggatattaggatccaatggcaatacaaagacctaaacatgcagtgagaacacagtgtggaaagtgcagccgaagagtaagtgcagggtactgtttggggccaggcagcaagggtgaaaacagaggggagaggaagcatgatgtgttagggggactgaaagactctcagtaaaatagaaacctggtgggaggggtaaatggaaagagagaacatgggatggcctcagagctgaccaaaggcagatgagagaggttggccggccttgacgaagagtttggactctatcctgagggaggtggggcagggtttgggttggagaagagctcgctgaggggaagaactcactgagggttttaacgtgagatataatcctggaattcaataggctgtttaatagcataggcggtttatcctcatctacttatttgtaaaagggaagattataatatagccttgcatcctgtgatggttaaatatgattttacattttgcatttttttctatctccatatgaaacataccctatttgtccatatatctctgtcacataggaacagatcgtgtgtatgtggtccatagtagctttctaatagaggcgacttcggtctcatacctacttgcttctcaaaggttggccctgaaccttcagtccatcttagaaaaaaaaaattgccttataaaagattcatctataaatgacagtggttaaaaaaaaatttctaccaccaggacagagacacgtgactggattttcacaatgctggttcttccaggatttgaacgtagcatgggttaaatcctgccctcaaagcctgacaattactcaggtttacaatgtgttagttttccaccgcaatgccagcattgaaagggctcccagagtgtatgaacatgaaaactttatgtctggatgaggacaaaacagttccaaatagggggctagaaggtatatgtggcacacagcacaaatgcagttttgcattagtttgtgtgacaatttgacattcatttctagaggttgccaaatgggtttgattgcacacagtatcagtaaaagaaaaaaattgctttcgggtgttaacctctaaaaatatgggcatttgtttctaactgatatatactaatttaccctactaatatattacatagaagacatataccaaatagagaaattaattttaaaatgagactttaacaaattgtaacatgagtagtggttctgatattttcttcctccctcaaatggggtttatacagcccattttggagaccactggtctcagcttcaggcttcagggtggtagggacctatcctgcttttgctcacctgtctcctcagttcctggggcagtctgtcctcaataaatatttttggaataatgaatgaatggtttaacaggatctttcttttttttcttgagatggagcttcactcttgttgcccaggctggagtgcaatggcacgatcttggctcactgcaacctccacctcctggattcaagcgattcccttgcctcagcctcccgagtagctgggattacccatgtgtaccaccaaacccagctaattttttgtatttttagtagagacggggtttcaccattttggccaggctggtcttgaactcctgacctcatgatctgcccacctgggcctcccaaagtgctaggattatgggcgtgagccaccgcacccggctgatttaacagtatcttaaagttggctagcaccttcagtggtcaagcctcacgtcccactcatcagaggcatcttctccatgaactgcctcatgaatgtcacctaactcacattggcatacttcagtgacaaaattcatgaggcatcctttttcttttagatcactctagttgatgtagaaatgcccactttttacccacccaaacactgtctccgtgtagcttttaccagggatcttgggttgagctacctggacacagcatctaagcctcattaacagccttttaggtatttaaagtgactgctatgaccaccttcactaacaaacatttatgaactctaaacatatggccaggctctgtgcttagcactggccttaagaaggatgtagaaaacacagcaaatgaccttgagaagtttcttgtataatcatttcttcggcataaactcccccagctgttttagccccttcttaaattataattcacaccttcagccctcttggcagccatttggggaatgtgtacactaaagtctattgagtttatgattgctttgttgggcatggcatgcagaactgggtaccatatttcagatatggtcagaaaatcacagaagtcagtgggactctgggtatcctttgattttaatcctttacacttattaatgtggcctaagcttttatgtccattgtcattattagcttatattgcactttttaactaaatgtttggtttttttcacttaagttgctatcaaacaagattccccaataaatttacaaaatcctttattggtacaataactttttaaaatgtgggatagtctctttatccaagttgaatatttacttgttagggttagcccattgttgtagccaataaagatattttaaagtatggatttttgtactccaatgtatttgttattccctagattttaccagcctcatatttaatcattgtgggctcctccatgtcattgataagatcgttgatcaatgtcaaatacaatcccagcactcatcactcgagacctccattaatcaacactctttgggatcttcagttagctattaatctagtctgctattatctagtctgcattttccagttcatctgaacttatcttagtgataacgaggtacaccatgtttgtgaaaatccattgatttaccactctggtaaccctaacaagaaaaggaattacggttgggtgccgtggctcaagcctgtaatcccagcactttgggaggccgaggcgggtagatcacctgaggtcaggagttcgagaccagcctgaccaacatggagaaaccccatctctactaaaaatacaaaattagctgggcgtggtggcccatgcctgtaatcccagctacttgggaggctgaggcaggagaatcacttgaacccgggaggcgcaggttgcagtcagccaagattgtgccattgcactccagcctgggcaacaagagcgaaactccatctcaaaaaaaaaaaaaaaaaaaaagtgtgggaaactatttgctcttgatgaatcttagagaccgcttttttttttgttgtttggagacagggtttccctcttgttgcccaggctagaatgcagtggcgcgatctcagctcactgctacctccacctcccaggttcaagtgattctcctgcctcagcctcccgagtagctgggattacaggtgcccgccaccacgcccagctaattttttgtatttttagtagaggcagggtttcatcgtgttggccaggctggtctcgaactcctgacctcaggtgatccacccgcctaggcctcccaaagcgctgggattacaggcataagccaccgcgcctggccccctttatttttcctctttctaattttcgtaaataatgtgtccatttagacttaattatgcaaaataacactttctgtgagctgatgtaataccaggcacttagaggcacttagtatttgcttactaaatacttacttagtaactgatatatggcagctgtaaaattgaagtggcagacagcgcacagctcctgaatgctccagttaagcagcttttgttttccagcatgtatccactaattttgcagaaaacttttattgagcatctgttgtgttccagaggtcacacaaagaagtttagaagcaatctgactctcaaggaactcagtctgatagccaaaactatctcataaacaaataattacaatataatatgttccattagaatagaggtgtatgtgggatatgttgtaaaaatcatgaaattgttaagtgcattcagtgtgagaaagacctgagactatagatttatctttccagggccttggttcaaatgtattaatttttcaaagcctgatttctcactgtaaaatgaagacatgagtatatctgctcttgtctggtttattcgtggattaaatgaaatcatttcagtgttaggctcaataaatgtcaactatatttaggaagattattggactatatattatcagactgtattacatattattggtatatatattgagaagattattgaactaaatataactattgaggaaggttattgattgtatctagctgttgaccatttaaaataataggtttgggaacctgttggagtccatctgttccagggtcccatatttagtggttaattcctagctccagcctcaactcctgccagtgtattgcaatcatcagaaagaaaaagtagaaacagaaaagcaagtgaggagatgaaaggcaagaaaacttaaaaaatttaagtgcagattctttttttttttttttttttttttttgaggtggagtctcgcactgttgcctgggctggagtgcaatggcatgatctcggctcactgcaacctccgcctcccaggttcaagtaattctcctgcctcagcctcctgagtagctgggattacaggcgcctgccaccacatccggctaatttttttgtatttttagcagagacagggtttcattatgttggccaggctggtctcgaactcctgacctcaggtgatccgcccgcctcggcctcccaaagtgctgggattacaggcatgagccactgcacccagcccaacaggcagattctgttagatcagtcatatcatctgcataagtgaagagagcattcattacacactgagctactttggcaattgtttgttacaaaccataactcattagatatccctaagctcatcatcggaactgaggcaatatcctaccatgtcacttgattgtccatttggttctgagtcaggcttaacaatcatccacagaacagactagtccaatttctatgggtcccagaagagctgtcaataacaacagtgtcaagtcagatcctgtttgactgtaaacaacagaaaactcagctgatacacatgtgtctcgcccattaaggaatttagatggccttttttcctcttcctctcttgcctttcccagtggcaaagcctcttcttcatgttgcatcatgattccaagatggccgtagccactctaagtttcatgtccaccttccagggagaaaggagaaaggggcaaatggccaatggaatgtgctagtcaagttcatccctttgaaaagattccccagtagactccaacaacttctcattggcaaaaaatgtattaaaagatttactctagtggcaaaaaggtgttgaaaatagaatttcaactttccagtaaacaaagtcaagagagaagtgagtagtgagtggcttttagggcgacactctatggaatccaccacaaatagattacctttagatgtcttttctcttttttttcagttccctttaataatgcaaaagttatagattcatagtatatagtactttcgtcaaatatattcttattaactccctgtgagaggctatccttattatgtagaccctcttttatagctaaggcagaaatatttcagcctgaacaacttgttttacattttttatttttaatttttgtgattatgtaataggtatatatatatatatatatatgtatttatgggatgcatgagatattttgatacaggcatacaatgcataataatcacatcatggaaaatgggatctccatcccttaagcatttaccctttgtgttgcaaacaatccaattatactcttttaggtatttttaaatgtacaattaaattaatattgactagagtcaccctgttgtgctatcaaatactaggtcttgcttattctttctaactatttctttgtacccattaaccatccccacctcccttccaccgctctgtctaaataactcctagaggcaactgggggacatacattcctaattttcatgaccactgaaaaagcatgtgctttgggaatgctaaaataagggcaatgagggatagaaaaagcattaacaggaagctttgtagctgtgtgaacagctggatgtgaacatatcttgtatcactggggcaatgtaggatagttgatatctctttgtcacgacagtttgttaatttcagagattcagcatttcattgagccatagcattgtcatgtacagctcatacctctgttggtgtttgtccccagtctctttctctctagtgagttttccagttaattttattttagtttaatagcattttgtctgtcacctctgactcatgacttcgtgtggctgtgtgtagggacttgaacagtgaatacagtagattacttagagatttgtttttagtttttacaagtgaacaaaagtgatcacatttcaatgtgggaatcccagtgataaatgccatttccgtagagagttaactcatcaattgaacaaagcaatcagattttttttcttagaacatattaccatcaatttttaagtgacttttaaacaataatgagaaatctcttaatgaaagaatctctgtgaccagataaatgctaatagtaactgatataccattaactctactttcctccatcccatctctttaaaacttgatgttctcattaatttttttcccgtcgtctgagagccctacccttgggactatactagttatatctgcctaaattgtcagtgtccaggggtgacagatgtagacaatctcctcctttattatgcatgagctaggcaaagagggtttgtactcagtgaccatccattttcaaggccccttccccccatcctcaaccactgggggtaaatgggcatgtttgaggaatgtttgccaaagggttaccctgatttattaaagctgtcatttaagcatttaagcattgaccgggatgcttttcaaacaaatgacctgatccttaggatatattcatctaactaattctgtttactaagaagaggttggaaggtatatgcagaatttcttcacttcgacataaaataacacaaagagaatggcacagaacccagagtttcttgccctccagagagatgcagctgacaatctggaataataacagtgttatgctatgatatgataagggtgagccagagatgcttgaatgcagatctggctccttgaaggaatccatattatgacctaaagaagaactagaaactgagtgggtataagggcatgcacaaaggcccacagagaaaacatggtacgtttaggaaaccacatatattagaagagctggagtgtagagtgtaagtcagggccagctggaggccagagatgaaagttagcacaggccatgttgttaaaggccagataatctaagataaaacatttagactttagcccaaggcaatggggaacgcttaaagtagggttggcatgttcagatgtgtgctttagaaagatgacagaaatcctgtggagtaggaatctatttcaccgatgaaaaactagaggctctgagaaattatgaaacttacctatggtgacacagataataagtcggcagagctaaggtttcaacccaagtcttactccaaaactcatgcatgagcttccagccatgctaaggtttttcaaacttcatgttacaccctattagtacctcttaaaatcaatgtagtgtgatcaatgaatatttgttaatagaatataaaggaaaaagaaagagcattacatatactgtaagtaattaagcattgttttgtatttttgttgcagttgtacatgtatgtaaaatgtggacatagggtatgtgtatagctgagtattggcacatgatgcaaaatgcatttctcagagtagattgcagtcaaaaatgttggaaactactaagcatgtgcaaatagcatgcatgctgctgctgacctgccagatatttctcccttcctccctttctccctcatttattcattcattaactgattcattcatcccattaaaaaaattatatgtatgttttgtgcaaagcaccctactcaaggctgcggggtacaaaagtatatcagaagccttgggctttgacctacttctctgtagtagtgctagatttgtgtggatctgccacacttactccaggcctcttgtgacctgtgctttgcattaatctcttaggctaagccacataccttttcattatacaatctttgctgatgctaaggacagattccaaagtgccctccttataatttttgtatttaatgcaaagtgtaatcaagaataggccattgttaggtcaattgcttttctgtatttatcttttcaaacaataaataatcagtgggatgaaaaagggccggaaaagatagttttaatggtatactcataattatccaacattttaaggagacgttttaatatttatatgctgtgaaatatcctctcttctggaaagctgactgaggattggtatgaacccatccagaaatggaattcaggagccattgttttgcacagacttcagtcaatcctgagcaagcactctggattttcccaaacttggccgttactcagcctctcactctccaaattgtcaagacttctgtataccacactaagaaggatattctcttccatgtagatgcagaagattttctatgtcaagttcagtagggggcctaggctcaagccatgctcattcttagaggaaaacctgacaggatatccatatactatgccctctactgatttattcacgaaaaaccaagccccaaaaatgccagtcaggtcacacgcacacttaacaccaagagcttaaggtgtagtcacatcttacagggaaggttagtctttaaagtcaaacacaagataagaatagctcacagtcaaaattacccttgaaaatcccttaaactaccctttaagcaaagtgtgtatgatattatatacaacatttatattaattagtatttatttacactgtggtttaagagccaggagatagaacaaaggaagacaataaaggaaaatctgtatagaagagacagcttagcagttaaggccatagattctaaagccaaaccttcttgatttaaaacctggctctgccactcagtatagttgtgtggctttgcggaaattattaccatctctctggctcagtttccacatctgtaaaatgagcataatcgtagtacctacatcagagtgttattacaaggatttgcattaatctcttaggctaagccacataccttttcattatacaatctttgctgatgctaagaacagattccaaaggacagattacatatatgagttcatatatgtaaacagaaaaacagcagctggcagttaataagcaccatttaagtttaagctaatgtaatatatgctgatatgtgagcatttacaccattttgtcattaagattgcgattcattccctgttagtgaactttgaagttgggtagggaattacaaaatgttcttaattctcaactttagtagattttttttttccatttggatgacagttcttatcaaataacttcatatatttgtctttacattttctgtaaccatatagttataattattatatagtcatagttatatatagttatatagttatttttaactttttattttgaaatttttctagagtcagaagttgcagataaaatattgagaagttccttgtacccttcacccaattttctccagtggttacatcttacataatcgtagtacaatatcaaaaccaggaatttgacattggtacaatgcatgtgcatagttctgtgccattttgtcacacaggtagatccacgtaaccatttttgcagtcaagatatagaactattttcatcaccacaaagacatccctcatactactcctttacagtcacacatctttccccatccctaactcttggcaatccctcatctgttttctgtccataattctgtcatttctagaatgttacctaaatggaatcacataaatggggtagcatgtgaccttttgaagcatgtggcttttttcacaccctggagatccatccaagttttgtgggtatcactagttcatttcttcttacttctgagtagtaacccatgtatggatgcactatttgcttaatcatattggatatggttaacccatggtatggatgtaccattgcttaatcatgctatggatgtaccatttgcttaatcattcatctgttcctggatattttggttgtttccagtttatggctattacaaacagagttgctataaacagtcacctacatgcttttgtgtgaacatatgttgtatgtcttccattcttatctgtatgctttttatttccttttcttgcctcattgtgctggctagaacctccagtactatgttgagccacagtggtaaaaatgaactttcttgacattttcctgaaagaaaacattccttctcactgttgagtgtactgttagctataagttttttgtagctgtctttatcaagttgaagaagtttctcttcattcctggttttctgagaggttttatcataaatgagcatgaattttgtcaaatgctttttccacttcagttcatatgatcttgtgatttttttttgtttaggctgttaacatgttggtttacattgatcacttttcaaacattgaacctgccttgcatttctagaataaaactaatttattatagtatataattatttctagtcatagtatataattaaatgtagtcatagtatgtaactattttatatatttttaattgtattaaatataatcatttaataaatactcagttaaatataatttaataaatattaaattgaataatcaatttaatattgtattatgaaataatttatcataaatttaataaatttaataaatcgtttaataattatatatatttaattcatttgctaatatttattgctgtcttcattgaatgtgtaaggaaagtattacctccccttctttttctggaaaggattgtgtagaactcatgttaatttttctttaaacatttgttagaattttccagtgaaatcatctgggcctggagagttcttttttatgaggtttttaattatgaattcaatgtccttgataactgtaacgctattcaaattatatcatgttgtatgagttgtgggagtgtttacttttctaggagttggtccattttaagttatcaaatgtatgtgtgtagaattgtttgttgtattcccttattttcctattgatctgatattgttagtatcttattgatctgcatattctgtagtgatatcctctgtttcattcctgatatttataatttttattttctcctttttttgtcaatcttgtagattttaggctatgttttcatgtatcttaaatctacagatgttttgagccaaacaatacactgtaattactgtttatatggtaagcatttattttaactgttgctttttctctttgttcctttctgaatatctgtgtttcccagaatacttttccttttttccttaattatttcctttagtatttttgtaatgtggcaaattctctgtttttatttgttttaaaacagttttatttcatctttatttttaaggatattttctctaggtatgtaattgccagtgatttttttcttcttttaatatattaaagatatcattccattgttttctaactttcaatgtttttatcaaagtttgttgtcagacaacttactcctttgaagatacaggttgaacattccaaatctgaaaatccataatcctaaattttctgaaatctgaaactttttgagcactgacattatgttcaaatgaaatgctcattggagcactttggattttggatttttagatttggaatgctcaaacaataagtatataatgcaaatattctaaaatccaaacacatccaaaatccagaacacttctggtcccagacttttcagataagggatactcaacctgtaatgtatcatttttctttgactgccttaaattttttcctttttgtcttggttttcagcagttttactgtgatgtgtctgtgagcgtgtgttggcagggaggtatgtttaaacctgattaggatttgcagagcttcttaaatctgtgctttagtgttcttcatcatctttgaaaaattctcagctggtcacacctcttcagaattgtttctgttccctcctgctcctcttcctctcctcttcttcctcttgtcttcctcctcgtcttccattttcttctgtctttctctctctctcccttccttctgggatccaataaagcaaaaatatttgacctttctgtacatgcgtcttgctctctgttcgtttctggttttctctctgtgatgcagtctggtttttgagttctctgtcttctgatttactactcttgcctgtgtgctgtgtccagtcttctattaaacccttctgttgagcacttaattttagttattgtaattttcagttttaggtgtctatttgtttgttttaccctgagatgctacttctctgatgaaattctccatcatattatcttttttcttgaataaattaattgcagttattttaagaaccatgtctaataatgtcactatctgaataatgtcactatctgaactgtgggtctgttcatattgtttgattttcttcttcactttagtcatttggtcttatctcctggtatgcatatttttgatcaaatgctagacacagtccttgaaaagctgtagaaatctcaggctgatgatacctttcttcagagaagatgtatttaataatatgtcccattaagggacacattgccttaatgcagtctttgattgagatcactagaagctggattttagttatgtgaggggtagtgtattagtttactcttactcctagagggtaacctttctgtgattctaactgagagtctgtgttgtttacgagtcccttcttccttagcaggttctcaactccaattcctatcttcccatccctgtgagaatgtcagaatctctgctcagcctccaagtctctttgccactgcactctgctcattttcttagcatttgattctgtgccacttgtgaattagcaaatgacttggagagaaaaaacgccacagaatattgggctcagttcagtgtgcttacctacctaccttttagaatcagtcttggcctcccaagtcctagctgtcttgggagttctccaatgccttcaagtagtttttaggtttccttttttttaagcttatccagcttttttgattattctcatgagagtaagaatgcaacaaattcttccaccatcgccaaaaatagaaacccttatcttttttttaatgttaagtgttgacaacaatatatggttaacagacttcgttgttagaaggataaaaagaaattaatatatatgaaagtaacatgaatagggcctggtacatgatagacacttttaaattactttcaatttgaatttgaatatacagtgattttggaaacactgaaaaggttagtgattagcattacatttttgcctgttgatctttcttgttgaggccctacagtcactgttgtgctcctgggccttggtcttatgaaccttccatcagtcacattcctgaaggctgcctcttcccatcagtctccctctcagagacctgttggccctcctcaccatttcagtgaccacgtttagcaacaggaaggatgggtttgcttccttctctcgtggctcatgtctcagtgttcaccacagaaaatagctaatctggtggtggtcaacttcagacctttgtctcgtttgttttcctgaatgtttgccactgctttgcactcactgcagccttgttccagcttctttctcctggcagtgaggccagtgttggtgaaagatggcatggatcttacaaatttgtacttatgtgagtgaaaactgagaaatgccgagaaagacaggcagaactagatctaagtgtttcagaaactaggaacattacagtaccagaagacttggatgtgcttaattccagtttagaatctggaaaacaacttttttgagtctctgcaatttccaagtctcaaaactaattcactagaaaacatttaaaatgtaaagcaatagacttcagtagtaattttcagatcatttgagtctaaatgcagctttgaggatatgcagttcgtaaatttcctactgggtcattttttttctgagagggtatttctctaaactatatcagataaaggatgcccagaatttgctcagatgtgagtttcaggatctagaaacacaatatgaggattatcaagactaaggatgttgatagtgatgatgatgatgatgatgatgatgatgatgatgatgatgatagtcaatagtagtatttattgtatatttaatatatgcccagcattgaggtactttacatgcaatatgatgtctcttgagcaacatttaactttctattgattacttctcttgaggttatcatctttctcctagtggtcattaacatagagtttgaagctgggcataaatcctaggtataaatcctaactccacagctgctgtgatctttgtccatacaatgtaacatctttgagcctctctttgcctccagaatgaaggtgataccgtatctcataaaattcacagaggcctgaatgagttaatgcatggcaaacctgaagcacagtgactggttcttcctattgtgtgatcagcaagttgtagccatttttttcctcacttttctaccactattggttgaagtgccctttatttgacccgtcaaatagaggatctggagaataaaaaaatctaacaatgtaagaagaggaggctacagaaaccactgatgatgtattctgtaccagcttagcctccagtccagggcttaggaaacaaggttctttaacagtcatttgatttccataacattcattaaattaatgaatctccattcaacagatatttattgagtgagatttagacacagtccttactttcatggaacttaagacctacaggaggagacaaatattaaatgtgtagttataagtagagtgtcataaacatatttgacactgtggaggatcaagaaagaagtcactgagaaagcgacatttaagtcgagactcaaagagtgagtagccatgagaatttgggtgctgaaagaggcatgaaaggcactctgggcagaggagcagcatgggggatgccctgatgtggaaaggaacttggcatgtgtgaagaagtgaaagaaggtcctcttaccaacaccaagcaagaggataaagagcagaggcttagtaaatggatgagtcagtctgcctggcgcctttcttcccttcattgaaccaagaggtattccctagcacggactgccatgtagaaaaggtcccctattatttcagcaccacatttcagcttacccatggttctccagctgtccagggacatgcaccctctacctcccagagacctaacctatttccctatcacttattttcagggctatgaggtgccttattaatgtgataaatgtttgctccttggtcaacttttagtggtcctagataattgttctcaaatttgagcacgcatcagaatcacctggagaacttgttaaaccacagaaaccttggactgcacccacagagtttctgattcaataggtctggggtgggaccctacaatttgcatttctaacaagctgccgaatgatactcatgctgctggcctgggttctgtcggtggtgaatcattagtttaaggtgtctttcttctttcagcagtttaatagtcatcatcagttccttaactgaaagagaaatgctcaggcagggcttaaaggaagaaatactaaaatcaaaagtagactttatgagtaagtgtgacaatggcctaatggaatggacttctttgtaagcatgacttaccttatacatctgtgttcccagtgcttagcacatagcgggtaccaaatacatatttgaaggaatcacataatggatctagcttagtgactaaagaaatgggttttgtgcattagtctttggaaagctctcatgattcctttcaggttgaaagacgttctgggagaataaattattgtcattctcttggaatacagccctagaaattgcagagtcaagatatgcttgtattttaagtacttacttggattaaaagccaaattgctaacaggattacaaaatgccaagtttgctgagtctcaaattgtttatgcgcatgtttggttcaaatttctttcatcaatcagtacatttctgtttctaattacagtcttaatgttttttttgacacctgcacatgcattcttagtctaaaccagcttcagtaatttgcacagatataatataactgaaatgaggctcttaaccaccagtgtgtcacctataccacgtgtctgaggaattcagaggtgctgcacctcagttcacattgtgattttgaaaacagcctgctatttttcccattttcatgcccacaatgttgtaaacattttaataaacactaacacttttcctcattccaggcacatggagttctagtagatgatgcaacatgattttcgttgtgattttttatttatgtttattcttggaatctctgtacttggataaaagaagaagacagatgaccaagattaccataattgtccagaatataatgtatgcaatctggaagtttattactaccaccgatcaaattgattgcagactcttagtctagtcccagaagtttggggctggttttgatgtgagccattcatcaaatctcagacgtgactcacgcagtggctcatgggtcaaagccttccacgtattgtaatgaaccaacctgaacaattctgtacccagtttttagtttggattgtgcccctatctgacacctgtaaaattgtgagttccctgtgggctctaataatcagagtcctagttagagaaaaagtcatctcagcatcaactgacaattattttttttgccctcaatatccttccctgcccccttatttggtttgaactgactcacctaattggggtcaaccactgaaaaaaaatgtgttgctgattttgtcatttctgaatgcctagaactaaggaatatcttggcaatgacattgcttagtcttccttacacataaggagagtttgaacaatggatccaaattatcattgcaagagtgcactcagttaggggaactcagctgaggtgaggaacacgtccacgagtttcccctgtgggcatccagagtagccatggcctggccaggcactgccttgcggcccttccaaaggtggcagaatgatgttagtgttaacatttcactgcacattaattctttaaaaaaaaaaaaaaaaaaaaacctgtcatttaattttaaatgctaatatgcatatggttaattaagaagccaaaattggctataagctcagtgagctctgagaacggggagagagatcattacacttctgctcatggttagctatttgtgaaccaactgataatgtgcaaaattaagatttcgtaagtggcattttaaatgaatggttaatggctgaagattaattaaacagtcagagttgctgaagaaaagctgttaaaaattatgtttataggccagtcacttgcacgctgagactgaaatcctgaaagattgtggcctgtttactgggagagcattttaacaaagcagcctcctcgaggaaggaaagccagccacccttccccacataccatgcagctgttgcagtagccttagggactttgctttggagtaaaagcagccgagtaggaaaatggactagaaaagtgttttattgaagggatcttcactaaaaccttcatcccaggtaaccaggcagattttatttcctacctgcctgccacagagttctgagttagagtagtcagaacccatgggatttttaagaaagtactccataattctctaaaagagacaaagaattgcagtatattgttttcaacctgtagtggatacttcttaagtctgaaactgccagccctcttggtggtggaaacatggattctgtacatctggctctatcctaggttggttccttggaaaaaggtttgcctttgtatttaccactgtgcattgtgcataggaggtaccatactgtaaaaatagttgtaaaatttgttgtcagagcttacctgaataaatattggataaatcaatgaatgaatgagctacctaaaagttggttagtagactaggaaacgctctttttaaattcctttccatccatccaacaaatgaccaccctacttctctcgtagactgggtattaatgtgtggtctcagcctctgggaccacacaatctagtgggggagtcacaggcctgtcaacaagtaagttgcagccacagttaagcacagctagagcagccagagaggggggttaggaatctttgggtgcagggtagtcagaagtatattttgctatcacttgtaaggaagtttattctacctattgaaaaaatattagcatttatggaaaggctcttcactaaaacctttctctaaaattatatttcattaagaatatacactagtaaatatggtagttcattcagttcaatctcctgcttctaggcagaagacccaaatcacacaggccagatagttgtgtctgttgtttaaaagttccctaggaatggagatcctgcagcctcccttggtggcctgttgcagggtttaatcacccttctaatcaaggagttaatcctatttcctcttctctacccttctttgggttagtggaacctgtaaaaacacccatgagacccctcggaagccttaaggaattagtgagtcaacactgggctactctgggttcagcagtgtgcctggtaatggtgagactctgtactgcacgataacaatgacatgacttcgttacatctcaaatcaaaagttttcttcctggtctaaagaaaggaagagttgtttatgttagcatgttttagatgttgttttattacattttaatctatatgtttagttaattacacgtttgacctaatgtcatataactcagaagccaaattgcagtgttttgatttaaaatgaaatcagtaattattaaaaacaactaacactaaatagtgagaatccactattgctagacacttgctaattactttgcatgtgtcatttaatcctcctgacaatctgatctagtggtactattagtattcccaaggtacaaacgaggatattgagttgtagagagggtaaggaactggcgcgatattatcaggtgagccaggatttgtacgcctgaataaagagcctagacgtttaaccactgtgctatgctgactattcatttttaaaaattattttgctttctataaaactcgatttcattatctgaattcttttttcccctatgtgtgtaaagtccaaatttataaactttccttgtgggaagtaatagcattctgatgaataatagtccccaggtcaacggcagctcttgccgcaattactggcagttgagtggcaaatacattctactttaagaaaggcagtagcagttcactttagaaaaactgataattcaaagcttttccattctggtgaaaattttcttagcaaaagctaagaaaataggtactgatgggagaaaacctgccccattgaaggaatgggataaaaacctcctgtttgcagatgccagaagcatctggagaacagtgatgtccaataattgcagctaaaagctgcattaattgaccagtgataggttgaaagctgcctccaaccaggatccctaacactctggtgctttttcataagcagagtgagaggcaggaggtggtcagcttccatggggttctccatacagaaagggagcagctgtgacagagaagtgtatttctacagaagaaagtttagcgtttcaaacggatgcattcaaatcacctggggatcttgttaaaatgcagattttgatgccaggggtctgggatggggcctgagttgtgcatttctaataagctcccaggtgacactcacgctgctggtccagggaccacactgtgcttagcaagggtttagactagaggaaggcagtgctgaattgttattgattttaaaaaccattttaaataaacatgcagcaaatctttttataaccttccaaaatttcagctgtcatttcctcatatcggtgagatttgtgagaaatcccattcctctgcaggtcagaatattgttggtgctgttagccctgtttcctggaagagagggtatgacattttttgggtcttttttatattttaactgctgctgtctgcattagtgtccatgctttgacctcttgctgcacccagagaaatctcttgcaccttagtaatatgctgtgtctccacagttgaataagcatgaatttgaatttctttcctcaagtgctgctacgaacctgccaagaaaagttttattaatacaactaagtaatccatttttcccagtgtaccccattcacttaagagtttcaatggctgtgtttattccatcatttcggttaaagctaattatgctcaaaagatgtactttaccctaatatgtgtggcttggtttttgttttgttttgtttttgtttttgagacgaagtctcgctcttgttgcccaggctggagtgcagtggcgcaatctcggctcactgcaatctccacctcccaggttcaagcgattcttctgcctcagcctcctgagtagctgggattccaggcacccaccaccacacctggctaatttttgtgtttttagtagagacagggtttcaccatgttggccaggctggtctttaactcctcacctcaggtgatccgcccaccttggcctaccaaagtgctgggatcacaggcgtgagccacaacgcccaaccaggcttggtattattttaactgaatgctgctgtcttaatgtctctgataaagtatatcatctccattgatctgcatcataaacaagcacaaaggtttctagaatatatctttttggtcattttgtttgaataccaatattttaaattacgtgacctttttttgaccaacagcagcaaaaaagttgtcaccacaagagccatttgtaatggtcaaaagagaaaacagaaatgtttccgtggggcttggtttgcagatctgtgtgtttattaattctgtgaaatgccattgaattacaataaataggaagatgttctcaatgggactttcttctccatgtaggaaacattcaaaatctagaacagaagcaccacccagcttggtgtcacaacagtggggctgtttgacttcagagcaactctatccaatagagatataatacaaaccacatatgtaatttaaatatttcaataacctcgtctttaaaagttgaattaattttataatatattttatttaactcaatatatgcaaaatatattttcaagatttgttcacaataattattctagagctattgtacattacttttttcatggtggaatgaagccaagcatatctcaatttggactagccacaattttgagtgttcagtaatcagaagtggctattggctgccatattagacagcattagaaccccttcaacatacttccagtgggagctgatgcctcagttggaagttttctacacactggagtccagggcagcgaaagaccctcccatttcatggtagttcctgaagcagaaaacattttcttatgttaaacctgaactgccactaaacaagcaccattgtctcttctcttgtgaagtttatagactagggtaagaaaaagacatataaacaatccattcctgcttcagggaacagacacatttgtcagccctagcttttcaatatctagaaaaatgttccccacattaggtgccagatgctgcacagtaaggtaacctccaagtgggctgagctagaccaggcctaggtctgctttcatcccagttctttcttgctttgcccgaaaggaaggcaaaaacaatgatctagcttagcttacaaggcttctttttcctttagacataggagaatggaggctggtcttcagatatggaatatgtgtaatccctccacagaaggcttcgacaacaactaactcaggcacatgtgagaccaaactcacagtataataccagtgcgattctcatttagctacaaacttttccttccttaccaatagatatttcactattgtagccaggaatcctgagaggcagtgccttacagcagagccttctctttccctgggctatactctccttctcagtaaaccaatcatccctcaagaagtcgtgcctgtaaaagatgatgtaacaacagatgtagtcttcactttattaatttgcatttatcaccacaagcttttcttcatgactattgctgctgttttatacctgtgacatctcagtatagagaatgttatccacctcattgctcaagccagaatctgggagtctttcttgaggcttctgccttccctgaaccacacaactgacctctttctgaggaagaggtaggggaatgggtagcactggttctcacgtctctgcactgcattttcacggtgagcatcaggtacttctcactgttgggtccagtgttcctcaaacttttatttgatccattgtgctttccctctggcatgctgcagtcatctggacaaggcctcaagctccctacatgcatttcctttaacaaatgcctctcaaaatatatgtctatatggctctcttcttgctaaagcccttccgtcctcccaattttctgaggagaccaaccttagctgcatgattcaataccattgtactagtgaccacagtaccatttttcccctctatctttttttttttttcttaatgaagccctgtgtgttattcaggattcaactcaaacatcccatcccttagtgatcctctctgagctttctgtgtagacttctagcacagaatgatcacagtgtgttggaattgactgttaacttgtttgtttcctctatcaaatcttgaagcaggcatgatgttttcaatcctggcatagttcctaaagcattgggtagtcaataaatatgtatcgaatgaatgaatgaatccaagggactctacccttagctacatgacttcaaggtgacacgagcttattggacatactcttggactgaccaacccccaaactataacttgtcttgcctcctagtcagcacggcttccttctgattgccctctccttctgaatcatgatgccatgattctttggttttagtgatcccacatgtttctcctggtctttggttctcaccactgggcaaggtattcttcctgttcttcagcaggaggaagcacttcctactaaagtatccttagatgaaggacttctccagggcacagcaggtgactttttcaccccatccagtctctgcttcagaagcttcttaaggggaacaaggttgtttgtactgtccagaaactatagtcagcctaatcttggctgatacctcaagaggaaaggctctacttggcaattacctttttgtaaatctcttcctcacaccctatatttgacatagactcctggtattgctctctaaccatttctactgttacatcccagagaacgttgcattagcaaaatttagaagttagcatcaaatagaagtcctctagttattctcgaatttgcttcccccattttaaaaagcttgaccattacttgcttgcctccagtatcaagacacatctgccattgtctataatttctcaaccatgctgactacgcatccacgagtataccttccagctctttcagtaccttgaatataatttgtaagtaccagtaagcagggtgactttaaagaatcctggatcatgcattttctttcttcctcccactatccttttctttttggcctctctcctgctttccattgatggagatgtcaggtgagtcacttaatgtctgtgtgcatctttcctcacctacagacacacagggtggaactaagtgatctcagcattttttttccagttccaaaattatatggttctgcaattctttaatggaagcaaaataggagttcaggttgctctgccttttctctggcactgttaccatgtcaaagcatcccctcccagcagtgccctagcctttctcattcctcttcaaagtagctttcacaattaaatctttaatgtcattatcatttgtttcacaaccctcttagctcctgttgaactcggcttttctgactgtcttcagacctcttcaccaatttctttgttaaccacagtgcccatgtatccactgtcagatgactccctctgctcacccctgcaggagtatttaagcttaaccccagatttcaggagttagagcatttctcctgaatctccctaaactcgcatcagatctcttttgtccattcaggttgtcctgtctagataatgagaatttaagttataagatttgtaaggatcatggaataaaggcatacaggcaggtcactatcagcatttccagggcaaccctgtctcccacttagatcctctggcttagaaactactgaagatctgtaaaacgtaatgaggtttcaaacagatgtggccactgcccctaggagttggataggatcctctgtgagacagggcagagaaagtcatgtttgactctattaggaaaaattctatggagtttacaatagaatcatagggaagctcttaaacagcaccctggcccattacagacaagtagacatggaaggatactttaaaacaaagtgtgttttcaagtgtttcacgtgtgtttcaagtttaaaacaaagtgagttttcaagcccaggaatgatgtgaatcagacatcagaagggagaatcaattcttgcagtctgatgtttgacaagttgcaagttgtgacctcgttcataccctttaattcagtgactggcagtgttggtcagctgtgtctttttaagtggatccatgttgaagtttgttgtccaggtgagtttcaaatactgggagtaacctgaaaagtcttgggcacagtttcctagatgtattgtagatccataggtagacacatggcttaacatcttccattcagttttatgtaaccagtaccactttttcatattgatatatctatatgtctttttctatatctagatgtcttttcttaagttaaatgcattggcttaaaaaagaaagacactatcagtgcaaactcacttttctttttttttttttttttttttttctgagacagagtttcactcttgttgcccaggctatagtgcagtggcgcaatctcggctcactgcaacctctgcctcccaagttcaagcatttctcctgcctcagcctcctgagtagctgggattacaggcatgcgccaccacgcctggctaatttcttgtacttttagtagagatggggtttcatcatgttagccaggctggtctcaaactcctgacctcaggtgatccacctgccttggcctcccaaagtgctgggattagaagcatgagccaccacgcccggccctcatttttattttctaaactaaaaaacagtaacctgagatactcactagaaaataccttggccattaattggtcagaactgtaactttcaaagtaacctattgtctgtttacatgccacatgacatgaaactctattttaatcaggaccgtcacagataatttctgcaataacatatatctagggatggttttcaaatggagttgtcatgttgtgtttagcagacaggagattctctattgttgtcaggccctctttacaaaagcatcagtaacccagtgatcctagagaagcagggcttaccactcagcttacttagaataaaaaagagcaaggctggtttctgtctgcacgtagtgtgtttgagggctcttttgtttagctgggcttccttgtagccaacaatgcttttacagtcttggaattggatttcattctcctgtactggtttttgaaaagtgtaaatagtttaatgcatattgttattctctgaaggtaacataggatgcataaaaccgtatacatctgaattgtctcctcgaccaatgaagtcatggaaagtcaagaaaaattaaaccgtctctggatttatacacactctccctttctctctctctgacacacacatgtgcacacacacacactttctctttagtgcctttcaaagttgtcctagttttcttacaattagcacccaagacatactttttcaataattagtaaaaaaaagttaatttttgtccattgttaaaacagtgaaattttctttttagagtacataggggccatcatactgagttttatgataataaatactattttgtatcatataaatatgcaatgatatataacatataataatttatatcattaaagaggggctgaaaaaaattgttggcttctacatgtttgttcctctcaagacttctcctcttaaattcccaaagaataatacttctttattcttaaaactcactttatgctcaattcccagaaacagaagccaaatagggtaaaacaagatgcccagtaatggttcttacagttctcaggttctgtagtacaccatttgaagctatgtagtcttcaaccttgagtgtatataacagagggaaaggcaagctctagacatccattccagtcctaggattctgtggttctgagaagtgagaagggagacaaatgagagtatgggaagttgtatagagggggggaacagacagaaaggaacagaacaatgagtagtcacttggattacagaaggaatggcaatggaggaccaataaataagtgaatgaataaatgaatgaatgaatgaatggaaagaaaagtaagtataaggaagagaatgaccaaaaatagaagttgaagtggtccatttgagctagaagcttggcaattttacaaattctagcaacttcttaagaagctctaaaaagaaagttctgggttaggaagtttctcataatagttttcccactatccagtccccatattgtcttccaccataaacatctgccatgataattctccactgctagacctcagaagactctccctttcccattaataaaaaggggactgatttcataaatttagcatattacgcattgcagcattctgcctttcatatcataggttaatttttcatggatcgttatgaaaaatataaacaaacttaaaattctatttatgattcagacaaccaacaaagtaatgagattctgtgttatggtagctgtcacatcttgtctcagcccattgtgtctaaatgttaactctcttattaagctccattaaagggttttacaataccaaattgtttatacactgctggttttctgctgcctgacagtagggcacgtttcactcattaatatgggtgatatcttacattgttggaaagagctgaaataaaaataaacaggaaggtggcatgtactaactgaaatgcttctttcttctatgtttcccaatataaggttatatatatgtgtgtgtgtgtgtgtgtgtgtgtgtatgtatatatatatatatatatatatatacacacacacgtatataaaaccctaaatatatatatatatatatataaccttaaatatatatattttatatttttttaacttgcagttcaacctgttgtcttacgaaaggggagatattcttttctttgttacgtttaaatgaacttcaccctgagctaccaaattatacttttgcaagcttgatcttcaacctcacttatgtccccatgacaacctttcttgccatgtgaaatttagagtaactcatattggtaggtttcattatgggtcataaagcactgtcatatacatgttcttatttcatcttcaccacaacccggtaataagggaagatagagatgctgaatctggtagaagagaaagctttcctaaaactactcagttaaaaaatacaggcaccaagtttctgtcccactgtggttagttcagttctaatgctacttgccttctttttatatttttattatttaaagatatacttttattttcttaattttctctgagtattctatattaaatttaatagcaaaaagctaaggaagaaaaaaataaaattgctaattattccacgatttaattggctattattaactttttagagtattttcatccagtgtttcttctggttttttgtttgtttctgtgtttatcactgcatataaaatatatcatttgtgcatgcatatagtgctcacacacacatatagtatttacatgcatatacacatttgagtattttgcctttttacaatgatactgtgatattttcctgtgtcaattaatctctttgaaaccatcgcttttaaggttgcatgataactgtatcttaatttatgtaacctttcccttaatgatggacatttgggatgtttcagagttttcagtgttataaattaccctctgataagcacctttataaaatattttgctacacagcttgaattatttccttaggattcctggaatggaaatgatgaatcaaaggcttgaaacatattgccaacaattttcttgaaaaattgaaggaaataatgcttccaccagtaatgcagaaaatagctaatttcaccccattcctgacaactttgagtatcatcactttccttcctttaccctttactaatttgattcatgaaaaatagtactgtatcattttacattgaacttcttagcttactagtgaggttaagcatttttatagaagctcacgcctgttccaaattaccactagaagttttcagctcgcctcagccgtgagtcattaccaggaggaatagttttttgaatcaacttctgtttcctccctcaacaaatctatgtatatttatcaagacgtatttggatgcaggcttttatctccctcttgacaaaaatgaatgattatgcacccaggtcttttatgcactgaactaagctatatctacttggaccttgttttaattgactcacccttcccctaatagaatagcgtccctttgaataggcagtattagaaaaataagagcctcacagtagattgtgaaagaaatgtcacatcagaatctggacattgctatgacaacccaggccccgtctatcaccactcccatcagcatgtgttgcaaaggaaacccctttgcagtgtttaatctgagaattttaatattaaatacatatttgacattgaaagctcacaccttatttgctattgtcaggcttgtttgatagacagctaactcggtctctttttatagtcaatttctgaaatgaaactataaattttgaagctgggcttcatcatcgcagagagcaaagcttttctagcctattgttgaaatgtcacattttataggatttatgtggtccagattcaggaagatcatttgccaagcacttaaggctggttttgctgccctttgcttttctcctccctgcaaatacatatggtggcagggggagagccattagaaaagaaaaattatgaagaagaacttacttgattcaatacaaatgtcagcctaagaaagaaaaagtcctgcacatttagtgtgaggagcgttgactccagaagcctgctctttggtgataggcatactgtttgcttctgcaaatgaagtgggcatcatatttgttgtgatagtcagtgaaagcctctgatttggtgcagcagtttgaatttatgctcataatacaagttctctccaatatgcttccaggattccttttgaaactccatgatatgacaagctctgtgatttggtcatattccatttagcttgttttattgctgttaattttacacaggaaaatagattatctgaaacttgtgatcacagtcgctgtcaagtggtcaaaaatgaagaaaaccaccagacagtgtcagatttattaaatgctctaggagtacaaaattaatgcagttctttgtctttgaaaggttcagtgtccacaagctggatttatcctaatggacaagcagtggaaagaacagtcgtcaattagctatctctttagccagactacacgttgtcggaatgcatgtagggtgagccaccagtgcacctaggcagacctccaatttgttcattttgactgtaagtgacttaatttaacattttttctaagaaatacattaggtagaatggtgaagtttcctttttttcatttttttcttaaaagaatcaccggtgaaaagccacagtaagtaggcttctcactccatttgttttcaatcaccacccttaatgcataaatttctgagtagcctgttactcttccaagccctaaactgtagcagtgaatgtggattggaaagttctggtgctgtatccactgggtctatgttgggtttgaacatgttttatatgcatagcatgattattcctgtgctagatgatcttacctgtggccctttgttttctgggttttttgtttgtttttttgtttgtttgtttgtttgttttagcaggaatgaattttgcattaccctcttatgagttacagtgtgcaaaatactttgaaagtaaagttttggttcccacatgaaccatttctcttttacacagcaatcatttatcacttataagtgttaatcacttattaacagtaatttcatctgctgaagaatttatcccctaatcatgtgattttgtttcttcatgtgtgtatgtgtatgcgtgtgtgtatatttacagcattgacattttgtattcaaaaatattaacttctcaccttggtattctggtagtgtaatgaaaacatctgttacttgtgtatggcaatgatgtttttacatctatttatatttgtgggtagattccaaattgattctatgtgaagatgcacttcaaacaaaattcagtaactacatgtctggctttgggtttttcaaactgtggggtttcaaccctgaacatgaagccctgatgcaggacttaatcctgaactctgcaaacgtttccttttgcacttcaacctccagtcccactttatataacatggaatattcttctggttattatgtaattcattatctaaaatatgttgtgagcagataagcacaaggactctgaatgtggcttgtatatttttacagcaactctgtgaatattctctttggtgcagagtggagatgtgtgtggaagcattcctcctgaattttttatagactctctccctttgccactctagttgctgtctcccacaaaatttgagtcatacctcaactgtacaaatcctcctttgatgttcagttgccctgaagtgtgcagttgtggaatatgtctaaatgtctcctgtgaagagattggaggcgttggttttaacaaaagcaataaaatgattacagctgaaaagcatgctggaggtaaacagacgtctgtccttgttgctgaaccattgctctgttaaaaaaaaaaataagcacatgatttagcctctctttgttgctcttgtgtctaggaaagtcaaaaggaaggaatttgatttttattgtccccaagatttcagtatagagtcagccctacagtatgagaaacaatatcttgcttatcgccctgaattaccattgtccaactgtgagagcatttgcaagaaggtgagagtgtttgtgaaatagacagaaagggaaatcatgtgcttggataaagctttttggtttctttagtgaagtttctgaattttcttctctaaccttggcacaaaggccaacactctacatgcagtaggcacttagtaaatttattttggtgatgggtgattggtctttagtaccatcaacatcccaacccagggctagccttggagaaggacacggagcaaggagaggtttaattggggaagccccactccacttcatccaaccttctaccaggacatcaaggtcctcatgatctgtagctttccctcctggcattacctcttgtccacaaagtattaattcacgtgcaatgaatggtgtctatggctacctagcactgtctgtacttcagcgaagagtaaagccttgaagtaaactgaggctgaatttctggcatcagcctggaggcaatgggtggtcactaggggcgcccccattaccctgaaaacctgtctgtgtgtctctcctccctagtccgtaatttcctttactaggcccaaccagtttctcctgaaaatattaatgagagcacttcaaaatgtaggttgttgaattttaaattaacctagagcatcacattgagtgggttttcatggttttctacattgtctgctggatggacttcctgggcagcaagcatatcttattcctaacgtcatagtctattcgcttttacccagagccgggcttcatttaacaataaggagatgttttcgattttaccgtatgtggaatgtaacatttgcatttggcagttctccctttagtcctgctcaagatttcagctacctcggcagagtgctagaaagcgatatgcttattagaaaactttattaatcagagtagagtgctatttggcagccagattctaatgaggatgaggagctaaatttaattcaaagctaaaggtcagcaaatggtgctagcctaccttttttaaagtgtgtgagcttggacgttctcacagtttccggacagtttcatctagaaatgtgcatgctatatttagtatgaaaaagcatggaaaagttttctaataacaccatttcagcacacatatattccatgagcattaataagccaagcacattactgcttggctagacaattcttataggagctgatggcactgagatgttatagcaattgccagccgaaaacaggaggccataagaacatgttacaatggaaagaatttcaaaaacttgtagacgtttctttaaacaatgaactgtctgtggaatatgtgtaaatggcagagtcactctcacaaagtcatgaaggatatatttgtggtgttcagcttatgtccctaggaaagaaaaataggaaaaagaaagttctccaggcagtagatgaaggtggtgttgagcggttttggcccttgcacatggcctccctatccttaaatggcaccatcatttcctcccttctccttcccacttctccttcattgcacactttcttattatcacctcccacaaaaactcatttattgaacacatcctaggtgagggccctgtgccaaagtctacagaagacacaagaatgattaaattcctcctatcacttagccactattgggggactagacaaagactcaaaatgtataaaacctatgaatgatcaccatgccacaaagcagaaggtaagggccataatgtaagtacaaagcactgagggaattccaatgtagaaaagactgctttcctccaggaagggttcatggaatagcctgtgcttaggaaaaaatgcacctgaattcatctatttttctccagcttcgtgaccattacctaggccagtctaccatcacccctcacctgcctttctgcaacaacctctattctgtcttccacagaaaagccagagatgtattctaaaacttttagttagatcatattacttcctggcttaaaatctcctaatgtccactcattttactcagagtcaaatccaaagatctgtccaagtcctgtaaagcccatatgatctcagttttgcctgtctgttcaacctcatcacttgccactttgttccatgagcattaagctccagccatatgcaatttttttttttttttttttttttttgagatggagtcttgctctgtcacccagcctggagtgcactggtgcaatctcagcccactgcaacctctgcctcccaggttcaagcgattctcctgcctcagcctcctgagtagctgggattataggtgccctccaccatgcccagctaattttttgtattttttagtagagatggggtttcaccatgttgaccaggtttttcatgaactcctggcctcagatgatccacccgcctcggcctcccagagtgctgggattataggcatgagccactgtgcccggctgtgtactttctttctcctgcattaattgattacactcattccctcattagggctttggctctagctgttttctccagaatactcttcatggagattcttctggatgattcctacttgtaattcagaccttagattaaaagaaagaggactttcttgactattcaatctaaagtagccacctagtcactgtcttctcatcatattgtattttaagtgactggtggcactgaccacggcttgatatttctcttcattggtttgtgtattgtttcatccccatcctcaccaccagtcaaatgtaaggcccatgtggttaaggaccttatatatcttgtattcctcctatatccccaggacctgtaacagttgattatgaatagtgggtgctcaataaatatttgcaaaatgattgtaagagtcttgaaggatttcacaggtagagagttgttccttagttcatgtggtaggccctgccactggtaaaacagcctgaacaggacctagtagctccgtgctctcaacaccttctgttcttgtggtggaaggcagacatggagaagtgagaattgatagataatgaagttgatacattcagggggtgatcattgctacaaaggaaacaagcaggctaaccaggtagagattgtcttgaagggtctacagataaaactgccagaggaggcacctctgacaagggagaatatgccttgagaacgtggaggcagagtgttttaggtggaagacccaccaatgacagactcctggggctgtgacaagcttaggctatcaaggaacaggggagagtgagaaagaatctctctgtgagcacaggagaagaataggtcagcaaggaggtggagagggaaacaggccagttcagtgacgggagggccatgtagaccctggggaatggtttgagaattaggctaaacgtgatgacaaggcagtggatgtttttaaacaattgatatgatcttaattatattgtttttaaaaggaggggcaagaattactggtggaagaggcagtgtggtcaaaggcatagagcagggtgtgggtgaaactgaggataagtttagggaacgatcagagcttcactggagactggactgcaagtggaaggaaagcaggaggctggggtggtgtcgacaatggaaagagagcaaagaggttattgtcacagggaattccatgagcagagttgcatctttggaaggctaatgtgggaatgtattagaatgaaggagtcaggagcggagagactagctgccatgctgctatgaaccgggctcgtggaagaaggaatgcaggggaggccacagtgctagaggctcatcattacaaccaactgaatgtaagatgcatgggagaaacgaagccaacaataatatcaaataatgtcatagtagagcccagtagtcattgtgcaccaggcactattctaattgctttaaataaaaactcactttgctcctcaaaactaccctacttggttttactctcattatccttatttcagagataaggaggttacacaactactctaagatagggagatggaaagtggcagaaccagaacccaagcaatctggctccagagcctgggctctaatgctgatcattattcccatctctaatgagcacagagaaacaattacgagtccagaaaataggagggaaagaagatttcaatggaaatgtgagaaggttgtttctggacaagttgagtgtaagacattggctcatttcaagttcaagtgtggagcaagggtgagcatggcttttggagctcccatgagatgttgcagctagagaggtgtgtcctcatgcaggcgggctctgttgaggacctgccccatgcgagccactccggggatcatatgttgaatagatggacaagtaaatatatgaaatgcgagggaataggataatcaaagtgctgggagtaaatagtatccccaagagtgaaaatatagacaaggagcctttagactccaaagtttagagaatccttttagagaatagctaaagagacagtgaaagaaacagacaattagattggagcagtaggaaggcaacaaagaagagagacttgccacaagggttgctctgccatatctagtccagcagaggttagggagagttttgctgggcagttttagcagtggtgaaggtacaaaccggattgtcatctgcccaaaagaaagggtggcagatggcaaaaggagacggcagaggattgttttttaaagtttagtgaaaggagaaggaaaagagagagacaggaggcaatagcttgaagggggagggggcggttaggggctactggacagtaatacatcacaaaggacccctagttgctccagagagagaaggaggaacaacatctttggggcctccccaggcgggggtggggggcattgtatatccacacctgtgctgacaagggcagtgggggcctgatttgcatagcagcaggataaaaaccagcctctggcaccactggattcttccctggtagaaactctcccagggtaggcacattagataagagctacttggattaattcggtgacaccatcttttagaatgagggtagaaagtactgacgtcaccatgcggctgattttagagaaacaatctatttctccactgacaaggatttgtggcagtcagcagctgttttatttctttttttttaaagctccctccacccctttcttcagacttctctggacttacatctgtcctcccagctgtgagcggctgaattccagggtgcaaaaccaagggagacaagtaggaggggcatacaaataatgattacatgctgcttcagtgtaaatctcggttcattgtgtgtccatgggcacatgccttcaaattcaagtgcatgcctctctctctgcctttcagtatctgtctgtaaaccttgatgggattaagcatatgttttaataaatattttgtttgctgtattcccattaatattcatagggaatggaacactttgggttttgtgatttctaataaacattgatggtgttgctagtctgtactgagcattcagtatgctccatcaaaatggcagctctaattaggttccttgaattagctaatggattttgagaaagatagcttagaaagctcttacagctgtccaagatattcctgccatggcagaaagacaaaaggcccctggaagctacagacttcagagctttagaaatgcagctgacagttaaaaagataaattacattcatattttgccagtgaaagtcctaatactgaattaatgttattcctgtagtgagtatccattaagcagctcattttattataaggatgcattttgaccattagctctttttctttcctcgctctccctcccctctctcctttttctccctccaattccctagatattttggacacggtattaaaaagcatctttgaagaagaggaaatgattccctttttttcaagttataaatttagaagctctcttagatatacaataggtattcagtttttttaaaaatgccaaagtaaatatataaagaaataacatagtgattcaatttaaaccttgaggcttatattttatgtagaattggaaggggggaagcttctagctagggggcagtgggcttgtttacacttggaaaagagattatttgttagaaactatctcgaataaaacatgttacctcctttcatcttaatatggaatgtacaacataacacaacgccattccacatgttcctcgcctgtacttcctaagaacacagtcctgtaacaaatgaggaactaatgacatctgagtgactacacttaatgctacaaatggggggaaaaataccacggacaatattaaaagttcatggcaaatagcagaattcgggaaacaaggacagtcacccaaaagctccttttattagttggatatgtcagtactcattaattctgtaactgtgttcagcataactttttgctttcagtttattcatttgtaaaactaatacctggtacctttcatctgaaaagttacattcctctaggaacacaacaaatcctctagggaaatgtttcctgggtcattaactctcaaatgtccaaattctgttttcctccgtgagcctctgtagcccctctgcttttccagtcctgcctgccttttggccttttttcttctcattagtgtctttaccaaacaaggggctgggcaaggaaaagaatgtgaaactcgtgtcaattaattggggtattatttacagctctgggaaagcacttgttgggaaagaagctaaagttgttggtttaaatgagatttttttcaaaatcatctgtagtttttatttttcatgctcttccaaacctcctgtttctgcagataattgagagctgactaaaagactgttgctaataaagctgttggaacgaagcaaggaatcagaaagcatagtgttgacggaacatatagattacagatcagacagctgctttacctcagtatgatataaataaaatggaaaagcattgttatgtgaagtgccagaaaaaaagatactcaattattccccacacatgacttcaccatgatgggtaaaaggcataattgacatcatgtttattgaaaaaactagcaactgtcacactgtcgagaggctactgagagctggaggaagggcatttttttattcgttttcactgtgggttatttatagagttcaattgtcagcagcagagtgcctaattttccttcttctttgatattcgacaactcattcactgttcagatcaagaagacagctgcaaattgctccatggcagatactcaggcattgccattacctcgcctgaatggggcaatggctatttattaattaagattctctgcctactttcccttaaagtgccagtgggaaaagtctttgtcaacccataatgggtctagtttcatttgttttgttttgttttgtttcattttaactttttgctgtctgatttggcagccagacccagattcctaatgggaaatttatcattatattgctgatgcatcgtgcttcatcaccagatgatgttactagtcaaacaagagctctggttatggaaaatgatcagttttcaaactgaaagaaagtttcaatgtcccatttcccccatctccagtggccctctggcacgttagccaacaagtagggagattgaaatagagaacttttgccaatgattttatcaaccatttagcctgcactgtatgcacacacaagaaatcatcaaatctaagtacaagaaaagctcagagaggtcagctagttccttccataggttgtgatatatggggttacagagagctagcgtctcccagagttctcttgatatgaagcagaactctgaggatggtggtgctggccctacttgcaattcttcagtgggtctgcatcatcccctttagaaagattggtggatggggctgttaaggtcctaccagctgtatttcccagtttctccacacattccccacacttgtgcggtgcctgactgtgtgccctttcatgtggccactccatttcaagtggtgttccttccagctggcatgcccagccaccctctctttatccttgtctcttctctaataggcctttcctgacctccccaagccaagttaacaccctctgctctgagctactgctggagttcatcatacttcatgatacttcctcttaataattgccacattgcactgtcattatttatttatatctgtgtctccccaactagactgtgaaatccctgagggtcaagtcggggtcttaatcacctttgcatccctaaggccacagcaatatttatgaataagtaaagcttaaataaatgtacacatcagaaatttttcagagggttattggagagcttttgaaagcacttgaggatttaggtctgctaccagtttattattttctattctgttttgaagagaaagccagcattcccctagcaaggatttataagaatctgagcatgttttaaaaacaactgaaacaatccataggagatggtaatgtcagctgtctgctattctgtacacccctaatgttggaaggtcagtagaaggccctagggttagcagagctcactttgcatctaggctaatgagagctgtgggatcttcttggattgaatgccctttgggagctaagtagatgctaacttttgatgcaatctgcatcagtccattctagcactaatatgaagaaatacctgaggctgggtaatgtataaacagaagaggtcgagttggctcacggttccacgggctgtacgggaaacatggcagcatctgcctctggggaggcctcagggagcttttacttagaggggaaggcaaaggggaagcaggcacatcttatgcgtctggagcaggaggaagagagtgggttgggtgggtgaaggtaggggaggaaaggcgctacacacttaaacaaccagatctcataataactcagtcactggcacaagaacagtaccaaggggatggtcctaaaccatgatccaatcacctcccaccaggccccacctccagcattggggattacgattcaacatgagatttgagtggggacacagagacaaaccgtaccacgagttgagaatctatttggattaattgttatgaccttattcaaaaatctcagagtagcatatggacgtaaaaggaatgaaaagaatgtaggtgatatcagaacatgttcataaattcttggacctagacctaattgctttatgctaatcatattagaatactgcgtatataattctgtgtttattacatagcacgatttaacaccatatgtgatcattaagattggcctcatggtcacttacctatgtgacccaagcatcccttctgggcatttggagaatgtatatcctttaacagtagaaaagtaaggactcgttcacttgtcacatatatttagaacactttgactcttaacaccgagggtcgagctcctaatcacaatctttagcttctttcaattgaaaaatgttttctccttttttaaaacactcttttcctttgtcactgttattattttcccaataccctccattggggaagaaaaacaaaagcattgttgtgtaagtaagaaactgctgtattaatctactgacgttttgttatatttttcacttttcactatgcactatcctgactgttctcttctaactgacataatcctctaaattaaaaaaaaatacaagctaccatccgtgcactaaattatttagagtgtccttatttttccttaaaattgtgtggtccattaaaacttactttcttattatctgtaaggaaaggttaggtacccagctgttgggaatcagtggcctttgatggtattccaggatctcttgggagaagagagaacttctatgttgtgtcctctgaggaagaaggaatgtcatggaggcctaggaaattcccaaggtttcatggcctgcagcccacaaaggcttatttttcccagaattgaccctgaaagtttaatccccatataaatgtcagatatgtattcttaaaactcaactgtgtttgatttaagcctaaaagataataattttatctttgcagttcctgcagttgttggtgagaatttctttgagaaggcgtgagtgtgtgcgtattagtgttatcattaatttgttcaagtaccatctaaacaacattttatttctccttaaactgtcttttgttcagttcaagaaggtgaacgataattaaaataatacaagttttgtaggtttcctctatttacctttttaatcaatattttgctaattttgttttggaccgtcgagtcctttgagaaaacctatagtattccaagtggagtcatgtcttaaacaaggttagtttctaaagtcattacatgagacaaaaattgtgtattgacaaaattaatcttgggaaacactttaggacagtggtccccaacctttttggcaccagggactggtttcctggaagacaatttttccacagggcggggggtgttgggggttggggaacacagggccaggcactagattctcataaggaccatgcaacctacatcccttgcatgcgtggttcaccatagggttcgtgctcctataagaatctaatgcagccactgatctgacaggaggcagagctcaggcagtaatgctcacctgtgtaagctcaccggtttctaataggccatggactggtaccagtttatggcctgggggttggtgacctctgctttaggaggatactatattggactctgcctatgatctctcactgaacccactcactgctgtttctttagcactgcattagatggctcttcccttggttgagcatcagctgaagtagttggcttgcatatacaaggccatgttgtacaagtaatatacatccttaaacgctgaaatgatgttcagcacagcataaaacttacattaggaaaggtgcctaggaactgacactgaccaaaggaaatcaactcagttcatgttcagggacatatgttcgttaaatggaatgtccaatggaatcactatcactacttaaattgctattctgcccccaagcctctgtttgtgtctaagctcagatatttggtgtatcaattaaatgcagctgggatgcagtatcactatactccagccatgttagaacagctatatctatatgaattataatatagactatggcttatttatcattttttaacagaagacacaatggatgcacagttgcaaattgatccaaatctatttttctttgcatgtatgtatgcttgttttgcaaagatgtagagtagaaagaaagggataatattgctgccatccagtgtgaacttttcaactatattttaaaatctttcttttttaagaaaccaaaattatcgtattaaacacttgataagtttcttctgtgacacccacatactgtatgttgttaataaaattgacaaaatgccttgagacaatatgtatcacacacttacacataactttgaagtgtccagtatttgtgtaaattacttaaggctcaaaaatattgcactgggggctgggtgcagtggcttacagtggctcacacctataatcccagtgctttaggaggccgagacaggaggatagcttgagctcaggagttcgaggttacaatcagctattatcacaccatgtactccagcctgggcaacagtataagactctgcctctaaatatacatatatatgtgtgtatatatatatacgtatatatatatacacacatatatatggcatatatatgtatatatatacatatatatacacacacacacatatatatggcactgtgttggaagaactgtattagaatactattcaaaatataaataactcaaatgggtattttatgactgatggcaaaactgacttctaaaatttgaacacagtcaggaggtcattgtacagtattagaataaggcagttatttgttactggcttattatggtgaactgaagccataaataataactggcatgttgttgaattttgagttacactgtcggggtcactcctaaggtatttctccctttgtgagaaatggagatacagaagcagaatgttctgattagaagccagccttgcattgccccaagtgataaagagcaaaggtagagcaatgccttttatcagaagaggagatgacattgatctggtgacgattctcagtcacaacaatcaatcacataggaggaagttgccttcgtgaatcaatggattactttcagtggtaaatggtagctgtggttcatggtgtgtgtgaaagagcttaccatttcaaaattgccaagggaagtgggcctttatttcttttttatatatatatactttaagttttagggtacatgtgcacaacgtgcaggttagttacatatgtatacatgtgccatgttcgtgtgctgcacccgttaactcgtcatttaacattaggtgtatctcctaatgctatccctccccactccccccaccccacaacaggccccagtgtgtgatgttccccttcctgtgtccatgtgttctcattgttcaattcccacctatgagcgagaacgtgcggtgtttagttttctgtcctggcaatagtttgctgagaattatggtttccagcttcatccatgtccctacaaaggacatgaattcatcattttttatggctgcatagtattctgtggtgtatatgtgccacattttcttaatccagtctatcattgttggacatttggcttggttccaagtctttgctattgtgaagtgctgtaataaacatacgtgtgcatgtgtctttatagcagcatgatttataatccttcaggtatatacccagtaatgggatggctgggtcaaatggtatttctagttctagatccctgaggaatcgccacactgacttccacaatgcttgaactagtttacagtcccaccaacagtataaaagtgttcctatttctccacatcctctccagcacctgttgtttcctgactttttagtgatcgccattctaactggtgtgagatggtatctcattgtggtttttgatttgcatttctctgatggccagtgatgatgaccattttttcatgtgtcttttggctgaataaatgtcttttgagaagtgtctgttcatatccttcgcccactttttgatggggttgtttttttcttgtaaatgtgttggagttcattgtagattctggatattagacctttgtcagatgagtagattgcaaaaatttcctcccattctgtaggttgcctgttcactctgatggtagtttcttttgctgtgcagaagctctttagtttaattagatcccatttgtcaatgttggcttttgttgccattgcttttggtgttttagacatgaagtccttgcccctgcctatgtcctgaatggtattgcctaggttttcttctagggtttctatggttttaagtcttaacatttaagtctttaatccatcttgaattaatttttgtataaggtgtaaggaagggatccagtttcagctttctccatatggctagccagttttcccagcaccatttattaaatagggaattgtttccccatttcttgtttttgtcaggtttgtgaaagatcagatggttgtagatatgcagcattatttctgagggttctgttctgttctattggtctatatctctgttttggtaccagtaccatactgttttgtttactgtagccttgtagcatagtttgaagtcaggtagtgtgatgcctccagctttgttctttttgcttaggattgacttggcaatgcgggctcttttttggttccggcctttgtttctttatgctccaccactatggcttgattcattgggtcaaggtccagcccagggttaagatttccaagacaagtcttcgagctataggagtcaaaggatcagtttaccaagctagggatggaaatactaagacaaggatctcaaaggaggcagatgctgaaagcaggacacatattgagaaagacaaaaggtcagcctcaggttgccatggtgaggtcgggagcccagataagccaagccaagttgtcagattgttgcatccaggtcaaaatgccacaggcagcatcaggatggctggggggaggaccgcagttcaggattatagtctgagctgatgtattattgtgattttcaggtttcctctaccttatgaccctaacttgcatgttaacctctctggaccagtttctcaggttgcccacaggatcctgacataaggatgagtaattttgttgaacccttgaaaattcatgcaaagacacacttttcaaagttttatgttagtgtagagcatagtttttcatcagattctgctgccgttttatgtgacattaaatactctcttaagatgctgaagcattgtttcctcacctactaagaggtatcatgtcagagataatggacagaagaagcccttagaaataaaagcagattttacatttggaaggtttgtgttgtctgtttaatattattcaccctttccctaaattcattattcttaacatagaatattataggcaattatagtaaacaaagaccccttaatttagagtagagtaattgttttaatcaacaagataacttaaatctggtagaaattaaatgtccatataagctaagacatagtcttgttatttggggggaatcttttggcaaaaataatttgaaatgggggctaccttcattaatagtgacagtaaatttgggaagaaattagaaagaagtatccccaaagttgtccatggatagtcagctatcagtcctaaaatttcaccgggctaaacagtgaaaaatcttatttgtcaatgcacctttgaaaaaaatagagatgctttataagaaatgggaaacggggaaaatagaggatttacacaatcataactttacctggatatttacactggataattttcagagctgttctagacttaaatgtcatttgaagaatgctatggaattaagttccttaaaaagcaattatttattattaaattagtatatatgggcacactatataaatgtattttcattatgagatgttaaatctggagagtatgagtgtaagtggtgttgggggtgtagtttctttaaatcttaaatgctcttcaattaagaatcctaaatgcatgtacaagagtctctcaaagttttatttgacagaaatctttattaccaactgaaaataaataatacttatgtccatgactatctgtcttcagctgaatattcttttccagaatcttttcttgggatttgagaaaaattagcaaaataagcgtgcatatagcctgtttaattatattatagttatgttattgagagtgtgaatgccatagaatctcaggtgttttagaagttctgttcccactatggaaaaaaaaatctgccctgttttctaagacagaactatggtactgttaagttttaagtttaaaaataaagctgggatgatttttagcttcttacatgccaaaagacaaaaacaaagaacactccccctgtggaagaagtcaggaaaataatagtatcttggcgttcttaaagggtaccaaggtgtttttctttattccatgtctttaaaccctttttgagaaaaccattgaaattccacccttttgtgagtatacaaaaattaacaccatacttacataattaacaatcttaaaggaagcatcaaaataacattttatagtaacttcataaaaaattaaagactctgtaaaacactaaactcaaaaacactccctatcctactcactgttgttgacacgcatacatccaatttaaagggttttattcagagagttcgtaaggattatcacctccagataggaatattcctgttaaagttacaggctataaaagccatttcttttcatttatgtatgtatttatttatttatttatttatttatttatttatttatttatttatttttgaggcagagtcttgctctgttgcccagcctggagtacagtggcatgatctcagctcactgcaacctctgcctcctgagttcaagtgattatcctgcctcagcctccctagtagctgggattacaggtgcatgccaccataccagctaatttttttttgtatttttagtagagatggggtttcaccatgttggccaggctagtctcgaactcctgacctcaggtgatctgcccacctcagcctcccaagtgctgggattacaggcgtgagccacctcacctgaccttataaagaccatttcttaactgcatcatcaaatctggacaccaggctggtacccacaaataagggcagtgctcaccaaaggccaacacctctccttccaaatgaagagctacatcttgaggctgtatgaaaacaacacgaaaacagaaacagctgtttgaaatcaactatatacaactgaatcctggttaggatgcatatatttacatagatgcccacttatacatatgtaatcacagataattcccaggtcccacagtggccagggtttggtggtagtgaccacctccctctcattcagttagtggtgaacttccccagcagttctgtctgcctctcaatcctggtcctgatccagaatgtgtctttcatgtaggatctttgtcatatgttgattctcctttgcaccccattccgttttataccagctctctacataagcctgttagagatataatattaattgcccagaaatctcagcctgcagtggctccaacatcattttttaatgaatacggacttcattgcatgtatttctattactttggttacttctatttttattgcaaagatctgtgcaaataaaagaatatcaaaaggtacggctataaatgtgctctgctaaattccctctgccttgaaatgcctgtgaaccgcagccacagaatgcctgctgcattttaatgcctttcttgcgaggcaacatgatatagtagaaacagcgctggttgggagtcacacaaatcctggcccaccattcaccagttgtgttccttaacgtctctgagcctcagtgtgctcgtgtgtaaaatgtcaacaacaatgtcatcttcacagatttgactgaggcttaaatgagatgaggtatgtaaagcacaaatgttgtctttaggacatcataggagcttgataaatgttaatttttttcagcctgcagcagtcataggaggagatgaaggcatgcacagatgaacactcattttaaaaagtactacagttgaggtcatttttaaggctagattccaaatgccttagtgtgatgtttatgacatgtgggaatttgttgctgtaggtggccatgaagaaaatgacatggtttctgaaatccattacaactttaagctctgtccagctctaaagtgttataagaaagggcctgtttaatgatacatctgcctttaaaggcataagcaatgtaatttatttttaaaatcattacaatatacatcatgttattatactgcttgaattaatttcacataaaattccagcacatcgaaagtgtaagactgtcattgatcacctatatagggatacagctgtaatagaaactttttgtaaggatggccagggctttacttcattcagtgaataaataattaggaaagcctaattgttaaactaacaatgtggagatgaggttattgacacttttactagttttatatggtttcaatagtatttgaattacatcatgatctgatgtcacttctgaagctatttctagaatcagtgctgctaaattccatgaagcaaggaatatagaacaaacgacatataaatagggaaggaaaatgggaatcctcagaaagtaaatcctgtaggctagccttcacttccattcttgttcagtatcttgctagaggacccagtctctaaaacataaaatgagatgaaggaagggaagtaggttggaaggcagtaagccatagtggaagagcagtctttgaaatgagaaaacacttgttaatcatctatttgctaggagcttcatattcttcatctttattgagcagaataataaatccatcagtattttttgaggttttaagatattgacagcacctgtcacacaggaattgtaaataaactcatgtacaattcctatagattagtagtggctttctgaggttctaggctaaaagaattctgagaattctttcccaattacagcattgagaaagaatgctctaattgattcgtgatgtctgctgtggacagagagtggagtaagtaaaagtatatatagatatatttgctatataagtgttcaataaattataaccattatgatgattgccactatcacaaaggtgtatgtccctctaaaatttgctaagtttctacatcttcagtgcaatatggaatcaattaattgctttggttataatagtggcgtatattatttttattaatttggtggtaagcatatgtgtattatctgctgagaagagctacaaatcagaaattggaatttgctgtccctaatcttaccaccttaaatacctatttaggaaaagtctgataccatttctaaaagtagaatgagggttgagaggaaaaaagaagagatgatattgagacatcgtcccaggttaccacaaaaggtttgcacagtgttccatatttttaaaaaatattcacacaagggagaagatacagcatgttttgcacttagatggtccatgactttctgggctgttttcctgttttttctcttgggccagatttcttttctgggtaaatagccatgctcctgtcagccacaggggactttctgaatcctgaacagctgattttgtattcctgccccattcccttatttgagaacagcaatctgatcaaacccatatttttaaatttatgcatttataggcatatggaagaatagtttacagtctcagtacaattttttttttccaccacaaatggaagaaaagtgtgttcttagaaaacagtgctttatcagtttcttttttttttttctttattactgatgacttcattctacttgaattcaaggcttcagtttctttggggtaaactaatagattatgtatgcgatgtttgcaccatgttgattgaactcatctggtgagtttgaacgcagctcatgaatttccgtaatcgacagaagcctgtgcgttggatacagacaccatggtcatctcgtattactcaagagctagggaagctgttgaaaatagactgtgctgcttttcctgcctgcccatggttcagaaaagcttatcaagacttttaatttgttcttactatctttttcaagtgctcaaagaaaactttttttaagtatagtaaagaaagagaattagaactattatgagagtttcaacatacatattgaaaaaaaaaaaaaaaagaaagaaaggtacgtgattcccaagggtttgtcttttctgaaccaaaggcatcagctgctgagtgtctgtcgagcacccaggaagcccagaaccctgtgcgaactgtcagggagcagccacaagacagaggtacatcatccagtttgcaattaacttaccatctagtttgagaagaatgcttttcctccaaaaggtgtttactcaccattttttttttttttttttttgtaatttacaaacacagttgtaaaatattttttaaaaatagatgacctctttctgttgcttttaggtacctcatattatcagatatctcatttaaacttggaacccaactgtaatatttggggttctttttgacatgcaaagctcttcacgctggggctctacctacctttccaagcctcacttgtccctcttctctttgatcctcctatatttctttaaaatactcacacaagagagaagatacagcatgttttacacttagttcatgactttctggacttttttcctgtgtttattccccaaatgctacagtagtgatcctcacatacccgtgaaacataagtgtcatgattgataagatgttatcaattgagttaaagtaccaaaatttgtaagtgatatgcttctgtcattattagagtaaattcaaaatacccccaaactatggctgggtgtaatggctcatgcctgtaatcctagcactttgggaggccaaggcaggcagatcacttgaggtcaggagtactagaccagcctggccaacatggtgaaacctcgtctctactaaacacacacacacacacacacacacacacaaagaatttgctgggcgtggtggcaggcgcctgtaatctcagctattttggatgctgagacaggagaatcgcttgaacgcaggaggcagaggttgcagtgagccaagatcgcaccactgcactctaccctgggtgacagagtaagactctgactaaaaaaaaaaaaaaaaaaacaggccaggcgtggtggctcacgcctgtaatcccagtactttgggaggccgaggcgagtggatcacctgaggtcaggagttcaagaccagccagatcaatgtggtgaaatcctgtctctactaaaaatacaaaaattagccaggtgtggtggtatgcacctgtagtcctagctactggagaggctgagacaggagaattgcttgaacctaggaggcagagggtgcagtgagccaagatagtgccatagcactccagcctgggctacagagcaagactccatctcaaaaaaaaaaaagaactttaaagtcaccagaactcacttttattcgaatttgctttgtaaatgagagtggaaagggaacatacaccatacacctggtatgtgtgtaaggcaggacaaaagaagttgaggaccagtgcttaaccaaagtgatcgacttgcatgtctctaaagcaagatgctttctcattgctttactttgcactcactgcccttccctctacctggaatatcctcctctcacttgtctagctgttgagcacctttgtatccttcagggctcagctgaagtgtcacctcctccatggagccttctgtgattttcttcaatggccctgctctcaccttgtcaaagtttaagcactctgcgttcccatgaccccatgcaaatctctgtaagagcacaagtcataatggactgtagtcttctgtatccctctctgtcccctacctcccagactatttgtttttgcaggtaaggactgtgaagtgttcctttttccattcccagattttaacgtctggtgcaatggggcactcagttatgcctcaaatgaaccagataagtagaatggctgttcagatctgcctgtcattcttttgctccctagccctgtataatatcatgtgatactggttccactaaaataactacaataacctaatctaagctacaagggaggtgctagctgagcagtttggggttgggcagatgagttactggaaaagctataattcataagaggaaatactggctaaagtacagagagaagaacttggattagcacgttctactctacaccagcttcccccaccttaaaaaaaaaaaaaaactttcttactgttttgttttgtttttttactgtcaccttttttacacgtgtcctaactgtacccatatattgacatgtatcccatccccaacccccactcccaaagttcatgagcctcatggaaatgaatgctaacatattccagccctgtctcatatccagccttcaggtcaaacaactggagctttgtcccaaattagcaatacttattgagaaaatgagatatccatattaaaatgtgacaaaactctgtgtgtgtgattataagaaaaaagtggtgggccttttaattgctctaaaaggtaaagactctatcttaccttctcattcaaaaggcatttattcatcccaagtcagacatttgacccttggaactaaaggtaggcacgtaaagaccactttttgttcatatttatgactgatttcaccattttcctggcatatttgaattacattattgaatcttccaaatttagatgtcaactcctttaacaagaagatccaaaagtgatttcaaagatgatgtacactgtgtgaatctgattatttgtctatatcctgtagtggccgtcctacgggtggaagcactgaccgtatccagaagttgcggaaagagtattatcaggctcggagggaaggtttccctttatatgaagacgacgaaggaagagcaaggccatctgagtatgacctactctgggtaagcgcatgcatgatttcaatcgttgaattcatcttttctaagaatgtttagagcagaagaacacggtcaagaatgttctgtacataccagattctatttaggtttcttgggcttcatagacaggaacattacccaaaccacaggcatattctcccacagaagctgtttatggaaatcaaacgccgtgaacgtgcagtagttcattctgattgctctcatacttcctgttatatgccaactggtttgggggaagcagaagttagctactttaaagagggcaagggatctttgtcaccatccactgagctttgattcttgcaacacaagccatctctcctttggaaaatggtgattagaagtaaatttcaaaagggttattgtcagagatgtcagttgtttgtttattggatctgagcacttcacattctgctgatcttaccggcatactaggatggatttgttttgagataagggcagtttttgtattagaggattctttttgctcaatcctttgacattcagggaacagaaaagaatacagtgaccactgaagaaaaactcattgggttttttcagagtggcacgattcactctcttgttttcaagaagcaagtctgtgcctacaagatgtacttaactcttcagcatctacaaaaatgcccaggaagaggatgcttagaattgcatgaaatgtgcatgcacatcagatacatagaacagtggctgacatagagctggtgctcagtaattgttagttcttgttactggcattattatcagagcagagctgaacatggtaatagcagtgtccttgctggggttcagttctcactcaccctctaatgatttctgccttctactgcgccttttagagctgctctgagaaccaggtaggggactctgttatccccggtgcccatgaaagacaccggctcctttgaaaggcagatctgttaaggcaggtttcctttcctgagtttcacactcaggtttatgctcataaggtcagagtggggagaatagagtctggcgactgagctgattccctctagttcttacatctgtgtggggggcctgtcatgcgttcatctctacactggggtgtgaaaatcagtttcaggatccaccactgttgggcagagcaaccggaactgctgagcccagaagattgcacctgtataatggagttccaaaacactaatcagaagtgcacagtgcagatgggcgatctcaaggccaagtggcttcagcctctttggagagaggcagcctgagactatggatcggaacaaacagctatttattggtcttattatagatgttaggattaaacagaatgacacctagagtgatgggaaaacttgtctcttagcttctctgtagcagaagagaaagatttccacagaataacagattagataacaattcactcagtttcaaacttgatcgagatcgatttactgcctctgacaagagatgtgagctacttgttaggtaaggctcagctccctcgataagccaaacaagcaataaaataaaggaaagtcatttccactgtacccaaaacagaacaccgtgtccagcgcattgaaaagtgctctatctcaaaacctctatgaattcctatgagcaaaataagacaaataattttagacaaagtagtcctggttgttttgaccttattttatatgatttccttacatcaagctgaaaggatgaaggtgcttaactttcaagagacttgaagtttcctctgaccctcaccaaacctgagctagataactatacccttgggtgctcccttttttaatgattctatttttatgccaagtaaacgtgtaaccagaccatctagtgagtaaagaagtatctctagtttaatttgtgtttcccatgctccggtgtgttgagctctgccaaaagtgactgattttatgtttcccagacaatcggggtctgaggcttcccaaagggatgcttgggaaatgcactgccgtaaaacacgagtgttctttgtgactgcctgagatactccaagccagggattagaatctcagcatcctttcctctcctctccccacgccaaggaaaaacactagtgttttgtattaaggcaggtttcctttcctgagtgtcttttgttcagcgtaggcctgagaaattacactgttgtcttgccacttttggagagatctaggaaagcaagttaagaaagttaacatttcattcctgtcaagcggccagacccaacaaggcagcttttatgagactgtggttcctagaaaggcaggtctttagcatcatcaccagggcactagctaaaatcagatcacagtcgcgtgaaggggaagaatgggcccaggagagaccctcaagggatgcgccacgtggtcatcaaggattctgatccacaattctgaaaataggacattgacttcaatcccttgagtaaacacgaaagcggtccaacttctctagcaaaaccactgtggaccagcatcatcagaaatattgttatgaacttagaactcccccaagtccagagtctctggttgaaaggcccgatgagtgttttctggagtcattctatactggggaacttctgaactatggagaaggaaattacaaagataagttacctaacaactactcgtaaacccatttcaaaataggctagcaagaatgaaagtatgctcactgaagtcttcaaagccaaaataatgagaataatcacttgaaagtttattagggtctatgaatattttaaaatatatatataaatatatatgactaatactttttctttggctggccctggactttctagatcttctcagaccaacttgtatgtagttctctaccactattgcacctgcccagtggcctgaagtctaagctttctcttactcctccctagggttctcacttggtttcatgcctgtcttctctcccctctcccttatcccctcccctctcccctctcccctctcccctctctcttctctcttccctcttccctcttcccctctcccctttttcctcccttctcctctcccctgactcctattacattttaacaaatatttgctaaatcttagtgtagaccaggtgctgataacaagaatatgacattacttccaccttggaggaactcaggatccagccaggaatagatctaagcccaaacaaaatggaacaataatatatgtgataaatgctgtagtatagagaggtattagcttctatatgtactgagagagagtagttcattctgctggaggtgcatagttggagacagagtgctaggaaaactatagagacattttgggagttgcctcagctgacatactttgttctttttttttttcatactttgttcttttattctcaaatttgttggatttttttccccttttgcaaaagatctcctgatttattcgctttgttttaaaataaatgaatacttctgagggctctgttctgttccattggtctatatctctgttttggtaccagtaccatgctgttttggttactgtagccttgtagtatagtttgaagtcaggtagcatgatgcctccagctttgttcttttgtcttaggattgacttggcaatgcgggctcttttttggttccatatgaactttaaagtagtttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcacatctcttgtaagttggattcctaggtattttattctctttgaagcaattgtgaatgggagttcactcatgatttggctctctgtttgtctgttattggtgtataagaatgcttgtgatttttgcacattgattttatatcctgagactttgctgaagttgcctatcagcttaagaagattttgggctgaaacgatgccacatatctacaaccatctgatctttcacaaacctaacaaaaacaagaaatggggaaataattccctatttaataaatggtgctgggaaaactggccagccatatggagaaggctgaaaatggatcccttccttacaccttatacaaaaattaattcaagatggattaaagacttaaatgttagtcctaaaaccataaaaaccctagaagaaaacctaggcaataccattcaggacataggcaggggcaaggacttcatgtctaaaacaccaaaagcaatggcaacaaaagccaacattgacaaatgggatctaattaaactaaagagcttctgcacagcaaaagaaactaccatcagagtgaacaggcaacctacagaatgggagaaaatttttgcaatctactcatctgacaaagagctaatatccagaatctacaatgaactccaacacatttacaagaaaaaaacaaccccatcaaaaagtgggtgaaggatatgaacagacacttctcaaaagaagacatttatgcagccaaaagacacatgaaaaaatggtcatcatcacttgccatcagagaaatgccaatcaaaaccacaatgagatgccatctcacaccagttagaatggcgatcattaaaaagtcaggaaacaacaggtgctggaaaggatgtggagaaataggaacacttttacactgttggtgggactgtaaaccagttcaagcattgtggaagtcagtgtggcgattcctcagggatctagaactagaaataccatttgacccagccatcccattactgggtatatacccaaaggattataaatcatgctgctataaagacacatgcacgcgtatgtttattgtggcactattcacaatagcaaagacttggaaccaagccaaatgtccaacaatgatagactggattaagaaaatgtggcacatatacaccatggaaaactatgcagccataaaaaatgatgagttcatgtcgtttgtagggacatggatgaagctggaaaccatcattctcagcaaactatcgcaaggacagaaaaccaaacaccgcatgttctcacccgtaggtgggaattgaacaatgagaacacatggacacaggaaggggaacatgacacactggggcctgttgtggggtggggggagtggggagggatagcattaggagatatacctaatgttaaatgacgagttgctgggtgcagcacacgaacatggcacatgtatacatatgtaacaaacctgcacgctgtgcacgtgtaccctaaaacttaaataataaaaaaataaaataaaataaaataaatgaatacacacacactgtaaggtttgtaaatatggacttgagaccttaaaatcttttcagctgttctgttgtgtaactgttttcccgtcttagctctgaaaagctgtaaagaacaagttgaaagaacttcagtggctgcaagtaaaacagtctggtgagtttttataggcccaattaagtaagcaagatatactagctgtgaagtgttaatatttgccagaggaaaacataatacctgttatctgctggtattttattttttgtaaaacttaagatagtcctctgacaacgggctgcttttttcttagcagataaagctgatctgcttatttaacagcagcatgaatatcctgtaaataattttagcaatgagatgcctctgaagttttctaaaaatattagtgcctttattattgtctttttcaagagctgaatagcagtatcattatccccccgcccaacctttttaaaaaaaaattctttggctaaattagaagaaagtttatttataaaagaggtttgtagacacatggttgggaagggagtacatttgtttatatatggaaaaaaaagtgggagttaaaacatcttaaactagcatgatatacctgttaccactgtcattaaaaacatggtgctggccgggcacagtggctcacgcctgtaaccccagcactttgggaggctgaggaaggtggatcatgaggtcaagagattgagactaacctggccaacatggtgaaaccctgtctttactaaaaatacaaaaattagctgggcatggtggtgcacacctgtagtcccagctacttgggaggctgaggcaggaaaatcacttgaacccgggaggcggaagttgcagtgagctgagatcgcaccactgccctctagcctggtgacagagtgagactctgtctcaaaaaaaacaaaaacaaaaacaaaaattgtgctatatctctctggcacaggggttggctcaggtagatcatagttggaacaatgagatggttgggtgaataaatgtaaacatctgaaagatttgttcattctgttgtgaagatggtctagaagccaacttgaagaaacgtacttggccgctgatctggatgacaagagacaaatctggtgaattccacacttggaggaaagagaaaacacaatgctgagatcatgctaaccatcttaaggaaaggatttaagatggaatgtgcaatagccaaagaagtataaaagccatcagaaggtttttcataaacaccaggagaaaagaggacaagtgccatcaatggtccaataccagagtggagatttctatgtattttccttgtctcctccttaaaagcatctgataaaaactaagtacattgatgaacaattctggtttaggcaatagctcttatattccaaagaacagagacctaaatcaaactgacctgattcataaaggaaattttgttgacttatttaaaagaagtccataaccatatcttgacttcaggcaaagctggatccaactcctccagacaggccattaggagtctcttttttcatctgtcagctttgctattctctctgcaggcaccattctcaaggggctacctgaggtagaaagacagccatctgcagctctaacacaacaactctgaaggaggagatagtctctctgtagatcaggaaacatcctggagtggatgttcagcacaattctcagtagcgctgattgattcagcctggatcacgtgtccacttctgaaccaaccttcatggccagacaggtgcagtattttttttttttttttttttttttttttttttttttgagacagagtcttgctctgtcacgcaggctggagtgcagtggcacgatctctgctcactgcaagctccacctccggggttcacggcattctcctgcctcagcctcccaagtaactgggactacaggcacccaccaccacgcccggctaattttttgtatttttagtagagacggggtttcaccgtgttagccagaatggtctcgatctcctgacctcgtgatctgcctgcctcggcctcccaaagtgctgggattacaggcttgagccaccgcacccggccacaatattcttatagactaaaactaggccacaagaccacccctggaactagacagtgaagtcaagtccacccagactccataaataaggataggtgaagagagagtcctcaaaggaaaatcaaggtgctgttaacagggaaagagaatgtagatggtaggcacaattacaaactgtctacgacaacttcgagttctaataatgatataaactttcttcatcttcttagatttccagggaaagagaaagaaaagccttccctttgtgtattctcctgtttatcgttagaaagaatagatctattatcaaacttaaatttgctgccattatttgttatgtaaaaggagaaagaaaattcactttgtctattggttcagcatctttgaactatcccaggaacccagatgatgtcactgaattattcatgagaaattatcagacctctggaatttatttatataggcaaatgacattttagttcacctcggacctagcaattcaccccagaacgatctgagtacagattgtctcagcaatactctggggacaaatctgatccataaaggttgtagggatagtgaaagaggagggaacaattcaccccaggagaagcagtagaattatttgaaaggactaaagttgctctctttctttacatagagttgctctgtttatatcttcatggattattgtcttgtgacaagcacatagtctgttcttaaaacctttagaaggtgagatggggtaaagaattagagccattaaatgtttgtatccaggccaggaggggtggcccatgcttgtaatttcagcactttgggaggccgagatgagaggatcacttgagcccaagagttggagaccagcctgggcaacatagtcaaacctttctctatgaaaaataccaaaattatgggggtgtggtggcatgcatctgtggtcccagctacatgagaggctgagacaggaggactgcttgagtccaggaggtcaaggctgcagagagccataatcatgccactgcattccagctcgggcaacagagcaagaccctttctccaagaaaaaaaaaaaaaaaaaagtatgtgtccatagactcctgcagttgggctgctgccacacgatgggcaatcccttctcagttgatgaaccttcttgagctctatcccaatggttccctcccagtggctgactttatcaacacatcttttgatttccaaaaacagtggaactgaggattggaagcaataccaaggcagagaaaaaaagagagaaaaaaccatgtctatacattgcgtgggttttagaaaggcctgaagttttattgaacttgatactggtgaaacatcaatgccactggaagagttgagattttgctcacttagatttcagcaagtagtaaaacaaaaagaaaaaaaattgagaaaagaagaggacaaaataaactgaatttttttttttttttggttagtggctttggcccttttatatttcagtgtgtctttcacaggaatttgttgacatataagctatatgggagaagatctggactatacaacatgtgagtgaatttctagcctttaaatatagcataaatcatttttgaaaggaagcaacatgtttacaggcagtccccaacatagaaataaactgttccagaagtccatttagaagctggcaatttagaactaggaattgatttttcccatagggaaaaaatatatatatattgtttgttaggatcccaaaccagcctacaaaaacccactaaaatccagtaaccttgtgctaatcccagaacaataaccttgaagcagaaacagggagctatctaaccccctcccttcttttctggacacatttttttgggatactctctgggcccttcccatctaccggtctttaagtctgttgctccagattccctgaccattaattcccctacctccgcatcatggcaccccacttaagcccactcctcccctaaagcattcaggcattcagttacttctctgccctgtccctcaacagagttaccattctcagtacagatagtctcagcaatactctgggggacaaatctgatccataaaggttgtagggatagtgaaggaggagggaacaggagaggggctaatggaatgtactcccaaacagtagtgttagagctattcctgatgctctgttgctactacactagcctctggattctccagcgcttctgtttccacgtatggagcccaagcttacacagagctccctgtctgacactgcctgtgggcagtgacctgatcccaagagtggatccgatttctccagcaaactggccctttctccaaaggaagccttttgtttctgggtctgccctctgtggcccaagggccagtcgctacaactaacatgggccaggatgcctcagctctgcttaaaaatctgccctgataagatagctcttctaaactactcctgtccactcatcctgtcttttgaaacacacagatgtccagagttttagaactagtaatttagcagatatgggaagcattttagcacaggagactctgaagctaggctgcctgagttcacatccaggctgtacccattactcactaggtaaatttgggcaatttattttacctgtctcctttaaaagtgagagaatagtactgtctccttgaagtactatgacacacacatgattacatgtaaagtacttagaatagtgtctaaacatgtaggaagtgtcaataaacaagaatttttaaatggtacacatatcaagttttgaaataacacattcaattggccagacaacccttctatcttagttattattggagctccttagcctcttcggttattccagagcccttggacattatatagcacacaaagccttgagggtggccttcacatcctgctccctctggttaccactgagatgcccagggtcacttcaggtggtaactgtcaagcttggtcatcaggcacttttagcaaattccattggtccaaaggtcaatatctatttccctctctcccacacacatacttttccttcaaaagtacattcctttcatccctgaccctgggggcacacctaatctctttaatgagcttatgctaaaatcaaagaccagaagaaagttgacttctagcagcttctgcctgcagctctgcaaaaaaccctgaagcaaagaaataccagggtccagttaagcgcttaaaataggagggtgagatacaaagagaatatatacaaattatttactcaataaattatactacaaccagatcgttaataaaaatggcatcatttactcagtgctgactctgccttatataagctattccatatactagctctgtgaggtagatatctttaatccagttttatagatgagaaaacaaaggttccaagaccttgcctcatggccacacaatcattagcaaagctgatttccaaatctctactgactcccggtgaaaagagaaaggaaagctcctatggctggtgttgagatacttcttaatataagatgtttgaaagaaagaaaatgtgtgaatattcatctataagcactatgaaaactgtcttctatctttgttgaactactcttgaattatcactcctcttaatttgtttttgaacccaataatattgaaccaaaatcaaagtgtggtgttgttttatcagtcctctttcaaagtctaaatgaaatcattctttttatgctgtaatcaaataagttacccatctctggctcaaacccaaacctaaatagcaaagagcagaaaaaggaagttcaggaacacatgatttttccatagtatgtcaaaaaaccctatgctatacttccattagagtgaaaaaaagaactctttctgcttttaatgagcaattaattccagtccaggatgtcgagtttagaataggttaacttcccccaaaccacagccgtttgtgttggatcatggttaaaaccccaaattccaacttctacaataataacattcttttcttctactgcaatgggagaaatgaccattttatgtaacataagaaaacctatagcagaaacccctatgaattccagatttcttaaactgttctcaaagctgtttaaaatcagttgggtacattttattttagcagtgcttaaatgttctaaaataaactttgggtactaaattaaaaagtgaagatgtctggagtcgaagatatgaatatctatctaactggtatttatagcacatgtatcacttaaatttgacaacaattaaaactccacataagccatgtttgtgttcagatcctgtggcctgggatgtcccctcacacagcttcctgactataaccaaccaatcaggtcactacagcggccatcttgttctttcagtttaaggaaatttttgactgagagtcgttctgagatttaacatcatttggttcttattaagtagtaactagtctggtgttgtgatgggaaaaagaaaattcacagaaagcttacctctgaaaggaagacagaaagcacacttgaatcaaagaaaaccctaaaatgagaatgatcactacggtaatattggaattgccattctccacaagaaaaatgaccacttttgaatacgattgtaacgacacatactaacgtctatgactttccagccctcctgtgaatctcattaatgtctttgtatttcattctgagccttgaaatcacagtgctaaattttcggagtgtttatgaaagagtgcaaaagttgataccactgaattttagcgaggctaacaggaaaacttcccatttactttagtaaatgatctaagaagaaagaatataatgttgctgttataaaccactgagaaatagtctcttttctactttccagataaggcttctgtgaagcagtggagtatttagattttatctccatgaagcttccttcaaatgatcattccgtgtcatctctcactcacagacatagctccattccctaagcagcaaagtcaaagttgcacatgagagaaacgtattttctgcaattttccattccttcgttggtttttttcattcagtgaatactcagcaatttatgaatgcctaggaaaatgtacatcgagcctgacagttgtatcatcaacacttacctacaaggaaagaaaacttgtttggtgtatgtgtgtatctttaagcctgtgtgtgtgcataaagttgtgtgatttgaagtttctcctttacagaaacagaaggaaatgttgtatgagaaagacaatccccatcatgacctggtgtcttttctttaatgaaccttctggcccactctatagtattagatacccccaaaccatgtggagacacctccttttttctcttttgttttcccatgatcactaattggcagagccacagcttgtttctcagtagcaaatttattttaaagtttttatatctatcatctactttttttccttctttttttttttttagtatgaaccaagtttcctgttttctatgcaattccctttgcagtaatttcccagatttcaattgccaggcgtgcttcagcagcaatgtacaatatgtgtatgtggttataagggaatcagagactctcatttcagaggaggaaatcgtgctctcacaattaatgtgaatgatagcaggaagcaatctttaaagtagtacttgaattgatgatcagaaaaaaacaaaacagaacaaatcgctatgggctttaggaggttgtggctttcgtgtggttccagaactatgttgccttttcccaatttaagaaaatggatagctttctcctttctatgtatggatatatatatataaggttaaaaaatctaatccctaaatacatgatgatgcggggaacagatgacaggcaaacaggaaagaactgacattttttatcaagcattcaaattttcccctttgttggttcataagaaaatttgagtaccttcccatttagaaacttaagagtttcctagctttcttaaagattttatctgcaaaataagaagaaaacctgttaatatcctatcatcaattaaggaaaagaatagtcattttcacgtatgttctgtcactttggccccaggattggagaacagaatttcaaaatgtgtggttccttagtcatgcattcatttattaattaatgtggtagacctttactcagtggcaaccttttgccagacatttacttgactctgaggaatcgaaagtgaataaggggttcatgtctgctgggaaaggcagacaggaaacataatttcaaatataatgagatatttaggagtagttatgcaggaataaattgataagcgaatgcataggaaagagagactaaccaagaattaacgagatagatttgcttttatccctgtgaagttttcccttgtgtgttcagtcttcccttttgtctgcatttagggctgtctgtccgcctccaaagtaagctactaaatctaaacaattgccctttgtaatttcaaaacaaatgtaaagtggcttttatcatatgtttcatgatgatacttttctttatgcccaacctctccttttgaggatctgagcatttctgcatcacactgtcccaattaccaaccaagatcagcccgagagagtagattttctaacaactgtgtgtcacaacttattagatgataataccatcaattagttggtcactcttatcatttctaaatgattttgcataggatatatcaaagggcatagcaggtagtcaaggtgggtattggtacagtttttgtttcacatccaatgcaggaacacacacacttacgtttggtcatgatgtaaattataagtcttcctatgagttatgattttaggaggctgaaaaactctggtttagaatttaagtttcatatctgcttatttactgtttcacttataagaacccacatggtgctatttcacattaggaactaaaaaagacatttttaaataaacattattaataaatcttatctgaaacacataatgaatggcacatagtttgcttttcttgtttatatctacatatcaatacagatagatacatatggatagaaatataaagatagatacagacacaatttgcatatatttaaatgaattttagtttaatagtcaatgatttatgaaactcttaaataaacatattgcaagaagttacaactacagccagaaatatgtggatatacttggcatactccaggctttctttattctcctgaaaattacttcttttattttatatttaacaagtttttatgtttttattatttttcttacagttctttttttttttttttactttaaggtttgagggtacatgcgaaggtttgttacataggtaaactcatgtcacgggggtttgttggacagattatttcatcacccaggagttaagcccagtacccaacagttaccttttctgctcctctccctcccccgaccttccaccctcaaatagaccccagtgtctgttgtttctttctttgttttcctaagtgctcatcatttagctcccacttttaagtgagaacatacagtacttggttttctgttcctgcattagtttgttgagggtaatggcctccagctccatccatgtttgtttgcacaaaagacatgatctcattcttttttacggctgcatagtattccatgctgtatatgtgccacgttatctttatccaatctgttattggtggagatttaggttgattccatgtctttactattgtgaatagtgctgcaataaacatttgcgtgcatgtgtctttatggtagaatgatttctattcctttgggtatatacccagtaatgagattgttgtttgaaatggtggttctgcttttagcttcttgagaaatcaccatactgctttccacaatggttgaactaatttacactctcaccaacagtgtatgagtgttcccttttctccacaactttgccagcatctattacttttttattttttaataatagccattctgatgggtgtgagatggtatcgcgatattgagttttttttaatgtgcttgttggctgcatgtatgtctttttttgaaaagtatctattcatgtcctttttaatggggttgtttttctcttgtaaatttaagtaagttccttatagatgctggatattaaacatttgtcagatgcatagtttgcaaatattttctcccattctgtaggttgtatgtttactctgttgatagcttcttttgctgtgcagaagctcttaagtttatttagatctcatttgtcaatttttgctttcgttgtgattgcttttgctgtctttgtcatgaaacctttgactgttcctatgtccaggatggtattgcctgggttgtcctccagggtttttgtagttttgggttttacatttaagtctttaatccattttgagttgatgatttttgtatataaggaaggggtctggcttcagtcttctgcatatggctagctagttatcccagcaccatttattgaagagggagtcttttctccattgctcgtttttgtcagctttatgaaagatcaggtggtcataggtgtgcacccttatttctgggctctctcttctgttccattggtctgtgtgcctggttttgtaccagtaccatgctgttttggttaccatggccctgtagtatagtttgaagttaggtaacatgatacctcctgctttgttatttttgcttatgattgcctttgctatttggtctctttttggttccatatgaatggtaaaatggatctgtaaattccatatggatctgtaaattgctttggccagtatggccattttaatgatactgattcttcctattcatgagcatggaatgtttttccatttgtttgtgtcatctctgattcctttgtaattgtaattgtaatctgttttgtaattctcattgtagagatctttcacctccctggttagctgtatttctaggtattttattcttttggtggcagttgtgaatgggattgcctttctgatttggctctcatcttagctgttgttggcataaaggaatgctagtgatttttgtaccctgattttgtatcctgaaactttgctgcagtttatcagctgaaggagcttttgggttgagactatagggttctctaggtataaaatcatatcgtctgcaaacagagatagtttgacttcctctctatttggatgccctttctttctttcttttgcttgattgctctggctgggacttccaatactctgttgatcaggagtggtgagagagagcattcttgtcttgtgacagatttcaagagaaatgcttccagtttttgcccatttagtataatattggttgtatgtttgtcatagatggctcttattattttgaggtatattccttcagtacctagtttattgagagtttttaacatgaaggggtactgaattttatcataaaccttttctgcgtctattgagataatcatgtggtttttgtctttagttctgtttatgtgatgaatcacatttattgattttcatacgtcgaatcaaccttgcatctcaaggatgaagcctacttgataatgatggataagctttttgatgtgctgctgggttctgtttgcaagtattttgttgaggatttttgcatcagtgttcatcaaggatattggctttaagctttgttgttgttgtgtctctgcctagttttagtatcagaatgatgccagcctcatagaatgaggtggggaggagtttctcttgagagggtatatgtgtccaggaatctacccatctcttctaggttttctagtttgtgtacatagaggtgttcatagtagcttctgatggttatttttatttctgtggggtcagtgctaatattaccttcatcatttgtaattgtgtttatttggatcttctcctttttcttctttattagtctagctaccagcctatctatcttactaatttttttcaaaaaaacaacttctggaatcattgatcttgtgactggtttttcatgtctcaatttccttcatgtcagctctgatttttgttatttcttatcttctgctagctttggggttgattcgttcttgcttctctgattctttcagttgtgatgtttgttagtttgttaatttgagatctttctgacttttggatgtgagcagttattgctgtgaatttcccttttaacactgccttagctgtgttccagagattctggtatgttgtgttttgttctcattagttttaaagaactttttgatttctgccttaacttcattatttgccaagaagtcactcaggagcatgttgtttaatatccatctaattgcaagtttttgagtgatgtcttagtcttgagttgtatttttattgcgctgtggtctgagagtgtgtttgttatgattttggttgttttgcatttgctgaggattgattcatatcccattatgtggacagttttacagtatgtgccatgtggtgatgagatgaatgtatattctgttgtttttgggtggagagttgtatagagccctgtcagttccatttggtccagtgttgagttcaggtcctgaatatctttgtaaattttctgcctcgatgatctaataatgtcagtggagtgtaggagtctcctactattattgtgtgggagtctatgtgtctttgtaggtctctaagaacttgctttatgaatctggctgctactgtactgggtttatatatatttaggatagttaggccttgttgaattgaaccctttaccattatgtaatgcccgtctttatcttatctttttgatctttgttggtttgaagtctgttttgtgttaaattaggattgcagcctctactgttttctgttttctatttgcttggtagattttcctctgtccctttattttgagcctacaggtgtcatttcatgtgaaatgggtctcttgaagacagctgtcattcggtcttacttttttatacagcttaccattctgtgcctttttaagtgaggcatttagcctgtttacattcaaggttaatattgatatgtgtggatttgatcctgtcatcatgttttagctggttattatgttggcttgtttgtggggttgctttatagtgacactggtctgtatgtttaagtgtgtttttgtgttagctggtagcagtcttccctttctatatttaaagcttctttcaagatttcttgtaaggcaggtctggtcgtagtgaattccctcaacgtttgcttatctgaaaaggatcttatttctcctttgcttaggaaccttagtttagtttagctggatataaaattcttggttgaagatttttttctttcagacacttgaatataggctgccaaactcttctggcttgtaggatttcagccgagaggtctgccattagcctcgatggtgttccctttgtgggtgacctgtcctttctctctagctgcttttaacattctttctttcatttcaaccttggaaaatctgatgattgtgtgtcttggggatgattttcttatgtagaatcttgcaggagttatctgtatttcctgagtttgaccgttggcctgtctagcaaggttggggaagttttcatggacaatatcctgaaatacgttttccaagttgtttgctttctccccctccctttcagggataactgatttggtctcttttcataatcccatactttccagaggttttgttcattttttaaattgttttttctctacttttgtctgactgtcttatttcaagaatcagtcttcaagctctgagattctttcctgatctttgtttattctgctgttaatacttgtgattgcattgtgaaattcttgtattgtgttattcagctctgtcagacccattatgttctttttttggactggctatttcatccttcagctcctctatcactttgttgtgattcttacattccttgaattgggtattgccatcctactgaatctcgatgatcttcattcctatccatattctgaattctatttgtgtcattctagccaattcaacctggttaagaactcttgttagagagctgatgaggttgtttggaggacatatggtactctggccatttgagttactggagttcttttgttgcttctttcttatctttacatgtgggtgttccatttactgcagtgtagattgagtacagtcagtagacttcttttctggatgttttcactggactaaggctttgtgcagggtctttatttgaagctgacttcttatctctggtttcagaggtgggtatgttagcagggcatttttggtgttgaagctttggggtgtgatccagtaggtggcacttaggcttattagtcagttggtagactcttgcttggttttgtggcttcccctgtgtttcctcatcattgcagctatgttccctctcaatgctctgaaagtttgggttctctcccctttcagtgctggctgtagataatggcttggcactcctggactgcccactgctgctctggagagatctcagtgtttttgttcctcccctaacttagaggcaaaaaaggaagggaccttagtagtgattgtggccaagggtcttttgtttgtttgtgtcccgaagcctctgctccagagagatgcaggtcagtaatccctcagtgcaatcagcccaggatggggagggtctgtgctgcaagcccaagccagggattccttgtctggtgataagtagtggtggatatgtgggaaacatgggagatggactgtcctcctctccttgggtcgactacagcttgttggaggtgtgataaagcacttgggttctttgctccttcatcagtctaagggtagcaagggtggttccactgcagaggcagtggcagagaggctttcagttgctcctggaggctctctgtccagggagttgccgagttgctactggctcaatagctcgggccgggggtggctggaggcttaggcctggaagacaacaagtttttatcataaattaatacatgctctaaaatgcttaggtaattggtaaaagtgttaaaatgaaaatgtaaattattcattatctgaccacccaagaaatgaacactgtttatgctttggagtattttctttctatacacacacacacacatatgcataacatgtagtaattaaattgggaaccttctgaatatactatatttaagtcatatttttttactttgttatattttgaaaatttctcatgacattaaacaatcttcaaaactgtgaatttaatgtttaatgcatagtattttctagaaaggatattaagtaattggttaatcactttaccattattggacgtttaagttgtattcattgtttcttatcataagtaatgaaatagcaattagccttacaaataagcatttgtattattagttctttatcataaatcaatataagatactaattatctagtatgaggcgatgaaatttatttaaaatttggcacatattactcatctttcctatgaaagttgttaagtttatattcttgccagcagcatattcattaatacactgaacaaatactaatggtctgttttatacagcttttagagcaaccctattaaaattgagtgtttgtatttttcctagtattaccaatttgatggcaaatatcaattatgttgttttcatttcttaattacaactgagaataaacatttcataggtttattggccatgtatatttcttctttttatgaattttttattttttctattacaatgtttgcctctgtcactcctaacttgttaaagttcttgatgtggaaagaatattaagcctttactgtcaaatttcattcagggttttttttctaacttcgtcaatagactctttaactttgtgataccttagagcttaaggacttttatttttgtgtaaacaaacctgggatattgactagttttttcacataccatttaaacatctatcaagatgattatatgattttttttctttttctattaatgtgagagttcatatgaatagactctaatgttgaatagcccttgcagttctgaaaaaataagtctacacttacatgctgtctgttttgtcctttagagagacctgggcatggattgctaatatttcatttgtgattttgtatcttatttgtaagtgaaattgataagtacgtttgtttttttgtttgtttgtttctaactttagctgttttatacagaagggttacattacctttgccaaatgatctggctagcttttcatctgtttctatgctttgtaacaatgtctataatgtaggaattatctctttgtaaagattttaaataactcatccataaaaatatctaacttgatcctctttcctgggtaattctttgacacctttttcagcttttctgatagatacagatatttggaaaaggagattatttttttcctttactgaattttggaaatctgccttttctgtaaaattatatctctttgagatttttaagtttttagtgtattttatctttaccaaataatatatttaataattattttttgttttcatttatttttacttcattatttttacatttatttttacttaattattgtttccttaaaaacaaatgaaacctattttttgaattattcagctatttaattttgcttttgaacttagtttaggtatacttctggaagtgataataagctaatgttctttttttttctaagtattctaaaatattaaagactttatttttcctttgatcaagaatgatttatatgatctttaaatcaaggaattaggttttttatttaagtttttattattaatgtatggttttaagctctgtagtcaaggacagcgacgtctcccatttttgcctggtggcatttattaaaagttggcataatatatggtaactattgtcgttaaaaaaaattaaattaattaaaatcaaaataatgatttttctgtaaatatgtattctctaataaatacttactgagttcctatagtattataattccaggcaccatgaaggtgctggaggatagcaaagagcacaacagacaaaaatatcttggcttgtggtactggcacactagtagatgataaatatatgcataccatatttccttaaatatgagtcagcaccgattattatacacacaataaatttttactaacagcttttcaagaggagaacaaaaaagaggaaaccatcatattaaatgtaaacttttccattaaaagacatttcaattttacaaatatttaggtatgagaaatgtgtttcttactattgagaaaatatggtaaaacaatcttattaattatattgtttttgatattgtaaatacttatttgtcactttttatctgttaaacacagatattaggttaaaattcccatatactgtttggttctgagggctttcagtatcccttttttcttaggtctatcacttattataaaagttgaattgtgccatttgattcattctgaggctttttcttccaaagaaatgtttaactcatttctatctgttatgataactgggattcttgtcctttctgtcatcttgttttaggcttcctgttttatatacccttttctgttttcttacccccgtgtactatatgtgtgtgtgtgtgtgtatatatatatatatatttatatatatatatatttttgagatggagtctcgctctgttgcccaggatgcagtgcagtggtgcaatctcggctcactgcaacctccgcctcccaggttctagcaattctttgcctcggcctcctgagtagctgggattacaggcgcccaccaccatgcccaactaatttttgtctttttaatagagacggggtttcaccatcttggccaggctggtcgtaccatattttctttgatgatttttagtaatttcagtcatactggctttataaatattatttagcctattttctctatcagtcaacatcaaaaataaataatcttttgagtaccttacatgttaaagaaacaaagtaacgtgactgtgttatcaaaactttcctttatactttttaacctgtggtatttaatatacagttgtgtttctaaagaaggtgtatatttttaaaatatttttaatgtgacatagatcctactatctagggattatatgcagtgtttaatgccagtccttccttgctatgacagctccattgctcagttctttattttgattcatctctctgataacctttttttttttttttttttgagtaattttagttcaggaagaataggcagtatatttttaaatccttaaaatctgatgataatattctttatatataaatctaaatacttcttataaggatgtctggtggtttgaagtttgaagtacgtaacaaatttttttttacctcaatgacttgactgcttcccaaggtttttttcctgaaaattctattatctttaggtttttaatattgatgaaggagaaatctgaggcttatctaacttttctttctctaagtaacttgttttctctatctggatcttaggggcttctttattcacgatattccaatgttttacctacatttgtcagggttttggtctctgcattcattttgccaagccttttttgtgttctttttattgatggcttcatgttggtttctgctgttttcttgcttgaaagcaccttaaatgaggtgattgaagtctccttgattctcatcaccttacatctgaagatttgtagaagagtcccctcaaacctcaacatcaggactgtctgatattaactacacctcctgtttagaagttcagcagctgagaggacaggagtggagccaaaaccctcaacaatacttggaggagaactttgcatctgcttagttttgcaggtgcttttgctgaaatcactggataaggggagagctttctatgccctgacttctttttggcccagccgtctcgtcctctattgcctgtggctgtgtctgcccttcaccttcatactattgcccatctaattagaagagagagcactttctatcttttagattttttccgctgttacagctacttggagaatccaagactttccaggtgtgctgttcagaatgctgccacttccaacataacaaaaagccccatgttaatctcatcagtctcataacctctcctccagcctcacccttctaatgaaaggcttagcctcctctgcctgctccccaggagggttggttttgagctggcaccatgccctcctttccgcccaacccatggcactatttccaatacatactcctcaatgactcacactggtgcaagtttcacctgttttatatgcggttggtcatttcagccagaatctgggagatcagtagtaaattgtctatgctcacattgccatttttattcagaatttgatacccatcaaaacacttaaacctcgccagaataagagatttcttagtgatgaaccatggcaagaaccaggacagttttattgcctcacaaaggctattttcttagctgcaactttcttattcacacacagtaaagcaatgcctagctcatggtatgactggaaaatactagggcttttttcccctcctacatggttaactcctaattttcctttaaatggtcctgaaaacaagagacatggtatgtaaaacttccaaattggtttccttaccactccaagagtggggtctctggaaaatatagtaacaaagctggttttctagtcacatgtcaccataacttcagtagggctaagctggaaaggccaaagaaattcggaggattaagaggtttttttgtttttgtttttacattgaagatgtaaaaaataattacaatataatgctgggtgttatgtatgcacagttacctatgaacacaaaaaggtttaattttttctgtcaacgtgcattgttgtaattattaaagataaaaaacaaagttcctgctataaacataggggtattggttgcatgactttattagctcctagactgaggtctattgtgcggatgctaatctaataacagaatcatatttataatacagtaggaaattctctctgcaggttcagaacagtacacatgagacccagcattatcgaaggcttatcctttctcacactgaactaatactcacccttcattttggtgacaagtccagctcaatgagaatctcgacaaagggcctgactctctccccttccagccccttcgctacagcagatatgattacttggattctgcctatgggtccacgttgtgtacccagtcccgggaaggtgcaagaaaatctgatcctttttcaaaaatcatcttagaatcgaaccagtcttactctgattttcatgacacccccaccctgcccttgcttctcgcagggtctggggctccatgtccttatcagtatcagacttccactgaggctgctgtctccagtacccccagaacactaggattatagtttctactggaattccctaaactacattgctcatccatttcaactagacccaactgcttgacaactggtcatggacaatcttgaacatagattctgtttcacagtttgtcctaatctctttcttctcagatccatctttttatccctgtccctctgtgtacccatagtcacatctgggtgtctgtggtgggattgtggatgtgcacttctacccactgtaagcagctatcacaggtctggcccactcaactgctcccctgatatctgtagtgacagaaccttgccttcaaaatcaaaagatacaaaggtgattccagtattgccaggtagagttttacaaagagtacttgcctttgtggcccctttttctaaaattttggtaagcagatatacccagaagtatgccagccagaaagtctgcagcagctctggggcctcagtaacataagcacaactctaacttgatagcaagctcaaccttgatctccaactgctcgtctgctgtttatggcacttactgcctggccacgttttcatttttgacttggaaacaacaaggcagatgccacattccataccactaccttttttagttctagtgaagaaaataatgtaagatggtgaattaattgacatgaaaaaaaattaaatgtacaagattaccacttctgcttagtgctttgtctttagtaattattgcatttttgtatagttaacgcttaaggtatgcaatggccaaagcacaattttattgcctttattttgctgtttagaaatggcctctgggggtggaagggagtagaggagaccaatctttatcaataatgggtagtaattttaaaatcatttaaaatgatttttgtactcacatatgttcaaaccccctttccaggtaaattctatgtggggacacaagtggtcactgagataccacttggcttttagacagtgaagaagtcaaatgagaggtttgcaggtataaataaaatagcacaagtgtagaagcatcatcagacacagcaagtgtaactataatgaaagttaccttgaacaaatcagttcccaggatagcattcatttcttattgttaaatatgcttgatgcagtgaagtatggcttccagaaagataatggagcagataattaaacactctatttggaaacacaaacacagacacatacacactgcagggagtgtgggttagcacaaatcttgtcagtacaacctaatgaccttctgtagaccaggcctttgacaaggggaaaaaaatagaaaaagtcattttttttactgcagtaaggattttttataaaaattctgtggtacgtgaccaacatcagtaaaagagaaaagagcttagctcttacttcttttatataagtggactatggttcgaggttgatgataaatcactaatgtttgagtttcagttggctacagcatactaagtagtcttttctgtggtgacaagtgacaaggggcagttaaagatgtggctacctcaagttctcctctgccatagaaaacctcccagaggtcaaccattagacccctactgtttctatgtcagtagtgtaaggccaggcaaaggcaataaccttcatcagggtctgtctcaacctcccctgcagcctcctttcattcttcgtatccgatgatgccattatcatagagagtacatacctgataaatgcttgttgaattgggcagcattgtttctaggtctctctcaggaaaaggaggaggatcaagacataccatattcatcttaggagtaacacagaagtttccccagatacaaggtccaattctctctactgtaaagcctagtcctcatctcactacatttttcaattagctgatgacacctacatgatgcatcagagatggatagatggattggctgcttttgagaagttactcatggtccatcatgcatcaggattcttactcatccacagtcccctgcaaacagccagctattatagtcagcagccaatggtctatgtgagtgatccagaagctaggttagacagcatcccattggtcttcctggtaagaggttgtgctcacatttcatacatctgtacagtcacagtagcctctcatgaagccttctccagctgctccagcctcatctccctctccctgtcagcacttccagtctacaccaggaagtaaaacttaaccacatcctacctggtaccagcaaacaacttatttaagaagtcatgcacatttgagccctacgttgtgcccaacctcatgctgagtactttgctgcccctcaacaaatgtttgaattcttgatggcccagatgggtaactgaggcagaaacatctatgagtctccaaagggaaagcacatataaattgagacctgtgctgtattctcatctccagcctcttctcttcgtgtcagacatgacacaatcttttttttttttttgaaacagagtcttgctctgttgccaggctggagtgcagtggcacagtctctgctcactgctacctctacctcccaggttcaagcgattcttctgcctcagcctcccaagtagttgggattacagacatgtgccaccacacccagctaatttttgtatttttagtagagacagggtttgaccatgttggccaggatggtctcaatctcttgacctcgtgatcagcccacctcagcctcccaaagtgctgtgattacaggcgtgagccaccgtgcctggccaacacaatcttaaatactcaacaagctagcctaacgaggaatgccagcaaataggtcattgctaacatctcttttggtgtctttctttgacaatgttccaagtggctacctaacatgctggcaattatgcctatagggtgagtacctcatttaagtatttttgtagattaagtcaatctatgtttatgaattttgaaataatggatatggctatggtggcatgaccctacttgagcattaaaaaaaaaaattaacttccaacatattttaatgcaaatgttacctttgtaagtggatgacctgaaaagaaagtgtttccatagtaacctaagggaacacataactgtttatcagaacttctccaggaaaagagcttggcatggactggggatctgctttgatgtctgctgaaagaaaatagctgacagcattgtgtgagaaaatggttagaagatcccactttatttgtagttaatttagaaaataaactttcataatgaactgctgaaatacacacttgaaacaaccagatgatccatcaggatattttttaaaatgtaatttgtcgggtgtgacaaccaagtcatcagtttaagagaaacagattagggaagagatcttacagcaggtctttgccaccatttcactcattttttttctgtactctgtgttcttctgtaggaatcactaggcctttcagagctcttagatttttttttctttgcttactttttttcctttttaacttcagaaaacgttacgtaaaagctgccctttgggaattgagactctacattgtgaggctatcaccaaaaagaaacctattgattgattatacttcactttctttactgacacggctgtttgagttagtagctttttggacatgccattaggtagaaatgagtttgacatccacaagccactatctggttatctgctggttattttccctttttcttatggatgtaatatctacttaaagaaaagctgatctacgagggttttcttttttcattttttaaggttcatttgagtagagaacagatgcatacagttttgagaagtatttctttgaagcgcctttttagagtcagctcactgacaggtccatgcccgtgggctctggtgtggacttagagcaattacccacctggtctccatctggtagcatgaacgaaaaatcataacagatcatagagaaactataccaactgccaccttggtataggcaggcaaagaaaggtgccacccaacaatgctgtgaagagtaagaaatgctatccgtagggtatgcacattcccaccacaagatgcaaaagagtggcacacaggagcatgtggaaaggaaataatatgcacatctaaccttacagctgcaactcgtgaaatagtaaaccaaaagttctctccgccacatttatgtttctagtgaagtttggagaaaacgtattatcctaatatgcttgagacctgtcttttgctacccactaccacccacaacagggttaaacaagacttgaggacttttaggtgaggagtagatgccaacatcataaggatgttgatgtaatttacatgtaatgccactttgtagtcagttcaattgtagcaaaaataagggttttatggttgctggaaaataatttaaatgtttgttgattcgttattgtctttttgtttttattttctccttttctgctttgtctgctttcttccagaatacagcgtgctctggttagtacaatagctaagggttcagaatctattactacaactgccagagatttgccctcttcgggtaacacccttccatcctgaggagctagagaatccgagattcagagaggggcaaaatgtctctggcgtgtgtgtggttagcagggtaagagctaacttggattcctttctttcataatcccctacaaagtgttgcacatgcttccactgaggactaaagcaatgaaaaatatcttcctggattggccacacagatactcatgctggacgattcaagaagatgaaatggggaagaaagaaacgatgactctagaggcatgacccacctggataagaattgttgtaaaggaattatgtagtgcaggaccattagaaaatgccagagtgggaggtgagtgaaagatgagatgtcaaaggagaggggttgtgatctgaaaggtaagatttcaatatctgtatgtagactgtgacctttgcaaaagactttatggaaaagccaacaagagcctaaacgtgattgctgtggaagaactgaagtgcatactctctgcaagaagatataatattgtaaattcacttgctttttcttcttccaacgtatggaagggactcaggtttttttcaccataatttatactaattagtctttccacttaaatcaagaggggaactgcaaatgtggccattgatggtctgctcctcattagagacaattaagagttagaggaacaaaaacacatcataggattaatgatgagaaaagccacccagagagagaaacatgaagcaggaaatgatcttattgagctggacaaaggaaactgatagcctgcaagatcagaggctcttggagctgaggtctaaacagtctaaagaagaatcgcctgggcatgcaagccttcccctgctgtattctcatctgtatttttcatatctcctgtcatattgcatttattaagaaatgttcttgctctctaaatccaattcattagtttccctccatggataagagggatggcattactgctgagagaaaaataagtactaagctaatcagccttggtaaattccagtcttgcatgttattgtcattgaagctttatgtagcattcagacagggcaccgagacacaggagagagactggatatgaaatgtcctaacaccactctcagacccctgctgcttatatcattttatcgtcttccaaagagagagggaggagattagggaacatttaattgccttataaactgattgacaaattggtgatctgatgcatatggatgatctttttagtgaaatggttcagaagctgctaacagatcatcaggaaccatgatttgcacgctctccgcagagttattacagagaagtggaaggatgggttgattatttattatctttccttctttctgttttttttttccttgaatgttttcttcacctccagggaaatgcattctagcagcgtgaacaccgctattaatcaacacttgtagcaataatcagtgagtgaaaaatggtgaccagaatctgcgaatgcgctggcataactgtcttctgagtgttcctttgtgatcatgccttggcattcgaacatggataatttatacaaaattaatgttgacaccttctgaggtgcaaagattcatagaagcagtgcttacttcttcatccgttaaaaaacgaagagaaattgtttctggtcatgatgagtcatattttagaggctttaaaaatatacttgatattgtcatgtttctttgtgttatgtttagtcacctagtcccatcatttttgaacacaggtgtcataaaaggcaaaactgttataagttctttgtttcagttttctcagacttactccagaaggggtgtggaaaataatcaagaattttaaaatagctcaagccccaatatccttctcaaagccaactattgttattggcagtgcttgggggggaaatggttcagagttgctggagtggcaaaacactgttacaagccacaccttacatagggcagttgtctaaattaatagtgcaacatttggctagtgatgcaattatacacaatgaaactattttgaaatttggttgccactctcattccacaaagctacatattaattcacaccatcctgtgatcaggagggcaaaatctgaggtgccaacacactggaaatttcccttaaacttcgctaagttaggatgagtttgcctggagcctaaggaagatcactaaggcatcagaccacatctttaaaaagtgtgatagaccaggactcataggagcatatgacaccagccccttctctgcgaatcattcctgtcattaaaatcaatgcaacttaattaaagcaaattatagatagatacatctataaataagatattaaagtgtgctgctgaatatgataattgctgcatatttagcaatcagtgtgtgtgttctgcttttgccaggaggaattcctttcagtggaatcaatggagctttattaaaaaccatccaaattagagggagaaatgatgagtgttataataacacaaaatcactgtttcaactttcattgcaaagaaaagaaagcaaaatatggccatccctcttttttcactcaaggaaaatattagacatattttctttaagatgtggatgttttgaatttataaattttaatttttgtattctcttctcccaaaggaaggcagaaggaaaataatgatcataaataaaacaatttagcagtgagactggtaggaggaacaccccagtgcccagataagctgttttataccgtgatgacagaagacaaataatgaagttcatattctgtacagaacttgaagatggcttattttattctcctatccaccagattttcttgtatgtgaaaattttcatgggttaattcaaaataatgaatttggaaaataaaaatccattttcttacccctatacctttattcataacaattacacttgaggcaaagtatattttttcaggctaattttaaaatacaaattttaaaaagtttttttatcatcgagtttaaacatcagtaacaggaaacataagtgttcattaaataatgaaatcacccctgtgtaaccagaattattctcaaatttataaaaataaatactaaacttacaaaaagacatagattttaacattcaatggttttgggggttttttgtttgtttgtttgttttttgagacagggtcttgctttgtcacccaggctagagtgcaggggtgcaaacaggtcactgcagcctcaacctccggggctcaagcaatccttccacctcggcctcccaagtatctggaactacaggcccacgccaccacatggggctaatcgttcagtgttttaagagatgaagaaaatcactaggcagccagccacctctaatagagtctagtaaaagcatttacaaagacttcccattctgggttactctgtgcattaatgttttgtctttgagaaggaaaagagataaaagaaaaagtgaaaaagccaaaaaaaaaaaaaagggacaagaagagacatgcatgtttaggaaagtggtttataactattatttcacttgatcaaataaatgttgatttgttgaatattttcaagggactggtcctggtgctaggaaagaaaacaaagtccctgttctcatagagtttatgtttgtgaaaagagatagacaataaacaagtaaagagtaaatatcaggccatgataatgaccaggaagaaatatcaagctgggctaaggggctgggcaagcatgctgttttctacaaagtggtcggagaaggctaagggagcaagatgcttgggaagctggaggagcagagaggagagtgagtgagaaggagaatggacggaggccagagaggtgggaggatcagaactgtggagtcttatggagtccactttttttttttggagacagagtcttactgtgtcgcctaggctagagtgctaaagtgtagtggcatgatctcagctcactgcaacctccacctcctgggttcaagctattctcctgcctcagcctcccaagaaactgggattacaggtgcccgcaaccacacccggttaatttttgtattgttagcagaaacagggtttcaccatgttggccaagctggtcttgaactcctgacctcaagtgatccacccacgttggcctcccaaagtgctggaattacaggcttgagccactgcacccagcctaaccattcttacccatagtggttatttctaattttctaagatgcatagatgatgatacgtattcctcatgcttagaaaagagtaaaaacgattggcattggtctagcttgctatgtttttctcatggcctagctctagagagtgattttcaggagagatggccaattatttcattccagactgccaaaaccagaggctattatattcacaaatttgttcaaaatcgggacacatgagtttccagtctacagaggggtgtatacagagtaaaatggagttcttttttgcatctctcttagctctacatctactgtgtagacatattgcccccataatcaaatctgctctgcccctttctcatgtttccaccagaggataccatggcttattcccacctgcgaactctgcatgaatggaaagaggaagtaacaacagccactaatcatgtacatcacagacatctaagcccggtctttcctttaacacacactccgtccttgtgcagctgtgccttagagttggccccagtcaataggtagggagggagcagagtggtggtactcagactctttatttggttcctttctccatgccaaaagaagatgtcataggacatttcaaaactaaaccatccttagagatgtgtactaacagcagtttgcaactctgttatgggatacacaaaacagcagggccactgttcttcattgtaatctgcatgtgaatattctagttcaaactccacacagtaataataccattaatatgatatttgtttgtagcataagaaatatatttccttctgaaaatattgatgtaatgggtctctttaaatcacagtatttaaataatagcccacttaaagaacaaggtattggaagacattatccagtaaaaggtttctcttccctatgaggcagtgagttcattctgccacctttataatttcctcttcctgtgcaaagtggctctgtgctctctgctttgctgcaattcctcaggcaatagccaagctctcccattgtgagaatccctgatttcaataactcacagaaattagtaattagaaacacattaaagtgttggatcatttttcttaggggctttactagtagagaattgtaccccaaatttcatttcctggtgttttctcctttctggttataaacatgccaatggtgctgtattgcattcacctggggtaggattgagacgtaatcaaggtgagcctaataaaaatgtggcagcaggcctaatgaaaattggaatggatctaaaaaccttgaataagctcactctcttttcataggttcttgcagtttggttttcctgagtatctgagaaatggcagggagtggggtcctttacaggtattagctatgagcaggtatttgaattctgattgagaattgtgaggtggaacaagcgtgtggtgtctcttagctgagttgtgtgctattggaaatgatggaggctgaattgacttttgattttttaagaaatgattcgattaacttttgaaccacctgctcctgtgtccccaggaatatcgtgaaataggctctattcctgttctttccacagcattgcattctcctgctcccactcatttgagttttgccgctctgtgaattatggtatttgatctctgctcctaaggaaagatgattctacccactctttggatgggttgttccccacggttgaccctcaaattgaaagtgatgtttcccttgtgaatgttgtaaatttaaactcagggatcatcacctgatcagtaactcacttgtgggttgttagtgtaatttatgcactgttgcttgtctgcaaagtaaaagtgagtttctcatgacccttgaggaagatactcggagagacctgtccctaaactatattgggccaatgaacaaattcaggaatgtaactctctctacttccttccaagtgacttggattaatgttggtgctattttccataccaaaacccaattacaagatggaagattttcagtaattgggccctttggatctgaaacatctcaggtcagtgcccctggggatagccttcagtaggaagagttctggggcttcaaacagaaggtaaatctgatttatagatggacatggcattacatctgtcacaaatacattatgaattggcgttgtacattttctaacatataaatcaactccccctgggaaattatccttcatcctaatggattataccataagaagttctttgcaatattcatcctaaattttcacttttcttaatttcattacattgatgagtagagttccttatatattcttttgcctacctcttagggatgttaagagtattaggctaatgcttgtaaatcacctcacaattctccaactgagcccactaaagcaatgcaaaacagtactagataataaataggtgttgattctgctcaacattcatgctatactggggcataatgaatagacccttaagtaagtagataaacattcttctccttaaagatgggaaatcatataaatggcactcaaccagaatttcaattgcttagctgccaaagttgggatttggcttctttgcatagaaataatcatggcaagtgttggtttctttttctttttttctctggttctcctgtctgctgaccccttgctacatgatgcttccccttcagactctgtacctttgtttctctggaagaactgcacttaggtgagcatctctctgaacacagacactgaggatgctttcagacttgaaaacacaatgaaggggccttccaccagtcggcagggctaaatctgggagttgcactcatttaggaaaacccatcaatggaccgatagcaaaatggctgaggtcagtagttggagatggactcactctctacctgcgcacacaacctgttgtaccctgggaaggaagccagctgtcattctctcctcatccagtcactagaactacacacacatggtcctggcatttatatgtgatcccaaactgttcaataatgtaataaaatgcatatttcatatttgcactgttaaatgcctaaatcacaaatactgtttcttgatttcattcagtagaattaatgttgccacatgaattagagcattgcattcagttgctaatagcaccttgaggtaacccagctaggataatccaagtctgttttctgtgggtagttgaggattacgtgtttctctgcttgcctatgttatgtctctccttcaagattacttttttcatttagttgatgctttattcttttaatcatttattgagcatgtgttagataagaagtattacaaagatgaataaagcaggattatttgtcctcaaagcactgatgatccaacagagaaggaaaaacaaaaacacaaaccatctccttataacagtctaggtaagtattatttacaaagacatactgaaggctctcagaaaataaaaagagaatagttctgtctgacaggcttcccagaggacctggtgatggaagagagggggagaggaaaaagcttgaaccaacgtaaggaaatgtgagagtttacagggatgaaggatggtgatactgatgaggatgacaatgatgactgtagattgtgaaaggcttggatgccatgctcaagaattagacttctctaggcattgtttctgtaaacaacaataagatggtcacgtgtgtgtacacacacacacacacacacatgcatatcatccttctaaatgtgtcatattattccagccactcatcttgtatacatatagtgtaaaaaaagacactttcataagagaaagtaagagttctctctctataattccctctctttctgtctatctgtctctcctttctctctcgtcactctctttcccaataccgttttcggaatagtatcggtgaagaagcttccgttagctctgtaagccagatctgctcagggggctcatggaaatgaactctacagggcagggaagaaatcctctccaagtgtttttgtttttttattttgttttgttttttaaccaatagaaaggtcagattcaatgtaactgcaatagtaagaatgaatatttactgacatgtagtagactatgtgtgagatgtactatgtgatttatatgcatcatatcatttaatgctcataacagtcatctgagtgggtattactaatcgcatttacagatgagagaaatgaggctcaaaagttaacttacccaaaatcacaaagtcagtaagtggtagagccagaattcaaacccaaccactatggcacactgtgtgcaggcctgagaccactgcctctgggtgttcaattagagactcttcatgcagtttccagttagaattaattaatgctggaatcagacacgcattaggagtgatggtgcttttaggattgtctgacctaccctccctgccgtgtcattctctttgagtgaaatagtcttatgaggaattcacaacacctgcctttgtcctggtcagggtagtgttgcagattgagtcagatgatgtctgagaacatgctttgatcattgcaaaaccctgtatgaatatagtatctgacaatatatcactcatttaatatgtatgtaggaactagacagcaagcacattttaaaaacaggacaggtagtttgaaaatcggtttaaccttttaggtatcatcctctagagcaggtatgtgcacagcccctccaaggccgtggtcaggggcccatcagcatccaagcttcaaagccagccattgctggtcactctatcctttccccagtgcctgccagactgttcacgaagtagcagcccagctgtcacaactgatgaccagctgttttttattttaacaatggctactaaaacccacactgaagtatcctttgtattatttcctcagtagtttagatatccggttctgaagctttgatcagatcactgaacacagttctccagacccgaaccccacccctcccccaggtcattgcacagagcaaacgtgttctgctcaagtggcatcctcagatctccactaggtggacttcacagagcagccaagtacggttagatgtgactcaggtgaagttttttcaaagccctcttagccaaagaagtatgaggctttgatgtagcctttcactagttcgaaagtaactcaggaacagaggggaaaagactcagcagttctctcctaatatccaaactttcctcattttagtatcactactcagcttgcagggaagtctgggagagggttcctagaaacccaactaaccacggactctgtgtcctccacagcatgtgagttgtgcggcaccgtcatgctacatccatgtcttggctcatgtgagacacttgggctgattttttgttgttgttgttgttgcttgctgtatatttgcataattttatatcccgagcagagttcttgattttgcaagagcataataaaaaaaaaaaacactgtgaattggcaggtttgaggttatgatttgcagctggtctatcacttcctcttcctggaagctgcagcttaaagtattttacaattatcatatttcacgggacctgggcctatatttgcatctgctcatcttttggttttcttttttaaaaaatactctcttttcacattttttggtggcaaaattgtccaacacattcattttatgtatttttctcttctgggtataaattcatatggttcaatgctattgaaatcaaaacattcaatgcaatgagcccttcggacaggtttttgagactgaaaacaatgacaaagcaaattctacccagggttgcagtaatatttctaaccagcttcctttgtccattgtcattattttgattaaaaaggtgtgtagaagccacggtggattttcaggatgcaaaaatcattgcagaaacttcctctattagtgcaaattattagacgatggaaatggtacttgagcagcaagaatgacattaattatgcgaaaagcagtcatatctggcagttggcaagcatgcattattcttcaacaatcttccatgggtttgtgttcagccagcattagaaatctaaaagcttttaattttggcaaagttttcacaggacttgcacttccagcttctagataaaagataatttggaaggaaattatgttggtgaaattgaagaattcagtaatgagttctgtgtagatgaatcaatgctcaattaaatgattatatcaaatctacctttaaatgttgacttaaaataatcatattttaaagacattgaaagtaagatgctatatatacatgtaatcagaagagcaaagtctgtgttacccatgctggtagaggaatgaagtattctgattgatccatgaatttgattaatggaaagaaatttaggacaggaattacctgtacgctaagatttagagtagactgccataatctagcttgttttcatagtttccattctcttttgcagcttttctctgtttctctgggtttttttctctttccctgtctacacccctttttccaggctcccttctctgtttgagagttttaatgctcacagaaactttgttttttttttttttttttgagacagagtttcgctcttgttgcccaggctggaatgcaatggcgtgatcttggttcactaaaacctctacctcctggcttcaagcaattctcctgtctcagcctcccaagtagctggaattacaagcatgtaccaccacgcccagataatttttgtatttttagtagagacggggttttgccatgttggccaggctggtctcaaattcctggcctcaagtgattgcccgcctcagcctcccaaagtgctgggattacaggcgtgagccaccgtgcccggcctatttttttttatctactactttatccacctgtttttttcccttcgtggcaatgagtacagccaatcagagcaatattctttgtttcattcattcagtcaatcagcatttactaagcccctgccaagtttatggcactaacctgatgataggcagagctaccaaaactgaagaaacagatatcctgccataggcaaaaaagcacatgtttggctggccagacacggtggctcacacctgtaatcccagcactttgggaggccgaggtgggtggatcacttgagatcaggagttccaggccagcgtgaccaacatggtgaaacctcatctttactaaaaatataaaattagctaggcatgatggttcatgcctataatctcagctactcgggaagctgaggcaggagaatagcttgaacccaggaggcggaggttgcagtaagctgagatcacgccactgcactccagcctgggcaacaagagtgaaactccgtctccaaaaaaaaaaaaaaaaaaaaaaaaaaaaagtatatgtttgggatccataaaatttttaataagatcaataagatcattgagcatgcataagaaggacaagataaacctggaaagttaggttgctatgggttactaaaggccttgcataccagactaagaggctgagttttttttctctagttaacaggaaactattcagtagtttgtgtttgtgtgtgtgtgtgtgtgtgtgtgtgtgtatgtatgtatgtatgtgtgcttatttggtttggttttccaaaccaggttttgacataagaacatcagttttcagaaggttatcccttcagttcttcctttctcctcaacttcattcatcttcctagaacttgaactcagctgctgcagtcatcacaaaataacttggttaatataaatttgaggaaaatgcctgtctgattccagcatgaatggtaggacaggtctgataatgttgtgactccagtaaacactgcataatgacatagccattccatccaacagtagttgtgtgctcagtaattcatcttattgtatacggttcctctcctagtccactgttactctgagcttataggaatctttcctcacgctaagcagttacataatttagattccaaatggtttcgatttatactccagatctgagttcaaatctaaattgttagactatttatagtttattttttattttgtaaggaatatgaaaagccaggactgtgtaaacaaaagaaatgtggcagtcttaataaggcataaccataaaacagatgtcatgagggtaaagctccctttaaaacattttgatagtatgttttctctgatttaacaggtttggaccaaaaatctagcatggaatctgattcattctttctgttaacttccactgcgtagatgtctgagacatctatttcattggctcagtaaatattaatgaacggactgatacaaagatgatatgccaggccttgagaatgcaatggtgccaaaaggaggcattgtgttagcactcaggaagcttacaatctgagatcttaggtaaaccaaattaatagactgataccatgtatgaataactgaaaaaaaaactgtacataaaccaggctatttttataacacatatctccttattaggaaacacttttgctataccaaaaaattagaatatatacaaatattaatgcctccagctataagaaataaatattactaggcctttggagttcagtgatatggctaagaagaccacaaaccactgagaatacttgcagacagtcacagactattttacacgtcccatcgcatcaccaccatgggttcatttgaactttccagtccttcatctcagttcttcatttaggaaacagagtgacagtaattatgtgatcactgccaacatacgagcagcattgtcgggggagaaatgttgctttggggtcagacacatctcagttcaaatcctggctttgccactgtgtgacccttaggcaagtctcttgatgatctctgaactttcatttcctcatgtgtgaaatgaggcagagatggaaatggtagcacgattgcaactcatgatactgatagtggagtgttctagagagtcctttcttttggtaattgtaaatggaagtgaccagaacttgccaactggctgaaatagatacaaaatattcagcttttccaaatgtttcttttttctatgtttggtctttataaatggaagtatacctaaaatatgctagagagcttggtcaaggaatatgctttatagagtttatcagctaaaagggatagtataagaaataatatgaactagtatatcatttaagaattgaacatattttgagggttagcattgtctgttttggggtgagtgaataacactgtcacagagtgtacaataaaacaaaacagcaaggagtaaatgactcatggaatacatccatgaaacagaaactgaatttagtaagtactagatattagcatctagtgattgatgtcactaagattacatcaaattcctgtgtactctgctcctggagaatacaagacaggtgacagatttcttaggaaatgcttttcctaatgccttttttttttcttttcatcagacctttgtcttttttcaagtatgagtttactttttagccagtgttacaatatctctatttgtaggtagacagatgggggataggaaatgaggaatgatgtctggctctttaattaaagacacagagccagagtttgctcttcaagcttgttggcaaggcacatacgcacacgtgcacatacacacacatacacacacaaagtgcatctgatagatgaagccaaatttgtaaaattgtatccacaatcatagtttctatggtaactgtatcttaggcccagacacaaacagagctggcaggagatgtctgattttattttctgctaagacaatcataacagagacagttcaggttattaagatgccatagcccagtgtacatgcagctagtacttggatggtgctaccataagatttcatgcttaaatcccaataaatactttataatttcataatttgcaggttgcttttctctgtcattctgctataaaatcatcatgtgcctgcacacagttactatattaatgaggtgttagtggtcaacataaatgtggaaatgatgcaagataacttttataaatgtgcacaggttagaagggacttccaggatgtctgttttaaccctgacatgttgcaaggaaggaaaatgtaggcacagtgtggttaaaagacttatccaagagttccttttaaaatattttatttgctgtattttttaaactagcagatgttctagactagtctataagctgaatacccagttatttcacaaaattactgaaatcaaattgtggaaaacaaacacttcagaaacaatagtttgaatgagtgtgtgttctttcgcctctctggatggcatatttgtaaatacgtagctcaggcatattataccacatattgctgaagatgaataattaaacatcctattttgatgagtttcattttgtttaaatagagcatttcccttagttcccctagaaacatatagcattttagcaaaagtcttaatattagaagatgctgaaagccaagtttataacttttagaagtttttattgtgttgattcctttaaacatcttccagccaaatctgtaactaggtaagagcaatggaattagaagaaagcttttggaaatgtggaacacttctccaaaatatctgtcatgataccaacttgaaatgaaaggcacatttcctaaaatggcatctaaatttttatactttgcatcttaatcttatgatgtgtctggcagcatgaaactcatttttttgtaatggatctaagtaagacatatttgtaaatgaggatgttatatataggtgaataagccgtattgcaactttgcttggcctctccatcacagcagctttttaatttcctcaggaaaattggcttggaggacataaattacaagattggcaaaaaatgtgtcctaacctatagaaactggaaaacatgttaattttgaattgtttccgcttttcatcagcagacatttgcagaaaaatcttgtgtaatttattcttttattttcaatgaattgttaaaaaatgtttgaaaaggcattatatcttctcctctgccattaatctacaaatggggaatattgggaggttaaatggcctctttaggatattgctttatgaaactgctgattctagcaatgccaggctagaaatacatactaatttaaggaaccatgaatgtaagcagcaagctctttgcttttgtaaagaaaagactaatagctttattttaacaaggctcctaacaccccagccggcagcaggcattgagtgaatgaaactgggagaactcccatggactaaaagcaccttaattcaacattccttccaaacaccaagccctcctgataggcttgtcacaggctgtcataatccagccaaagagggtcaccacgtgcaaggcgcaccaaggtatgagcgctttaaattgttttgaataagctctctgaagtttcacttcctgagctatatcagtaaaggaaagataaatatgccccaaatccaggcgtaagttctaacgttacactgttgtgtaaaaggctagatttctgttatggcttaagtcaagattgtttctgtcagacatatatttaggtcactacattaaaaagaaaaaaaaaacctgcatgataccaagtaagataaagggatttaaaaaaaattaattggattgaagctgctgaccttatttttttgtgatgaggaaaattacctaataaggagttcttcaagcaggaatatttctgagccttgttgagcacagagaaaaatgagaagtgagcttataaatgcctgtgtctcttttctctccctcactccctcttcaagtcatcttacttcctaaggacttaaccacaacttcttaaaattggcttccctttagcaaccctctatctgcaatttcctatcctctatttgcagctcttgtaagaatatttgtacccaacacactaatctatattgccaccatttctaaccgagtattaaaaattgatcaaattataggagattacatgaattatgatttctccatataatgggatattatatagccattaaaaatcatgttttaaaatatatccaatagcatacaaaattgtcaataataaacagatgagaaaacagctctatatgccattaaaatatgtatgtgtttataaatgttaacagaggtcattttggggtggttttccacaataatcatttaatggagaaaaaaatgattaaatctgtttttttggataatggaacagaaatgtatccccaccattttcattaactaacattgtatccctgagggagaggactttttctcatctctatgtcttatggtacttcacatgttactctacctaggagacactaatacatgtttacatatttgaaagtattaatcccattccataagcatgacagcataagacagtacaatcagtgtttatttattagaaaactagaaaggttttcagcaccagagagtctggctttctctccccatcaatccaccgaaatcactctcaataaaccaccaatcaccatctcattgccgattccaaacaatatttttgcagactttatagtggtctctgttcagttgtagagagcaacatccactgtagcttaagaaagaataaatttattataccatagtaatgagcttatagaaccataagggatgttaaagaaaaaacttcttggataagctttcaggaatgatttttccaagccacactccagaactgagctactgggggagctgttgctatttctatgtaggaagttttagactgcagagccacacaatgctcatatcaggagccaccatgattaggaagatgccacaatcagaaagccacctctcctgccaccaattctaagaccaactataaaagttacatttcactccccaaactagcaatgttacagctgctaaagctgccacaggaaaaccaagcatacctctcatttagtcagtcttgccataataaacagcggaagtatggccactgcctcaattctattttccaaatgttatggcctaacttaaatcatgccagtacattggctgcaagggaatccagagaaaggtagtttttagctttccaggctctggaattgaaggtgacactctacaagaagggtggattggatgaagtgcactaacacacagtccctgtcttactgaagcttttcactgttttggcactgtggaacactcccttcatggaattcttttcttggtttctacaataaaacattttcctggttttcttctgaaccaactactttttctcagacttcctcctgggttcagtgtttttggcctgccctttaaatgatggtgttcctaagaatagtattagtgttcctctctcttctcatttgtcttttcttttatttggtccctacagactcttcctgggcattcttttccaagctttctggtaccatctgtatgctgaacgtttcccaatactacatctctagtccagacttctctaagttgcaaaccattatactcaacgatcagacatctccattgacatgtctcaagtcagtttaacatgtctagatattccctcctcccacctctactccaaaatctgtccttcatttattcctgttttggtgagtattaccaaaaccatgtagttgctgagctcagaaacttgggcattattctaaatacctcactccctttaatccacagtcaatcctattgctcttacctctttgaaatcctaatgacactctcttgtcttcatcctttgaaaaaccctcaggtttatgctcttacaatctctggctcagacctttgctgaactctccaagttatggtaagaataatcttaaaaactataaattcccaggagataaaatacaagaaaatctagatgacctagggtttgatggtgatttttttgatataagaccaaaggcatgatctgtgaaagataaaattaatacgttgaactttattaaaattaaaaaatgttgctctgtggaagacactgccaagagaatgaggagagaagctacagattgggagaaaaacgtttgcaaaacacacatctgataatgaagtatccaaaatacagaaagaaatcttaaaactcaacaagaaaacaacctaaataaaaaaatgggccaaagacctcaatggatccctcaccaaagaagcaaagaagatatacatatggcaaataagactgtgaaaagatgttctacatcacatgtcatcaaggaaatggcaaaacagcaatgagatatgactacacacctattagaatggctacaattgggaacactgaccacaccaaatgctgacaaggaagtggaacacggggaactctcattcaccaggaactctcatttgttgaattctggtgggaattcaaaatggtatcactactttagaagacaatttggtggtttcttgcgaaactaaacatagtctcaccatatgatccagcaatcgccttccttagtatttacccaaaggagttgaaaactgacatccacacaaaaacctgcacataaatgtttacgtctttattcataattgccaaaatttggaggcaactaagatgtattttagtaggtgaatgactaaataaactgtgctacatctggaccctggaatattacttagccttggaaagaaatgagctatcaagccatgaaaaagcatggagcaaacttaaatgcatatgaccaagtaaaagaagccaatctgaaaagactgcgtactgtgtgataccaactatatgacactctggaattgactatgaaaagagtaaaaagatcattggttaccaggacctgggggaaggagtgatgaataggcagagcacttaagatgtttagggccatgaaaattctctgtatggtacagaaatgatgaatacatgccattatacatttgtccaaacccatagaatgagtaacacctagagagagccctaatgtaaactatgggctatgagtgattataatgtgtcaatgtaagttaatgagttgtaacagttgtagcacactggtgggcatgcgggtaatgaaggaggttatgcatgtgtaggggtgggactatatggaaatctgtatgccgcctaaatttttttgtgaacctaaaactgctctaaaaactagtttctttttaaaaattgcagtggtggtggtaacagcaatagccacagtaggagcaacagtagtatagttgctagttagtagtattcttttcttcataccttgtttctacctttgcaaaatcttcaaattccctgaagacacagtgctttcgatatgcctccatggtttttcacttttgtgctctttacttgaatggcttatcctactactcctacacccttctgccccagaaaaactcctcctcatccatattcaggtttgagatgacgcttcaacacccgtatgacgctgtcttcaactctcccaggtggactttggaatttcttcctgcggactcccactgcctccttcctcagacttccacagtgatctcattgtaccacaattgtttgcaggcctgtttccatgaggagacccgctggatttcttcattgctttgaatacagtgaatgactgcattaatgatgttgcagtatcaatggagaaacatacaaagatatacacaattagtgaaggacagaataatttcttatgtgcaagcttgctgcctatcttttgaagactggcccaagttctggtacttccatgaagtttttcctgacacctccaggcctcacctgtgctactgctgataacatcctgaatggcacttgaaaatacattatcctatttcattctttggttatttcagtttgaatgctgttttcccaacaagacagaaaatcccttaagaataaggatcaccttacatttcatacaatcttatatgctgttgggtatatttcataggtgtgtgtatgtatactatatataaatacatatatgtatatacatgcaaatatacaaatatatgcatatttatatgtatatatgtatattttatgtatatttgaatattttatatgtatatttgtatgtatatatgtatatttgtatgtatatatacataatcatgttataaatacatataattatgtgtgtgtgtgtgtgtgtatatatatatgtgtatatatatatatatatatatacacacacacacacacacacacacacataatctgttcctcgaggcaccagaacagtaacaggcatgtggtctcctcaaggcaacagaatactgactgctattatcattatgccaggacagttctggataacggtgctgaaactattaacttggaattttatagctacaagaaaaagttcagttggaatatccagagctatactatggatacataagcatagtgattttccaacaatcacaattaataaccttcagcatagtattgatatttgcaggaattctctttccataagaaatagtttaaaaacacaagaaagcaaaccttaggtaggaatgggtgaggacaatgtttctgtccttcacttcttccttttcttttttttttttttatcccctgtctgtcaccatccttgcctctggttttggtagaaagttcagaaatttaaaccaaggcttttatcctactgcagagaattctcaatctctctgtctgtgattgctttaaagatgtgaagtcttcgtccctacctacgtagtagctcactggactcttgccctctcagataaccccagtgtctcctgttccacctattgatgaaatataaagaggttttataggacacactctaaaggtcctcccacaataattaaacaccaagaatagtctttcttaatctaagtgcaagtgtatacttgttttgcaacatctctccccatatccccaaccccatatacacagtctgcacaagctgggatggaatggtagttttatggagagccgggacttttggtaagaagaaaataacttccaggtggttgattaccgcctagaaaaattttccctactgaccttgacactgttagttccttcctgtgcttactggcaaaatctcttccttcccacctgatagtccaagttttctatttactccttccatgcccatgtgtgagggatatccaagagcaaaaggaagcacatgagtggtccatgtgataccaagtgcgttgaggtgaacaggtggggaatcaatcagtaatcaagtacttttaaatacgtgttacgtgttcatcctgtttttagttggcatgatagctacagaacaatgagatacaatatcttgtcattaagaaaccaacacacagtattgaaaacctactggggccagtcactgccctttaggatttcagaggctgatggaaaagactccaagagaggtaaacacaggacgtacagaggaagggacaaaaacagtaaagaccaacactagatagaaaacagttcatcacttatgggtggccattcgtaagagagagaactgaggttcagggtggtcggggggcatcatggatgctgtggagtagacagttgattgtcagcaacccttgttagtaaagaaaggttttatagaaaaggtgcttttatttatttgtttatttatttatttattttgagacaaagtctcactatgtcagccaaactggagtgcagtggcgtgatgtgggctcactgcaacctctgcctcccgggttcaagtgattctcctgcctcagcctcctgagtaactgggactacaggcgtgcaccaccacacccggctaatttttgtatcttcagcagagatggggtttcactatgttggccagtctggtctcagactccagacctcaggcaatccacccgcctcttgacctccgaacaaagtgctgggattgcaggcatgagccaccgaacccagccagaaacggtgcttttaaaaatatggtcttttcacagccaagaagagctataatggcgtgaaaactaaatgtaacatactggatgggatccagggacagaaaaatagcattagttaaaaatctaaataaactatagactttagttaacaataatgtatcaatatggattaattgtaagaaatgtgccatactaacgttagctagcgataagagggaaactgggtacaggatgtatgggaagtctctatactacctgttcaatgtttctgtaaacctaaaactattctaaaaactaaagtcggttttaaaaaaagaagaagaagaagaagaagaaaatagtctagcatcctacagaatattcctggcatggggacatgagggagtcagtttgacagtgacccttttttgaaagaagtgactttgttgttaaatgccatgtttgtggcttgatcatcaattcctatagcaatgtggagttcttgcttgcttttccatggttgatttttggcaggcagtaacagcatttgtgcactgattataatttcgagatgcattgtcagtaaccaaggtgtataatggatcttcatctctaattgcttttctctccacaggtgcctggaaggggtccagatgggaatgcacacaacctccgctttgaagggatggagaggcagtacgcatccttacccaggtagatcacggagaggtctcccatctccagctcacctacaaatgaagtctttagagaagtctacatgaaatagaaattctggctttgaaatagggaatatgttataattttgccttgctgccgtctgctgtagccctagttccatcttcacaaatgtgctaataattgaaacacttgtgggttatttttaaggggagaaaatagtatatcattgcaattgaacgtgtcagcaagaacattggatactaaatggaaatcctaagccattgctataaaactggtatcgaacatcccgcaccaagcttagagacaatcaaatagtaaatcctctgtcctaggagttacgcacgaggaatggcgggccagtcttaagcttggagtttcatgtgggtgttaagaagcaggaaagaaatgtgaacttaggaaggtgttctttgcctgatttagaatctgaccttgttctcaaggcaataagcaaatattgctgagaggcacagacccaacgggggaaagaaacaactgcatgggaaaagtttgctgggccaccctggcctgacatgatccactcatactgtaactcaacacccttgaaaatgagatacaattctcaaaacttgtgctgttattggtgagatgaagaggaattttagtttgctatcagtagcacatgacaaagaaacagcttttccaagagtacatgcagtccagctacgattggagttaggtgaggtgagagtatgagaattaatgcatccaaaagagaaacaaagtaaggttaatgccacgcagaaagttgcagtgttttcaaatattgccttttaaaggggtgggggaaagaccccaagcagagtttttttatcaaaactgagctgttaaagtgccaactcagagatggagtgactgtttgacattgtatgttgactgtacctctgtgtgattttacaaaacaaacaccctgaacattacaatgggcaaagccaaagtgaccatctgcttttataaatagtatgttattttcaaaagtaataaaatctgaaatctagcagagaagctgttttgtcctgattaggcaggacacccaaaatacaatattttaaaacttttataaagttatattttatttatcttcctgttttcttttctttaatagatgttgtctaataagtttttcttatttgtgattagcttcctgtttctattttccttggcttagtacaactggccctcagtatctatgggtttcacatccatggattcgatcaatctcagatcgaaaatatccaagaaaacaaagacagtcacaatggtactgattatgtacaaactttttttccatgtcattattccctaaacagcacagtataacaactatttgcatagtctttacattgtactcagtattataagtaatctagggatgatataacgtgtatgggaagatgtgcataggttatatactaatacgattccattttatatcaaggacttgagcatctgtggattctggtatctgaggtcgggggctggggtgcgggaggtgcagtcctggaaccattcccccaaggaatggggaatcatccccaagggacagttacattttgtttcattttaaaaatggaggcagtttccaaaaatttgttttacatataagatttccggctttcactgttgaagtatatggaaattgtggttaaggcagatggaaaatagaatgttcttatgagagggagtaaaaaaaggaaaactggaaacagtttaaaatcttcctgaccaatctgcactcagagtgcagaaatggagtgtttgggtacaattcagaggcacagaaatagcatttaaaattctataaatttcactcattcattcattcattcaccttgtatctggtgatcacctagtatgtaccaggccctgagaatatggaaactggaggcacagtcccagtccatcctcaggactctactgttagcaaaggagtcaagcaaatcagccttttacagtagtacaaccaatgcttctgtttgtaattattaaagtcttctgaatttccaactcttgtttattttcgctaatccccgaaatactcactcatggctgactctaaacaagtatattttaggattaaacactgtggtgggggttttctgtcaaagataatacatttatgctgtttatggctctttatgaatgtatgaattgacaaaatcccgccagccccagaataaaactgtagctgaaagggaagcatctcaaactggaaataattctggcaaaaagttcactcacccacgtacacaatggtaagagcaattagttgcatgtgcaaacagacctttgcagctacctggcaaccagaggcagccatggtggagaataaatagggctcagataaatgcaagggggacccctggcagtggcttttaaatggggatgctgcatcccaacatctaaagaggagatgcaaagctccctcccaggcattgcaccctggtccatgggtggggggctccaaattaaactaatgagatgcagaaagcagaggccagagacgtactgctggcttctgaaaaggtatgcagatgctgctctgagtgccagtgacatttaccctggttttcttgtctttccccctggagattttgctgtccacttaattgaatcacgccagctccaccgctgtctccttttgccaggagagtgaggcgagcacatctcggtaggcaccggatccctcttcatcacagaggccgggagctttgaaatatttatggagttaaatttttaattaaaaacaggaataaatccatctgtaggaagtcggtggccaaccttatggagaacttaatatgctactgactgattgggttcctatgttgtttgtgcaatgcttcacagtagtttttaggaacaattcaataacattgatttctatgccaaatttggagccatcgacacagagagaaaatgctccacagcacatggagtaggtgaggagctctggtcaagtgctttcatggaactcggtcatctttaaagcaggcccatgcagcccactgccaggctaaatgacatttcacgaaataaagccagagcgctggccagcacaggaaaaagacaattcccagcacttggtagttatgaggttgcctaaggctaagggctaagccatgttaagtgttattgttaagcaatgttaaatctcctgcctcctaagaaaaatgactttacttcttttctcctgagggtgctgttttggaaagcggagtgtggttgtaatacaacctcgttagtaaacaccagacctgtaccagggccaatgttttaccagcctcaacagcccccagttttcttggtagtaaacagaatgaaatcagcattcctttattcttgcctgacaccctaggtgagtagggaagtggctgtttcctaggctgctatgatgtgcgaacatcaacgtatgtgtttttgcaaacggctcctttttcactccagcctgccagccgctcgcaattctcccaggtcccattctgatttcgcaggcctccttgtggtcagtcccttcagcactgaactctccactcttcccatctcaagcctccatcattcccacctggcccatccctggccccatgggatcccattatccccctctctgcagatggctctgtgcatcggcgcatgatattgctcttccggacttagaatcaagtgtggagtcctagggagtgagcaaaaggcactgcagctcttctgtggtcctacatgcgtgggcggcaaaaggttgctggagagactcgtaaaactgcattcatgggttccactacaagattcacattatgcagcaccagctgggtcccttgctgccgtccagctttttttgtagtcatgttgtcaactcccctgactatcccacagtggccattccaaccctttctactcccgttaagttctacgaagatgactaaactccccaagcccagtctctggaggtgatctcacttcctttgctttatgaccttgaggcattcaacgttagcccctcaacttctgctcctgcagctcagagtcctgcatcttagctcacacacgcttcccaaggggatgcactgagggcctgagctcggagtcaggccatgattatagccccagtttcatcacttaccacctgtgtggccttgggcagtgatggaattgcttcaggctctgttttctaatctgcaaattggggatgatattagagcctcggtaatagtgccggtatgagtattaaatacaataatacaagcaaaaccctcagcgaagagcctgtgtagtgcattgaaggattttttattgttagctctttttttattttatctcaggggaagaaatgtgccttcctgtaatgaggcaaacccacacaccagagctcattttccctggcttcttggggaccttgagccaccaactaccctctctcggcagcatctttaatccttttggcgttgctttcctccccctgcctactatcatagatgcacaacttcaggggcacagtttgccaggatcccccactgtgtggagaagaggaagcagcacctgcatggggatatgctgggggaactcactgaagctgaaggattcgccgactcaggaaagaccagtggtctggatggtcaagtgcaagagaacatagcaatctactgtgatctgagtgataagctgagctaatggacatgatagtagacagcagtgctatggagagggggtttataacagatacagcatgctgacttggctctaggcaagaggccagggctcctgtccagcaagacttgggtgcaggagtaggcattgctccagtggtagaggccatacccagggcgagttaaccaggaaggtggagcatgatgctctagctcccagggcagacatggcatgacagcagcaccctattcgcaggtgggagagatccagagatactgctaagatactcctattatctcaggaccgggcagtgctgaacatgcaactaccagacttatacctgagcaggactcgtgtggcaggtctaccccattaaattgactcttgtatgtcagagaaaaacaaagacccttggctcaaccctccttttcccacatttcctaagaaaaagtgggctatacctgttggttctatttccactcaacccactcacactatagcctcttgccccaggcttctgcccacaccactgatacttccaccagactctgcttcccgccttttgctccacatggattctctctgtgccgtctcctccattcctgccaattcaatgcccgtctctatgatgattccaaaagtacctgcctaacattcatgtcccactcttgtgaccccgtttgatatactcctccttctgcctccaagacgcctccaagtccccctgccaaaacccatgccatcttcctttgctcttcttcttttaaacttccatagcatttacttagcaccttcccagtgccctaaaaacaccctgaattggattattctccactgcccctttccaccccattgaaatataaattccttgaaataagagactttgttttatacccatcatttgttacacccagaacctaacataaggccatgtatacagtagagtcttaatacattgctatacagatgagaatagtttttttggtttttgttttgtttcctctacccaggtggaggcctaagtatgggctccaccactggagcaatacctactcctgcacccaagtgttgctggatggtctgatctcatctgttgcccacgttggagtacagtggtacaatctcagctcactgcaacgtctgcctcccaggctcaagcattttccatcctcagcctccagagtagctgggactacaggcacgcaccacgatgcccagctaaattttgcatttttttgtaaagacaaggttttgccaagttgcccaggctggtctcgaactcctgagcttaaacaatcagcttgcctcagcctcccaaagtgccgggattataggcatgagccactatacctagccaagaatagattttctttatatacaaggaagttatgggaaagaaatcccccaaagcttttttgacagttggttttagattgctgttttgcaatataagaaatgatttttcatgaggatgtatcttttctctgaaatcaatagaagtccagacttttttttttttttttttttgagacagagtctcactctgttgcccaggctggagtgcagtggtgtgatctcggctcaccgcaacttccgcctcccaagttcaagcgattctcctgcctcagcctcccaagtagctaggattacaggcacgcaccaccatgcccggctaatttttgtatttttagtagagacgaggtttcaccatgttggccagggtggtcttgaacttctgacctcaagtgatccacccgtcttggcctcccaaagtgctaggattacaggcgtgagccaccgcacccagcccagatttctaaatagttcatccctagtgagcacttactatgtacaagacacagttctaaatgctttgcatctcctgactgacaatgctcacagcaaccctgtgactcagcagcaacctgataattatccccatttcatagggaaggtcacacgcagagagaggttaaataaacttgcccaagtccaacagctaaaatgtggcagagctgggtttttaacccaaacagtctggctgcgagtttgttcattttaaccaccttgactaaggttatgaagctcagagtttaatccatactctgcacctatcatattctgttatttgctcacctgtttgtatttcttactaaaatataagtgcctttaaggacagggactgtgtcttcttcatctttgtatatgacacagaacattcctaatatacaggttaagtaatgcctttcaaccgtctctgtaatgctgtcataaaaatcaattcttttttccgttcccttgggccctttgtttgaaatatgaacagtttagtgtgtaattgctagatgaacattaagcaatatactttgcctaccaaaaagagaatcctgttagaacactcctgagagttgaaaaaacagtgtctgcaaattggtactgtagttccttaagattagaaataatatctccctggaagaaaaaaggtgacagtaaatttcctggtggagtgctgcatgagcagtcctgtggagagaaagactccctttcctgaggctgatgagggacaaaggcctgcttgggccacgttcgcctccagtccttgatgtttctgtaatccatgttacataagttacttgggagaaaaaaaggtctctctgaatatctcaagcagctttcaacttggctgcgcaatgggaagcaatatactggagctgagtgtggatagaaagagcaactttagaaggagcaagcagctaatgcttgcttcctaggaacccataatgaatttgctttctaagtacattcccggtgtttccgcattgggtacgattgtgttcgtttcagaagaaatacgccataagagcatgcttccactttaatgtttcagttggttcattttattggtctcagtcttctcgtctacttatgcccatcaggaagagtccaatcacaagtgcgcaggtaactttgaaacttgcaacaagcatgctgtctactatctttggttatcccaaaagtattttgtctgggtgtcctcaacatccttttctgtcatttacctcacttcttaaagatgctctccctctcagatttctcttgttctcttctacaatgaacttctgcttcattcactgttactgaattttcctttgccggcattgcactattttattgtgctcactaagtcactggcggtgacattcaagttctgcagatttccagcaatgccacagtactgggcgttggctgaagctaatctagatagtaatccaaagagttcaatgaaaagttgagaatcagaacattaggtaaacaggtgtgtgagtgcttgtctgggtgtgggtagaggtttgactgtctgggtctgtaaaagctgacaaagtctccatgctgcccaacttctctgtacaacaagtacttctctgtgcgacaaggccagcttgtcaaataagatgcttcatgagcatatatgtactgctccccgcagtcatgccggcggttggaatgttctaccagagtttgagggtgtcacacttcatttattaatagacactgtgaatcatggccagtggctttgacacttccctggtggtgcaaccctatccgaagaaccttcctcactgtgaaaagctaccttgcagtgtttgtccctaagattgctgctctgactttgcaggaatactaagatgagctgaagaacttgtctaggtcatatcttccacatctgcatatgacggggtttactgccttttgaaaatcagtgaagctcttttaccccaccaaattaagctttttcatcctttctcttaaggttccctgtgctgaaaatctagtctctacttccccttcccagtaggatcagctgtctgtttgaatggccccctgataccacctcagtcttaaggccaaggacaaaatgatgaattagcagcgatttaattctttgtgagattaagatgtctccattgtcaactcaaacttcctgaaaatgcagaaagccccagcatgtaatatcactttaagatgccaaacagctgagatcagggggttaatgctactgccacctcatttttatgtcacttagttcctcagataaaagtccattttaatcaaacttttcatcatttcctcgtagccaatatatccttgatgccagttagaatatttgatattaattattcagtcaaaggcctccattatgagtttagttagaatattagtgatttaaaacatgttaagactcatacagtagtgatgtccccaaagtagttttaactgaatcttgatgaaccacatacattaaattctataggttttttactttttccctcattttccatagaaaattccaaactgctacacatttgttggctaagtactcttttgagaggaagagtatgtgcctgctctttcgagagtgccaaatctgacattaccttggacatgaaatctattaagcttggtaagctgacttgcatgttttccctcctgcacatattaaagggaattttagcatttatttcctacttctccagccaaaagaaaagaaggttgttttgtgcctaggcatctgcttagagtattgctctatatctcatttctcataatctttggtagttcttgatgttttcctatcttattgccattccaccatctgcctcctaatgctcattgccctggaattatggtggtgattttcttgataatgctgtaccgttttgcatgatgcacactgtctttctgcacctacctcctcctgtcttctctgactccagccatttgcactgtcccttgattcaagttcctgggtttgctgtgtataggtatcttagtatcaacctactatagacagagacattatgaataaatgaagtgtattaatttattataacatctgatttgtatgtttgtgaggcctgtgctttatgattatttaaaatgacattatatcactgaaatacataaccatcttggataaaaagttagtgcctcaccaaatgcatgaatacatgatattattcaacaggagtaattaacagtaaaatcactagtcttattttccatttttatataccaagatctgcatgcaaattgtttcaaagatgtcatgtttattcctaaactagttgattgtatttaaatagaaaataaaactaagaacaatcaaggcaagggagaggttgtaaaacctattgcgtgccttctatgtctgtacgttttgcatgccttgtctcattttatcctcactgtccagctggctaggagtcatatgatgctcctttaataaaagaaaaaaatgtatccttgaagtcacagaatcagaatcagaattcaaacccaggactctctggtttccaaggcctttttaatttcacttgaccccacatgactaacattggcaagtcaaggagaggttggaatgcttacatcatctgttttcataagtaatgtgagttcatgagatgggagatatcttagaccatatgaagaatagcccatgttcattgtgaacatcttttaaggttccagagaaaatagaaaatgtcaaaacctacgggttgtaaaaaaaaaaagtaataaaatacaagaaaatagtagggaatttatgggaaataaagaaaaacacttttgaatcacacactttttcttcttttatcactgtaagttttcccaaagtagaaacaagatacctgccttttccttacaattaccctgttcctgttgggaacatacacagagatgtgagtggcgccccctagggctgcacagaccatgtgcatggaccaggtccccagcccctagattgcactctgcaccactcctccacagaacactcagaacaaggcaaggggaaggagttaacatttgttgagcccgtattgtgctccaagaactctggcaagtactttaaatatgtcacctcatttatttcctgtaacaatcctgatataaatattatcatccctattttatggatgaagaaactgagactgggagatgcaaacaggtgtggctaagattgcacacagaactagtgacaggttttggagtcagttcagtattttctgcatctgaaatttctgggctttctgcagcatcaaggtgtctggtactaggctggttgtaaacaggtaggagagacacattacgtgaccatcctttcctgaggcagccctcactgctctgatcccaccctaaatcactgcagtgtatattaaaatgagcatttcaatggataaaccccttataggctttcagaatgactaagaacagcaaccactgaatcacagaactcctcttagcaaattcaaacacccacttccttccagccaaaatattttaaatggtgcttttttgcttaaagactgcctctgtgttatgctagtgagttaaatatatatacatataaaccagttggttccacttcagcaatttttgtagccaggaaactattgttggttctttcacagtgtagttctggcacatccttaggggacatggctgagacgcaaatgccagacaactgcggaagcatcgcttctactgactctgctgcttcaagtccagagaagagagctttggcagtcagttactatggtggtgccacccgagcccatctgtgccctggatctcatgtgacacaggccccacgacctcgatcattctgccaagaaacaccttggtccagctccattatttccagcaaaggcaaacatttgtggtacaaatgtgagaggggttggtacaaaaacagcagcctccagaacgtgttcctgcttctattccaagtctctcattaagcctagacagaagtgaccagggcttgtctcaccagagggttgccccactctgcaatcagaactgacccttatggccgaacatggaatgacatgttaaataggtaggaacctggcaattctcacgcgccattctccaccaacagtacactctgggacatcattagtaccctttcaacttggtcattgcttgaaagtgaagacagagtggtgactgcccagataagacttctgcccactaactgcttacatgtggctgaggcaaacacagacccttttccagaaatgatagtgtctgacagcccgggttttacaaggcactggaaagatctataattgttacagcagaggtttaagatggaaaataagcatgttgagctatttggagaaggaatttgccacagtgaagtttttttcctggaaacagtcatataaaatcaggatggagttggtatcaagcttcttggtcactttccattgatatgtcggtgcctttgacaatttatgttaaatgtgcaacaaacacccttttacagctttgtccaacatcaaaatcaggtccatatataagacagtttctagccagtgttttataggagtgatttctggatgtggtatctgtaatgtggccaagataatgtgaagactctgccttctgtgggtcggttatagacaagtcacttatgttaccatcttgtcaacaacttgaattcctcagtttgtcctttttctggttacttctttcttatccaattttttaaaaaatgaaacagttcagtcagagcaatgtgtgcaacttattagcctgaacagatgagctaggaaagtcatctactctccatattcctgcatttaacaactatttattcatgacctactaagtgcaatacactctgtaggccctgaggatagcgtgataagccccatagacacagtttctgtcctgtgaagtttatactctagtggagaagatagtaattcagcagtcacaaagaaaacataaaattgtaactctgcccattacaaaaaaaaaaaaaaaaaggagagatatgtgatccaagaaaatagaatgtgaaattgcaccaaatcaagaagggagggagacatgagttatgatctgaaggaggtttaagacaataaataaggaatattccagaaagagaacagcacacgcagaggccttgtgtaggagaacacgtaatgaacagactgaaagaaaggtgtgtgactggaacaaagactgtgggagttgagcaggaaagggaggtagcagtcagaccatgagtggtcaagtgaaggacatctgaacttactcaaagactagaaacctttgcggggttttaagcagaaagatgatatggttggatttgtgatccagaatgtttgtctagctgcaaggtagagaattgttaggagagatgctggagtgaagcagaccagttagaggattttgctgtcattccagggacagatgttgatagtatgtaccagggtgatggtgatgaaagcagaatcggagagaagtgggaggagctgatgaaccttgatgatggattgcatgtgggggtttgaagggtaagtgaagccaggtgttaagaatggatccacacacagcagcatgggtgctggtcccacttcccaggagacaaggcaaagagaggactaggtttggcagggagagatcatggttaagctttgggacatgttagatttgaggtacctttcagacttccaaaaggagaccactgaaatgtgccctagagatgtctcgacatggatgggaattgcaatggctgatccaggatattaagcaaatgtgtattcatgaaaactgagcaaaagaccccagggcatatcaggggtgatgatgtaataaaccacagagtcgcatactcagaaagtacaaataaaggcaggtcgacagtgcagactgcaaaaacctgggcatccttctgtggctgtgacatgccttcactgcttagatcgacagcaaaggcttatctatcactgtctttgtaatttcattctggaaataatatttttctcaagtaggaagaattggtgacttaatgtcatctggcattctgtgactaagcgtagctctgactccatgaagcataaggatgagggtaagaagaaacggtggaaactgttttgatatctgtactgagcttataaaacagaataaatttgttcagaaatatgcactaaaatattaaagggtaaagaggaacaagtatccaatttactctcaaatggctcaggaagtatcagtgtgtatatttaataatatgtatgtatgtatagagagagaaagagggaggatagagaggaagggaacagaatggaaaaaaataatgaatgggacaaaatgtaaagaattgatgaatttggataaagaatatagaacattccttgttttttttttttttttttttttttttttgagatggagtcttgctctgtcgcccaggatggagtgcagtggcacgatctcggctcactgcaagctccgcctcccaggttcacaccattctcctgcctcagcctcccaagtagctgggactacaggtgcctgccaccatgcccggttaattttttttttttttgtatttttagtggagacagggtttcaccatgttagccaggatggtctcgatctcctgacctcatgatccacccgcctcggcctcccaaagtgctgggattacaggcatgagccaccgcgcccggcctgtactagtgttgtactagcaataacagtaacaaggaatagtggacattctcataattttccagtatcaattcaaaagtttaaaaagtcctcattttggtgtcctaggcagggcttctccccacccccgagaagaagactctgagacagggatttgagagcaagtgattttatttgagaagcgatcccaggaagcattggaagcggagtgaggaaggaaaaggaagaaagccagtacagagcacattaatgaacagattaccactgcaggcaagagggaaggagggctggggtcttctggagatggtagggaagacactcacaccttgccccacctgggggcaagcatgttgaggtacttaacttttggtcccatttgtcattggttaagagttgttcctaagatatcaactccccagcacttcttcctgtccagtgcactggtaacagaagcctcaagccaggcagcacagatgcttggataaggaccgtagtggacagaagtgctgcagtgatgggggtgtgggggcagtctgctgccacaactaaggaagtgtgaaggctcagggttcaaagcagatcagttgtggttgcctttcgtgagagaaaacatatgagattagtaagatgccccagacaatcctgatgccttcactttattattggagtaggtgctctgtgaattggtcatgtcttgtacggaacacagtgaatgccaatagcaccaacagagcaacccaagagaataactctagaagaagatacttccagtttctctttgtttcactcaaatatgcaatacatcaaaatgatgtaaggtctttgacaagttcattttctgtcaagcccatgctcagaacatcactgaaatacagcagcacctctgggacactcctgggattaggaaagcctctggaaaaattaaacttggtactgagttgcctgactcaaaaatgcccattaatgaacaatgatggtttgagtgtgtgctgtggctttacctaggatcgtggctatacacacaggcgaggtaaagttctacatggatttcaacatgtcatctttgcttcaattatgaacaataaaaacttggccaaactcagggattcgtcagatggccctggtcgtgtgtcttccatggtctccacagtctcaccttagcctcaggccttcatgctaagacactagcgctgtatctatgaagcctgtaaaactggatcagtcacatccagttcaattaagatgcttaggctcaccttcttagaacaaaaagtatgtgtcataagtcaaacaggctacaggataaattcctagcatgtaattaccaggtcaaagaatgtgaatatttttaaagtttctgatgtatattgccagattgacctccaaaaaggttgtaccaatttacacccccaccagcactgactataaatcatttttgaaaacctatgtcaatttaataggttaaaaagtaacgattatgatcacaaactgttttaatttgtaattcgtttactctcagcgaggtttaatttttctcatgtttattagaatcctttttttttttagtttgttgtagcttatctgtttgcatgtcatttctgtctaggtgtttatctctgtcttcttgatttcctagagcccttcatatattaagggcattaacactttgacatatttaaaattattttagtttaacttaagctatctttatggtaatataaatctataatttttatatgttaaatctttcatcttttgccttataattttttgcttttatatgcaaaaggttatctctcattatgaaatatccatactttcttctaattatttgattattttggcacttctacagcaggaatgctttgaacatccatgtcattttaagtagtaatgtgattttgtaatatagtttcaagcaatatcaactgactgtgatattgttataactaaaaaacacatggtggtctagacacccatgctgaatggctttagacaaatattgtggaagatgtctgtgtagttcattggcacatgtcaaccagaatcaatttacatcttgctctcactgatattatgccctatgtcaggatactaagtgtcctgaagcattctgacctgtgttcttggaatgtgatacaacaccaggtattcagtgttctgggaatagtcaagatcatccaattgggcttttttctcaaaatggtacttcttcttgcaaaatatatgctcttctccttgatgctctgccagctgctggaagcctctgccgtgttagcaaggcatgcctgttgaactgacacacacacccctcatctcctagagcatgccttcctgtgttcctcagatctaggtgatcagaactctaagcatgctcctcagagaaaccatgtataacattgggagttgccttttaatttctatgataaaaagatgcagttttgctggaaggagacttgtcctgagattgtgtgtcaatttggctaagccgaaaggaactatgagaggagcggttcttaatctgggatctgtgcatatctaaattgacagtgattagtttcaagggaccctcaaattctctgaagttacatgccagtttatgaataatattttgtacatattcctgggggaaagggtgagtgagaattttgtaacccaataaaatgaaaactgactgaattaagggattcactgtaaacccttcttaaaggggtcattttttaaatcctcacattatagttcctatgtgactggtattttcttcacagaatagcaatgccttcacagagattatttcattcgtaaaaacttatgagaagaaaatacccatacagtagtttattgtgtgaagggtatcttcaatatcagagtgaatttaatagttttcgcaagaaaccttattatggtctaactttcagctccacacagcacagtgtgtatatatatttccattctggatgctgccttttggtctgcttttaaagagaacaaaaccttcccagcatagaaatcccacaaagcaggttgaatggcatcaaactcatcctcctcgctcccacccattgcaccacaatgtgaaatacagaacctggttaagctttagagaccagacgtatgtgttcacccgtgctacctaaagaaggatttacacattctgctatcttcccagctttggaaaaataacatcctgttctcatccgcagaaagtagagagggagaggaggcactcgtgagaataagcagacaacaaccttcatcacagccaaaagtactatgctgatcccaccataaattatagcagcataaaaccacaggaaatccaaaggaagtaaaatattaatattaaaccatagccactccaccatatataatttagataaataatccattttctatatgtaggatattggaatatagctgttcgtctgccactagcaacagttgatatttgaaaagcatagagactttagctgctggtggagggcaaatgtgttttattcattcttattcttaacagccaaatgtcctcaaataaaatactgatcaatggctaaaaatttaaaggccgctatatctttgtctcataatatggatttgtggcctaatctagccctttcttgacctttttgcctaatggtgggatattaataagcgaaagatggttacataaaacatcctctgcatgtgaaattttttttacatatgagtaacttcaggtggctgaagatggaatgagctaacctgaaagtaacaagctgctcactgtcttggccaaattaggcttaatgctgaaaggcattcttacttaagaagtcaagaaggccgggggtcaagccgtcaggccacggagtgcagctgttggaccaccttttgcagtctccaagggagcaagcaaagaaaatccagcaaagaaaatatctcaaagaatcaacagggagagtaaaacaaaaataaccagatgtcccagaagactctgttggtattatgaagaaggctagagcaggactaacagggtttggcttttatcaaccttactaataaaagtcacttggctctccatcgagaagagcagttggtacaatatggaaaggttttaaagaccattaatttcttgaaatgaaacagctggccttattggctattaaataatgagccagattctccccagtgcctaagtcactctctggcagtaaattaggcatttagggaggcacattaactctttaagaagattagagttcgatttagtgcactttatgcataggaagaaagttacagggaatctggctgaagctgggcagagaaaagatggagacaaggtagactcagatgaaagaaactaaacacatgatttgtgttaactgggcagctcaggtgagcatgggaaattggagcagtcgagctgtggagttattttgtttattgttctgaagttctatgagcatgaaggtagagagttgagtcttcatttattgattcattcattcagtaaacttttacataaatactactatatagccagcactgaggaagtattcttccataaaacacagttcttatctctagggattttcagtctctggtaccttgggaagagagtagaagaatgacaaattatagattatttcagtcaagtagaataagtgctaaaattttatatgcataaatggaatttgaagaagtggcaagatgtgtagcactttatacaacacgctagggactttgactctacccagaaggcctcaggcccttgaaggtgtttaaagaaagaaatggtttaatcagatttgcactgtagagaaagccccttgataatttcatggaaaataaattggagagacaggccgggtgcggtggtgcacgcctgtaatcccagcactttgggaggccaaggcaggcggattgcctgagctcaggagtttgagaccaccccaaacaacatggtgaaacctcatctctactaaaatacaaaaaattagccgggcatagtggtgggcacctgtagtcccagttactcgggaggctgagggaggagaattgcttgaacccagaaggtggaggttgcagtgagctgagatcatgccattgcactccagcctggacaacagagggagaaccccatctcctaaataaataaattggagagacaagactacaatcaggaagggcattgtgaaactgtttatgtggtccctacaaaagatgctgaaagcctgaaatgaggacataagtgggtgtattagtccattttcatgctgctaataaaataatacccaagactgggtaatttataaaggaaagaggtttaattgactcacagttcagcatggctagggaggcctcaggaaacttacagtcatggtagaggggaagcaaacagatccttcttcacatggcagcagcaagaagtgaagagcgaagcaggagaaaagccccttataaaaccatcagatctcatgagaactcactcactatcacaagaacagcacggaggtaaccacccccatgattcgactacctcccaccggttccctaccatgacgtggggattatggaaactatagttcaagatgagatttgggtggggacatacaaccaagccatatcagtggggaagggcaggaagggaagagaggcctgtgaaggagctgagctgacctgtttgatgcctgattagatgtgggcatcaagagaaagactggtgccagagaaaactctggagccaggctggaacaactgggtggctggaggtgccattctcctcatagatgaggaaggatgggtgtaaggctgggtggaaaggcagagtggtgacaattctgggctccagagcatggttccaatggatggcacatagagaactcaaagtcatccatggcaaccacctcatgagatttgaaaagtatgtatgaaaaggaaactgagattttaagactacataattcctagaatttaaactgaatccttggaagagtattttgctttgtttgatttttgtgccaaaggaaaagatttcaaagatgcaggtgcctccaaactgaggttctatcattgatcaccatcaagagtattaaattgatgggaaacaaactggaaatagtcatctctttaaaaagccaacttttttttacaaggaatatctatagttaataaaacatcgatcattgatatgaatatcaggaaatttatactctttgtgagaagtagaaaactgcacaggttgcagactagacaagttaacagttctttctctgtcggcacttaaaatccataccgtggcttctctctatggtatggagtgaaacgtgccaacaaattgacttagatgatgtcagtatctgaaaatatggaagaaattatatattggaggaaaaagaagaaatccttatatattaaaaggtgttgacagcttcaccgcagaatagcaaaaatgtccttaaagataaaacacttatttcaaaattttagaaaccacaattacagttttatatactatgtgcagcaaaagtcatttttagaaagaacattgaaatcaaagtttactaaaccagtaaccttgtggcaacttcctggtgagaacctcattcttcaggaatgtgaaaagcataaaattaaaagagtcgaaagtttgtagattgcctaaacataatttaccacaggcagacaacgaacaagacaaaacatgtcacttaatattatttgcaagtcaagatgtcatcctggtgccagttgcatcatggtttcaggaagagatttccaggtagatggccatgaactatgccatctatgctacgccatctgtgtggctatgcccatgtaagcattgttatccacgggctgcagctggacgtgtttgttaacaggtttccaccatacaccatagtgacaatggctcctctagaataattccggaaagatctataccaacagcgcttgtttgtgtcatttctagcagtaaaacccccgttttctagcatttacaggaatcaataaagactcactgacttagcactccagtgggggggcaacttcacttcattgtaacatgctgcctgaacatttagcaggagacaaagcccttcccttcacagttaaagagttcaaaaatgagaattcctgggctaagatgcatgtgagaatatcttattcttttctgtgttgacaaggagatggggaaagaaggtaaggagacatggggacttatagaagctgcaatggggaagtcactgaggagtaaaaaaaaaaaaaaaaaagaaagaaagaaagaagtcataccaaagacagaatttacagactagaagcctacaagctgtggcttcatctgtcctccacagaaaggttcatcgtatcctttgtcagggacccatctcataagctcccttactggatgaggagagaaagccattgctctagcaaagcaaggcatgatccacatcaaaatacattatatacacatttaaatagacacacacacacacacacacacacacacacgcgtacactatatataaaaatatattttcatgtaaggtatatatatattatacacacacatatatatcatatatatacaatatagatagatacacatacacactgtttttagtgcagtttcaggttcacaccaaattttagaggaaggtacacagatttctcataaacctgccacctcaacacatgcgtaacttccctcattaccaacattcccaactgcagtggtaaaactgttacatctgatgaccctgcattgacacatcataatcacccaaagcccatagtttacattagcgctctctcggtgttgttcattctgtgggtttggacaagtgtataatgacatgtatgtatcattatagtatcatgcaaagtgtttttactgccctaaaaatcttaagtgctcttcctagtcataccccactccacaccattacccctagctactattgatctttttgctgtcttcatagttctaacttttagtatgtcatatgcttggaatcacacagtatgtagccttttcagattggcttctttcactttataatatgcatttaagtttcctccatgctttttcatggcttgatagctcatttctttctaaggctgaataatattccagtgtttggttgtggcacagttgattcattcacttactaaaggacatcttggttgcctccaggttttgaccattatgaataaagatgctgtaaacgtgtatgggcaggttttcttgtggacataagttttcagctcttttgggtaaataccaaggaacatgactgctggatcaagtggcgagacaatgtttagttttgcaggaaagcaccaaactatcttccaaagtggctgtaccattttgaattcccacaagcaatgagtgagagttcctgttgctccacatccttgtcagcatttggtgttgtcagtatttctaattgtggccatcctaataggtatgtagtagtatttcattgttgttttaatttgcatttccttgatgacgtatgatgcagagtatcttttcatatactgatttgccatgtgtatatcttctttgatgaggtgtctgttaaggtctttggcccattttgtaattgagtttgttttcttactgttgagttttcacattctatgtatattttgataacagtcctttaacagatgtgtcttttgcaaatattttctgccaattggtggcttttttttttttcatggattgtgactttgatgtatctaaaaagtcatcaccatgcccaaggtcatctaggttttctcctattttatcttctaggagttttatggtttcacattttaaatttagatctgtgagtcattttgagttaatttttgtgaagggcataaggtctgtgtctagattcattttttgcatgtggatgtccagttgttccagcatcctttgttgaaaagacgatctcttctccattgtattgcctttggtgctttgtcaaaggtcagttgactatgctaaaatgggtctacttccggacttcctattctgttccattgatctctttgtctattctttcaccaataccacagtgtcatgattagtgtagctttatagtaaatcttaaagttggctattatcggttctctaagtttattcttctccttcaatatttggtttactcttcttggtcttttccctctgcatataaactttagcatcagtttgtaaatatccaaaaaagactttctctgtttttgattgggattgcattgaatctgtagatcaagttgggaagaactgacatcttgagagtattgagtcttccatccataaacatggaatgtctctccatttatttaggtcttctttgatttctttcatcagaatttcgtaattttccttagatgttataaatattttgttagctttatacctaagtatttcatttttgaggggggcttatataaatggtattgtgtttctaattttaattgcacttgttcattaccagtgtatacgaaaatgattgacttttgtatattaattttgtcttctgcaaccttgctataattgcttattaattccaggagggttttttgtgtgtgtgtcagttctttcagattttctacctagatgatcatgtcacctgcaaatgaagacagtttttttttctttccaatctgtataccttctatttctttttcttgtcttagtgcattaactaggacttgagtatattttttagtatcctgtttgctgtttcaaaaaccaaccaaatgaaaacaatgtccatcagggccaagagaagcaagtgcttgaggaaaatattttccttcattttttaaccttaaaagtgtggtaggaaatgggaaaatactttaaataattcagaggatttgatgcactgcgggtgataggtgaattataaaagagaaagcaaatgtacatggattttatattcaaatcccatatgggccaaactacagaacaaaaaataaaaagcaaagactgaaagagtacatgggtaacatgtatttaactatttctcaaggatagcttaaaaatgaattacgcttggcaatgtttttttcttttcctgtgatgacaaagacagtaggaatatttttttaaagggatcttcacttaggttaacagtgtctccaagagtgttcaagtctccctgctctcatcagatggttcaatgcagttggtttttaaagctaccaaagtaacttcctgagtatttggcctgtcttgtggattgattcagaactacccattgctttccaaagaaagttgtttccgtattttatgaactcttctataacatttatttctggaacattgataagaatactgctgatggaaagcagtttaggctgcaggcatatacctaatttttctgctttgttggagtaaatatggagctcgcctcactggattggctctgtatcagtgtgtatccactctttagctacttgtagcctgtctctcaccagggatattcacaagggccctgctcattggcccctgagcaactactcttccactgataagctgcaacatctgccccaggaattgatttccccacagactccactcctctcactatcctctctttacattgacagtgttacgagtgcattagatcaggtaagcttctgtgtgtcaattccaaataacaatgtggtaactagagtttcattaatatcatgtcatccaaagcaagaggtttatatcccttgtcaataccatgaccatgcacatttaaagaacaagatcccccccaaaaaagaaagaccgttctcttgcacatgtttgtgacatttaagaagttacgacagacacatctataaccctacaatcaccttggcacctgtacagaaagctatagttaaattattggcgaagtacacaagcaaatgaaggtatatctactatgaaacataaataaaacatgtatccttacaagataaagtaatataagccagaatcataagaatgaatgataaaaatagaatcatgagaaaaaatggtatcaaggtattggtggtgtcaaaatggactggcccaaagccaacctttcaagctgaccatgatatatccagattttgctatcacataataattagtgatttaactgtatgaagtcaaaatctatgtcattattatatagattcttgcactgacacatcacgtcaaattatcttactttttctgttttttaaatgaattttaaactcatcttcccaatcagaaaaaaataagcttttcccaaccagaaagaataaggtaagggccgtctcttaaccttttctgcattctgcattctctgcagtacctagctagatagtaggtatttggtaaatatttgctttcaaaaaatgattataatgagctgttttaataaagtgtatccattgtaagaacacacgtaacataatgaacaaataattagcaaaacgtaaaaatgtaaatattcccataaaacagctttttgaagctgtaagaaaatatatttctcttcctagccttctaattgtttatttttgtgggccctgaagtctcttttcaaaaaagaaatgagaacggttgagcatctggattttgggaatcaaaatggtcgggggtggaggtgaggaatgtccgagttaaagaattaatagaaaaccctgagtggcccatttaaggaagaaaaaaggctattgtggcatcatcagcttttcctggctctctcatcctcatcctcatcctcagagatgaggtctcccctgtgacccagaggtacctttccagtatcagtttgagaattctaataaacaagctgaaggagcagagtccccaaaggggtgtctgtgccgacagggaaggcagctgcggttatgaaccagcacacaccagaggccggcaagctattgggactttgtgtgagtgggtgacagttttaatttcactccccagcagacgtggtatccagccagcagtacttcaaaccaattttgcaaatcacattttgtggctgaaaattggtttactgcactcgtcccattttggaggccaaccttgcctgatttaaggtggcgcctttgttgaggggggacagttaaaggattcccttttctctaattgaaacgacagcatattctttcacagattaatttcaactacctatgtttatatcctttaatcaggattataaaaacagcacagataattttctgcactattcttttttaatttttgagggagtaataatagccagttggctcttgacacgtattgccttatatagcagttttattccaagcaccctaccttggactgtgtatcattgtattcttaattatttttaaacttgattttttctcatatttaagtaacgggggaataaagtctaagtcatagatttcactgacattccttctgtgaacttaaagatgatacttgcataaagagatttgtcccttggattatatctcacactgaaataagggccttcttactggaagaaatatttcttaaaaatgagtacttgcaagaagtgttcatctgtgaacttttaccaattagaaatggctccatacttaagactctttaataatgtctcttaagcagcattttagctcatttttataacacattcaggtttggtgatttatattaaacattaaatgtaataaatttaggtcttttttcaagtatgacgcacagcatctctgaatcacccatttcagcagagggcccctggaaggtccaatctctcgctatcattcatgcttataataaaacgggcttctccggtctcttccttgacatcggtaataatgggaatgacatgtgagtggtgacactgttacaggagggcatgttgatattgcttcatggctgggactgagtgtccatgaccggagggtgggctgagaacacacatcaacaacttgctgtctcaaatctgcaccaaaagctatactaatgcctattttttaactatacaaaaattcaaggagtaagtttcagtgccttaaaaaaggtggctttgtatgtcttactctatatgactgcaggttttaaaagaattaatcacgaagaattgaacttggaaacatgaatggatctcttaatgatagtcatataagagagattttaaatcttcctctgtttcaaccattctaccaatggttgctgcattcttcacttggtgagtcatgagaaggcacgagacactaaaatgccttggaaaaaaagctgctctccttgatgaaacaataattagaatagccttctttagaactatcatgagaaatttcactataaattattctatttcatagtgacagtgacttacaatataaagtaagttttgactgcaatctgagtataaaataccaggatacttttgggaatatgtatctttaattcagaaaatgctcacatttcaagtatttgaataagattaagcattaactaatgctttcattaagatacctaagcatttatacccaaaagaaagggaattggtatatcaaagagatatctgccctcccacgtttattccagcactgttcacaatagccaagatttggaatctacctaagtgtctatcaacaaataaatggataaagagaatgtggggtggggagatatatatagatatatatagatatatatagatatagatagatagatatagatatatagatagatatagatagatagatagatcctgtcatttatatccctgtcatatacgtgtgtgtgtgtacgtgtgtgtacgtgtgtatgtatgtatatataaatatatataaatatatatataagtatatataaatatataaatatatataaatatatataaatatatatgacaggatcttattctttttatggctgaatattccacatggtgcacaaggatgcagaaacatagaataaataagatctagtatgtgacagcacaacagggtaactacagccaataatttagtatatatttttaaataactaaaacagtggaatcggaatgttcctaacacaaaggaatgataaatgcttgaggtggtggatacctcaattaccctgatacgatcattacacattgtatgtctgtatccaaacatcacatgtaccctataaatagatacatctactagtaaaaactaaaaatcaaaatttttaaaaagatacctaaatcatctaaaaactgtaattattttcttagaataaaaagatggtggaagtaggcataactccaattttcaggcacatgaaggttattgcctctgtggcaacgtttgtggatgggtttggagatggtccacagagcctggcagcagcttggttcccttggttcccagatggggagcctggtcctgctgtcttcatttctggttgacacttggaaatgactagatgaggagtcatgcattagccaacccaaatccatccctcatgcaatcagtcctcaatctcaaatgggcagtttctactggcctagaacttggggtacctttcctgtagaaatgatgcactatgcagtgagcaggttgcaaggcttgcacaaatctacttagctcatgtaagtgaagtaccgtccatgtgaaaatcatcttaaaaatatggttgctgtgggacatcggctaacacacctgccctggtgtgggcattctctacagttaatagactctggataattcctatcgtcttgcctttacgtactagagtctcataaaaaatgagaaataacgaacggaaacagaatgaagaaacattgcttttaagaataccattacaatgctggtaattaaagcagaaaaaaataaaattaagtaatcatgtttcatctattttaataattgtgcttgagaaaaagcaggttcaatcagagaaggatgaggaagtagctggaagctgtgtttgaggttctcaaggaggcatctggccactctccatgttgatgactttgattcctttgggaattttttttaaattctctagactagattattgccttttcctcaaatatttttggcagtgaaacacagaacaaatggaaccaagagcaacaaggaaggttattgttttttttttttttcctacgtgtctagggaagagtgagagaggcagggaaaggagattgggagctagtaaaggaagtggcattgcctccgataaaagtaactgaggagtttattagtgacacttatagggaagtggcctgctcaattcccttgccaactgatgcaggtgagggaaaaaaaagaagggatgaggaagagatatctgagcctacagttccctgtgacagctggggaaaagggcaccgaattcaggacagctcggtcattgaactggccattctcagagtagcagggaatgggtgcttatggcaggtggggggaagggtgtaaatatataacctaattgtatagaaatataagttaattgttacaaaagtgtatggaattggttgttcttgatttagggagattcaggttgttcttgatccaggacagaaaatgtgcaatatatgctctccgtggattcttttgtgaaatgaaaattagagcatagcaagtggttttgagtcttcatttaacaagtacgcaggcactgcctgtgttatcagcttgaaagtctgctaagaatggatgggagaaacagagcagttcacatttgctctttgaactcagagaactgatctgagtgcatggcaatgatgatggaaggaattaggaaacgctggaaatcatatgcaaagaaattagtcatctctctcctcctaagctctgtgtgtgtgtgtgtgtgtgtgtgcgcgcgcacgcgcgtgtgagagagagagagagagatgcacatactactctggattgccttgagaatagacatcatgatggtggtggtggtgatgaagaggatgaaagcagctgatagtcattgactgctcattgtgtgctaggcgctgttctaagcatgttatgtgtattcactcatttaatcctcaccacatccctattatgttggttccattatttatctatttcacagttgaagagtttcttaccaaattttaatccaatagtcccaaatgcaaccaaaatgaatcataccttttgtaaaatgatcttaaaaccatactcatttggacgaattggaacaaccattttgatacatagcaaaagatgctacggaggtctgccacaatctttaatctatttccttttcctgtcttacatccccctcttccacctcacctccagttctactggcctatcttctaactctgtctacacaacctgtgcctgtcacttccaaactgcccctcataaattgtaaaacagaaaggaaggggaggattttacacattctccttcattttgctgggaatttataaagagccatgttacccatgataactctaagacactacagggcattttcaaatattttatcttggaaacttgattttcgaagtatttaggaaaatgcttcaaagtcaaaaattacaagcagttaatcacaattggaaataattctttgtagatctgcactccaatatggtagccgcaacaacatggggctatcagacatttaaatgtgtctgaattatgatgtgctttaaatgtaaaatgcacaccaggtcccaagacttaatgccaaaagcaaaagaatattaaatataaattatttttatatggattacttgttgacattatcatactttggatatattgggttaagtaaaataaattattaaaattagttttacttttgaatgtggatacaagaaagttttaaattatgtatgcgaggccggacacgatagctcatgcttacaatcccagcactttaggaggccgaggcaggccgatcacctgacgtcaggagttcgagaccaggctggccaacatagcgaaaccccatccctactaaaaatacaaaaattagccgggtgtggtggcgggtgcctgtaatcccagctactcgggaggctgaggcaggagaatcgcttgaacccgggaggcagaggttgcagtgagccaagattgcaccactgcactgtagcctgggcaacagagcaaaactccatctcaaaaataaataaataaaaataaataaataaatgatatatgtggcttgcattattttctcctggggcagcaatgctgtagactgtcaaagaggctccatctataaatggtgatggtagcttctgttgaaccaccctgctgaaagtttgaagagctcatgttcagcctgagccttcttttttggaaaacacttttttccccttagattgtacataataccaggcacacctggatttctggataattgcacccacaagtggctacatgcagacacaattaggtgcttgcaacttgttgaaggcacaggtgtctaattgcgcccacaaatgaccgtttgacaggcaccactcattgtgcacacccgctgattatgggcagaaaatggcaccaaccaaaatggaggcctggatagtggaggcgtgaaaatagatccttcgtaaccccacagccttggaatgattgctcactcctttctggcttagtcttttttgtggaatgcctgcctaggtgtttatggcaagaggcatatttggaatgcacaggctgggagatgaaaatgtgtatgccctatcccacaaagtaaatgctgtcttgggcttttaagtgaattggggctaacaaaatccacactgtcaacctgagtagccttagagtggattccaccctgctggggctggctgtttataatggctaaaaatgatggagtgtgagagaatccccagggaccctttggtaaatagtagtttttaaagggttaatccaacctaatgaatcatttaatggggatgagaaggccaggatggtagcctccggaagaatcggcaggcatttatttaaatgggatcagttagggagggagcaggccagctgtgtggcagggactgttggtgcaggtcacttctccaggcagggagtaattgatatccccagctctcctaacagctgaaacaacaaagcgggacatggaaacatgttcacttacacagatttcaatgtccaaaggaaatgtgggggacacttaggccctgcctcttcaggttttagggctttgaaggtggggaatcaggagtcagctgtttctcccccaccacatttcaggaagggctttgaactggatttcggtagctttgtgggctcttgcagaaagaaagccttgtcagcactgtggatgataagtatccaccctccggccacagcaggtctggtggtcacgggaacccacatcttacattcaacagagcagcctacgtccacaataaaccaacagtccaggcattggtttctgagctttcagaaggccaatgtgaggaaattcaaaacacaacagcttgacttggtttttccagggcagaaaaaagattttctcctaatgagggatggctttcatagtgtgtatttatttgcaatataagtaagttcatgatttacccatcttgacaaattctctgtcttggatcttcacatccctttgtgtccgctctttatttatgatgatagccgcctattcttgaatggcaatgctgttgtaataaatctccataaaaagccaattctcagttcaagttactgcaggctgaatatgaggaagacagtcagaaaacacatattgattgtcctcttttagagactccgtgacaggctcagctcagaacttctttcattttgactggactgcagctcaacctaatgtcaacttaccataattcttttatgtggaaggctattattccattatgattttctctcttgtcacctagtatccagaaagggttctgttgggaagagattactggagaatattcttcatctcagatatttcgttccttatggtctggcctgacctttccttgtttattttagaaaggcagtggaaaatgttctgtctcctgtttttagccatctttatacatagccttaagatatacaaaattatatacatattagatatatttttatatacatatatataatttctttgggagtttggcataaggataaaattatttggatttcataatttcatacattctaagtcacaattttcctatacttgacacattgcctagtatttgatgccctgttattggagacaatttagcactgacacagactagcatggcgtaatagttttcttttgtacaaaggccattgcaaaatttcagtctggggccaaacatccctgtagttattttttttaatgtttcataagttgtaaacgttgataccaagtatgtggtgggtgttataaggctttgccctttgtccatttcaaatttttcgtaacaacctgcacggtgaatttctcgagtctttcttccaagagcaaagagtctccatgccaacacatccactttcatcctttggccttaacaagtaagcttcacattggcgtgtgttaagaatcacattgataaccacagttgaccagaagacctacattactatcaggtaccttgaggagtctagtctctgatgctaatatagaaatcataggtctcaaagagctaatgcggtatttgaatgagtcattgcatcttgaaaaatcacagaagtcactggtcatgaggcaaattgtttccatttcttcgtaagccacaattatatttgcggtgtagattcggttttgcttcttagcatttttatgaagaagctacttaatggaaaaggattcagaaggcctattcttaaaactcttaatgaccacaatcagcagtagaatatatcagatttatatctgatggttgactattgtactatccatatttagtaaatcactgctctaatgttctcaataataataccgtggccatcagaaatagtttatactcttttccaaattcctgacatgtaagaaacgcagtaatactaaaagcttctggtacctcattgtgttggcattgaccttaccttctctctgtggctttccctttccctaatgtaggtagagctgctgtatttcaggcaagcactcaggtattgggctattttagttgggtttttgctttttattgatttggagttttaaaatcttcttctaccacgaactctacccctgacaaacggtgagaaaataaatagaattgctagtcttcatcacacggaaaagagctagtgagctatttcgtttcctccctttttctgcccccttctcttttcccagcttcccatttatagccctgctttgcagagacagcaacagatactctagaagcaggatgaacatgagagtggatttacaacatggaaagcaaaggccatgcattcctaaagggcagggaaggccttaagggcagggctttgacttttcaccactgcctcctctgcctagcacctgcatgcagtgggcattcaactaatatttaaggcagaacaggaaggaaaggcaaaaacttgggaagaaatatacaactgaggagaaaatttccagacatttcactgtgaaggtgtcagaaaagacagttctctattttcagccatactaagtggacattctacttgtattattctgtgaattttctaattgagtcatgaaaattctttcattgaaagcacattcttttttagtactttgtatttttcctcataaaaaagatttcctctaacataaatgcataaagcaatagaaaatcatgattgagatgacatggcatgttttccacatttcaattttcaatactttgtatctatcccagagaattctttccacagcacacttttcttatttttgttattcatccagacctgaattttttaatacattcagcaatttttatcaaacatgagtgattggagtttttccagacaagtaatgtttttttttcaagtgtgagattttgtgtgcgtgcatgtgtgtgtgcgtgtgcatatcttctgtagagttatagaaagctcagttttaaaaggtggccaaaaaaatgaatcaatgaataaagtggaattaagagtcacccgtaaccttgatgctagtggtggtacagatgtgtacatttgtaaaacctcatggaactgaacagttaaaattgatacatttattgtatatacattatacttcaataaaatttttaattaaagaaaataaaagctcatcttcatctgggctttacttgctagtccatgtcatggcggagcttcagttcttaggaaatcttccattgctatggcccttgctgttccctggcaaactccaactctcagggatctctacaatgccctggctttcaaaagcacaggagagaacccaagcaagcctggctgctttgtgctgctccttagaaacgaatttccatgttcttgggccacagaatagtctgccattcaaataagcatctctggctgggcatggtggctcatgcccataatcccagcacaccaggaggctgaggcaggtggatcctttgaatccaggagtttcagaccagtctgggtaacatggcaaaaccccatttctacaaaaaatacagatattaactgagcatattggtgcatgtctgtggtctcagctactcaggaggctgagataggaggatctcttgagcccgggaggtcgaggcagctgtagtaagctgtgatcgcaccactgccctgcagcctgggtggtgaagcgagaccctgtctcaatcaatcaatcaatcaatcaaatcctgagccatatcactctttttatcaaatcactatgccacaggatgagattaaatctcaccacaggatctcaccaaaatcaggctctccaaacctctgttcccacggcaactccagatccagtcccatctcaaatgctgtctctaaacagagagatgcagacagagatgaggaactaatcaaggtgcatgtttctgtgtctggaagtaggagcaggctggaagagatgggcacagtggaagtcattttggtaccttcctttttatttactcccttgggtctgagcaggcaagacttgtcttggcatgttttctatttatataactaattgcaaattaattgcaccctcacattgttgtctctattggagaattgctagaggactcgagttagggatgattcactttctcagaagtagactaacataattgcatatgtagttactaaagttagttataggcacagatatctgagcctaaaggaagtttgtcaggaaccaaaaatctatcagacaccctcctacactccatgcctctcctatttccctgtccactaacatctttagcacagctgaaagagggagttcttctaggtcttttgcttttcattttctctaccctggaaatgttgaaagctgtatcaagctgaagaagcataagctgcaacaaagcttttctcccccaaggtggtttccaaagtgaatgaccactggctctttctaagtattttatcctctagtacttacattcatacctattggtatgaatataccaacacatgaatgtacacatggacaataggtaaacattattgttctctctacatattattccgatgctttatttatccaatacaggaaaagaaatctattggtagatgtaactgaattgaaaagtccaaggacagacttatcttcaggttcagctacccaagatctcataaaaggctgtcagcacttggcttctttctccccatctctcgactgttttcttcattgttggctttgctctcaggcacgctcttccaccatggtggcaagatggctgcccacagcatcaggcttacttccccctcttctcagctactccacaaaagagggatcctctcattttaacattttccacagaagtcctaggatcatctcaggttgcttttatcgcggtatgtttttaaccatacacaatcactgtgcccgaggggatggaacgttctgatgatccaggcctgggtcacatgcccctctggagtccagagtggagtcattccacctgaaccacatggactgagagtgggcatggaatgattcccaaaagaacagaaggctgtcaccaggataaagtaggacagatgctagactggcaaaagcagcaactttcttccactgtctcaactcggatcacaagggaagaaggaaagataggatcaaggatgaaggagaaaagtagaagctgttgccacatattcacaagaagtaggatgagtaccaaatccctaaaaaatgttctgtcaaaccagtacaccaaaccctctctgcttccggtctgcttgtcatttgacccacaggcttcaagaatacttcctcaagtaaatatagtccagtgattcatccatcagataatcccatataaaggaaaaagacaagagagacaagaattatgtctgttttgagaccaggatggtctcttggctgttgcccaacttcctttgggtttggctgcatctgtccctcactttagagctccacgtgtcattgtgtttgtctttccctgagaatgtgaataatcccaagtctaagtcatccagcatttctcagagaggtgacatcaatgtagacccaccaaggagtagcagttagacatctagaatataactaggacaagacaaaaaactgtttagagagagtgtacattttagtgtattttgtataagttttttcaatgaacatagtccatacattttgggaaagtggtaataacttgcttcatttccatctggaggaagcagatttttggaggagaaataagcctctaaacatatttgaatatttgaaagactgagaaaagcacatgagaagttatggaatcaagaataaataaaaagttggggcaggaataataataactgcctaccattatcagtcacttaccacacccatgcaccatgctgagtgctttacagactttctcatttaaccctcctagctactcagtggaagcaaataaccattactatcccaatttgacagaggaagaaacagactgtcttacagaggaaacattcgttcattggaaacccagaactgttgttcctaacctccctgatgtctcatattttgatgctcattgcaagatctgtgttgatggacaggattgctgagctcaaggttggctggaacctaaacacagacatacaaggagggaatcaggagggaccccagtcagatgagataaaaagagaaggtctggtggttcaggtcactgaagaaaaggaagctgtccggtttggataaaaattcaatgtcctcacaggcagaggagagcaaagcctgagaaagaatctcataaaagacaaaggcaaaggttctgttggcatcaggatggtccagcagggaacgaagacacccaggcatggacattaagattcaaggctaggatctcatttaatggtcacacctagacaaagtggaaggataatcctaccagtgatgatgtcttacagtgtgtaactgggctttgtcagttacacagtgctttttcatacttccctaattttatcttctcccagcaggcctaggagcttgcttagtatcataattcccacttccgagtgaagaaaataaacacagagaagtttctcattcaaagccaatggcagagctggaacttgaacccaggtgttttgcctcagagcccagtgctcttgtttactatagtgggctgagcgtaacatcaaggttgacttgttcattggaattgctgtacgccttgggagcttggtcattaggcaacaagcaagatgccagtcactgggagagaaagggatgaggctgaaactcaaatgagtacccatttaaagaaaagaaaaccccttctttcccacaacaggaatctccagcgaacatccactaataaactttatattgggtgcctaccatgagccaggcactggagagtgaacggtgaactcggtaatagtccttaccatcacagagctcacagttcgttggagacaccagaaaacaggtgattaaatacaatggttattgattccatagaggcagaatgtttcccatacaactataatgcctgcgttatatttaaggtttttcatgatcttatatatcttaccatataaatctaaatcaatcataacgtatatttctgagatgattactcagttagctcataggaggggcatctgattcagaagtaaaggatcaggaagaagcggcatctggaacaagtacagatggccaaatcaagaacctttctcttggcctctgagctacttgcccaaaccgaactctgtcttcaaggttcccttaatgcagtccccttgtcagaagccacacctgcagcagatgccccatggcactgactcagccttgagcagaagcactgtgttttgtctttcatctcattgcccagctaggtgcaacctggatagacattgtggcccataccttttttatatactttatatttgggtttttaattgttgtcaccatcaccaaccaaggagtaagatggccctctgggtcagagtaacattagaagttttgtccatccagttttagaactacagaggaaagaggagagcattatttttttaagagtaagcatttgatttctgaaagcaattctgattgcctatccctgacaaatgaattgttccccagaagccatttctttctaccagaaaaaatactagagaacaacaagtaaatttaaatttagttatttttccccaccttgattgtccatgttattattgtttaaatggtggtgatgaaggtaattaactttttaattcattttttggttgtagttgatgcattttttaaaaccccaactgagtgagtgccacaattacaaatggctctaagactgctaaaatttcaatgggtatttttcagcttctggttttgccaaattttagttcactaaaccacacttaaattaatttgctaagtagaaaattccccaatgggatgttagtgaaggataagtatgttgtaaataaaacaattaaagggctagttcacacctcatcaaattgcttaacaacctgataccagttaactacatacattcctcataaactgcatggaacatggaacaaggaggtaaattagagtcccccttttctgaagtgggacgcaattacccttaaactgaggtccagtattacggtggcgagaggtggggtagaaatgccacagtatgaccttgttggctgtggaaatatctgcataatgctgtcaatagggattgcaaattctgatccagaaatcccgttaggcagagcaagttccccttcctaattgtagcctcatagacacaagagtaatataagatcatggattcattttatcccaacattcctccaatgtgctgtcacccatatcatttcatccactcttatgagaagaaaagcacatattactttacagatggagaaaccaatgcacagataagtgaagaggcccagtcagggtcacacttgcagagggcaggctgaagggcagcaacgtgagctgagttcatcttggcctggagcctgtgtggtttctggcagggccatgaaattataacccctgtcaactcattggaggccacctacacaaatgccttcattttacagagttgaagataaggcctgagaaagtaaagtgacttgtctgaaacttcctgggatatgacccagtgtccggagctcctatccgaggtcccttctcacttctgcagcagtcgcttgcctggagttatttagggataatttattttttaagatgtaaatgtgaaccaggtaaggtgatggaaattttagtctgcctctcaggacacttcccctctttaaagtggggaattgggatggcacacacctattagcagaggatgcaaactgaacacaatgatgtggaaatctagagagcaagatttattcacatgggtcagggaccatgtgaataaacccaaatagctataggggcacatgggaaatgtcagtgagagaagcaggtgggagcagagcctaaagaggacaaagtcccttcctcaagagcatagcttcacttgaccatgacctccaaggaaggcaagtcctgagattaaagaaaagcaggaaaactgaatttttatgtgaaagcccttgactttgaagtgtcagcaactggctgaaaattttttaaacagtgtgttggggatgggagtgtataaaaatgagcctacagattgcaacctctgttagaggatttcctaccctgacatatcagtgtagagtaggacatttagggtccataccactcagccataaagtttggatttgtttacaaatgtatttgcttgttcattcaaggtctttggacaatcaccttatactccacatagaagatccaattttatttttattttttaaagactgagtgtgacttcgaactcagaaaatattgagggcctcagtatgattggtccttttgtttgtttattcacttttaaaattcagtttccatcacaaccctgcaaggggaggaaaggcagtcccaatattcccattttacacatgaggttattgaggctcaggaagggtattttcatgaagtgcctcgcacaattcaagcccagtcttcacctctgagttgcacactctctcccagtgcactgatgcacccagagatccctcagaactgaaaactgtgggagcacctgcccaccatagaggacaaatgaacctagttccagaacaggtgggcaggttttgaagcctcaggtccataaagcaaaggcagagcctggaattccatctctctgaagttcaaaaaccagctggcatggggcaaacggtaaataacattttattgggtaatggctctttagttttaaatcacttcagcatttacttttaattaatttctttaaattagacgactcatacttgtaaatatttgcttttctatgataagcttttatttaaattattaaagctgcagcttcgtgactgattttaagaattgaggttgccgctatactaatgatagaaggcatgtgattaaaaacaaggaaaccatttcacattggtatataaaccaacaccaaatatggctggagcaaagcagcactcaaacaaatagaagagagggtgaacttacagttttctttgatttgttcaaggaataaatcaataaatcagggagttagagaacaatgtaggatgaaataacatctaaaggagctcactcacaataaaaccttgtcttgctctctcttttctaaaagcactcatcaatggccctggacccacatactagtttgctaaaaggagtgagagtaggtcatgggaggggggttatggagaggctcaggacagtgagtaactgtacaagaacatttgagacaaaaaaaaaagaagaagtaatgatgagagcagagtaattgcatagccctcatcagtttgggttattataagccttgatgtgctagctgctccattttaccagcatcaaaggcaagtatggaacccacagaaggtaggctgacaggctggattacagcaaaaggagaaatgacaaaggatactctaatttcaataaaagaagatttgaatgtaaaaggtttgtaattacattaataaccagtctttaccaaccatgtaatgatcagccagagtaagaagagaccaaggcaggatgggggaaattcaccacaagtcatcaatacctaagaacctgttaataacttttattatttgttgaaaatcatcttgacaacacagttcagtaacctttgtgctataaatccatttcatctgcaaaaatgaaagctgaatagaatgtgatattatatagaatctctcatgctgatgctatctccaaagtgctctgccaaataatgagctggattctggatgggagggctgtggggggccaacagcagatacttgtgtatgcctaccaggcccagcttggggctttggaaccagcttagcatagactgaaatgaaggctgaaagttacccttcaccctttactgaaaattatcatggggtgcttagattctacatcaaaattaatagagagaagccaaaagcacttccatttattatctggtggaaactggggaatggatcccattgctttggtgctgggtatgggggagaatgttagaataatcatccccaaaatgtatgtaatcatgtttgtggccaaatagggtaccgtaatccaaataaaccccaggtggcactctgggaccaagctatgcctccttcctgccctccctgcaattgagaggggtaccaaaaagcccagggcactattgagagaaggatgagggaagcccttttcacaggaagctgacatggagatgagatagtcagaattgggaggtactaatgtcaaatccttcctacccagaagcaaactcggcactcctcatttttacattggtccctgatccatttatcttttgactaccttatcccaattaaactactaatgtgctcatttctttttttttttaatttttattataggttcagggagtacatgggtaagttggttacctacgtgtattacataatgctgaggcttggattacaaatgaatgtgtcttccaaatagcgagcataaataggtggtttttcagccctcactctctactcttgtagtccccagagcctattgttctcatctttgtttgtgtgtactcaatgtttagctcccacttaaaaatgaaaacaagtgacatttggttttctatctctacattagttcacttagggcactggcctctggctgcatccatgttgcttcaaaggacatgatttagttctttttttatggctgcatgatattccatggtgtatatgtaccacattttctttatccagtccagagttgatgggcacctgggttgattctatgtctttgctattgtgaatagcattgtaataaacaaagaggtacgtgtgtctttttggttgaatgatttatttacctttgggtatacactcagtagtggaattgctggattgaatggtagttcagtcttctttgagaaatctccagattgctctccacagtggctggattaacttacattcccaccagcagtgtatgagtattcccctttctctgcagcctcaccagcatctgtcgtttttagactttataacaaaagccattctgactgtgtgagttaagggacaggtcacttgccttgaagggaaaccccataaggctagtagcggactttcagcacaaaccttaaaaaccagaagagactgggggcttgtttacagcatccttaaagaaaagaaattccaaccaagaatttcgtatcctgccaaactaagcttctaactgatggagaaataaaatccttttcagccagagaaatgcaaagggaccactagacctgccttaaaaagggaatgttaaacatggaaacaaaagaatgatgcctgccaccacaaaaacacacttaagtacgtggcccacagaccctttaaagcaactacacaatcaagtccacataacaattagctaacgccacaatgacaagatcaaatcctcacatatcaatattaaccttgaatttaaatgggctaaacactcccgtttaaaaggcagagagtgataagttagataaagaaacaagactcagctgtctgctgtcttcaagggaccccctcttacacacaacaacacctataggttcaaagtaaaggaatggcgaaagatgtatcttgcaaatggaaaacagaaaggagcaggggttgctaatcttctatcagataaaacagactttgaatgaacaaccatcagaaaggacaaaaaaaaaaagcattccataatgataaaaggttcaatacaacaagaacacttaactatcttaaatacatatactcccaacattggagcactcagattcataaaaataaattcttagagacctacaaagaaacttagccacacaataatagtgggagacttcaacaccccactcacagcattagttgtttgctattgaggcagaaaactaggaaagatattctggacttaaactccatacttgacctattggacctaataggcatctacaaaatactttacccaacaaccacagaatatgcattcttctcatctgcacagggaacatacctaagatcggccacgtgcttggccataaagcaaatctgaatacatttttaaaaatctaaacatgccaactgcactcttggaccacactgcaataaaaacagaaatcaataccaagaggatctgtcaaaaccacacaattacatggaaattaaacaacttgctcctgaatgacttttaggtaaagaatgaaattaaggcagaaatcaaaaaattctttgaaactaatgagaacagagacacaagataccagaatctttgagataaagctaaagcagtgttaagaggaaagtttgtagcactaaatgcctacatcaagaagttagaaagatctcaaattaacaacctaatatcacacctacaggaattagaaaaacaagaacaaaaccaaccccaaagctagcagaagaaaagaaataaccaaaattagagcagaactgaaccaaatggagacatgctcatttctttcaacagaaagtgaacccagaggttcatgaatatgttatataaacctcacttagtattataaatttagggggaatagattaccagatgtaaaaattttttaaaggctcatggtagatcttacattgaggcacatgcaaaaagctcttaccaattaggttatcagtatttaaatttcatagcactacatctaaaaagtctaatgttcacacagttcccaaaagactgaattcacctgtctccagaagttgtattatcatgccagtggtctcactgcctgatgagtatagaagccaataacatggcaccaacatttgagaaaaggaagtctttattgcaagaccagacagcaaggaaaaaggagttgggctcaaatctgcatccccagtttgctgtctggggcaagttttgaggtgtcagagggcaagggaaaagatttaggaatgttggttttgtagagtctcattggagagcttcaatttcgaccatttacattaaggtatgttgaggcagattttagccctggatttttcaggccaacagactcttcacttctgaaagagtttctgcattcaggttccagtcacgtatgaatcttcttggttctgtagggaggaatcgttggttctgggtgttgttagaggtcaaagctttctctcttgcacatgcctgggctgcccgacttacagttttggctctattttacctacatggtaactttattctgttatcaacagagtaggcccagtttgggctggtcctatggttacagtattaccatgctttcatccgagagtgtgatgtcctcaaaatttcttcaaagttggtaagcaactggctatagaattcagctgtccttcagagtcacatgcactgatgctacagttctgcactgctgacctgcccttctctgaagctgaaccacaacttttcctgcctgtctttgaatcctaatatactattactattggaatggtccattggaaaagggatttgagcctaaatcaagactgcagcatgaaagtggacagccatgaatagctaagagaatatttgctagaacccgatgtatgactggagcagggatgagagagaagtctagatttctagtgggctaactgcacgaatcatgacattctccaaagagaccgttggaggagcagcaggtttagggagaggtgattggtttaattttgtactcataaggttgaggtgcctagggaacctccaagtagagctttcccacaggtaatccacatcacccccatgttcctaatcctactgaataaaaatcacactctttgttgttggtggtgttgttgttaactcagttggttttcttttctcaggtttagtcttttaagttctaggatacatgtgcaggacgtgcaagtttgtaacacaggtaaacgtgtgctatggtgggttgctgtgcctatcaacccatcacctcggtattaacccctgcatgcattagctgtttatcctgatgctgcccctcccactgccaccccgacaggtcccagtgtgtgttgttcccctctctgtatccatgtgttctcattgttcagttcttacctgtaagtgagaatatacggtgtttggttttctgttcctgcatcagtttgccgaggctaatggcttccagctccatccacgtccctgcaaaggacatgatctcattcctttttatggctgcatagtattccatggtgtatatgtaccacattttctttatccagtctgtcattgatgggcatttgagttgattccatgtctttgcaattgtgaatagtgctgcagtgaacatacatgtgcatatatcttcatgagagaatgatttatattcctttgggtatatacccaataatgagattgctgggtcaaatggtatttctggttgtgggtctttgaggaattgccactgtcttctacaatggttaaactaatttagattgccaacaacagtgtgaaaacgttgctttttctccacagcctcgctggcatctgttgtttcttgactttttaataatcaccattctgactggcataagatggtatctcattgtggttttgatttgtatttctctaacaatcaatgacgttgaccttttttctcatatgtttattgaccacataaatgtcttgttttgagaagtgtctgttcatgtccttcccccactttttaatgggattttttttcctgtaaatttatttaagttccttatagattctggatattagacctttgtcagatgaatagactgcaaaatttttctcccattctgtaggctgtctgctcattctgatgatagtttcttttgctgtggagaagctctttagtttaattagatcccatttgccaatttttgcttttgtggcaattgctttcgatgttttcatcatgaaatctttgcctgtgcctatgtcctgagtggtgttgcctagattttcttctagggtttttatagttttgggttttacatttaggtctttaatccatcttgagttaatttttatgtaaggtataaggaaggggtccagtttaaattttctgcatatggctagccagttttcccagcacatttattaaataggtttctagtaggctaattgcatgaatcttctagatggggtcttctagatatagaatcatgtcatctgcaaacagagacagtctgacttcctttctcctatttaaataccctttatttctttctcttgcctcattgccctggccagaacatccaatactgtgttgaataggagtggtgagagggggcatccttgtcttgtgccagttttcaaggggaatgcttccagcttttccccattcagtatgatattggctgtgggtttgtgatatatggcttttattattttgaggtatgttccattaatacttagtttattgagagttttgaacatgaaagaatgttgaattttatcaaaggccttttctgcatctattgagataatcatgtgatttttgtcttcagttctatttgtgtgatgaattacatttattgatttgcatatgttgaaccagccttacatccccgggataaagctgacttgattgtggtgcataagctttttgatgtgtcgctggatttggtttgccagtattttaatgaggatttttgcattgacgttcatcagggatattggcctgaagtttcctctttttgttgcatctctggcaggttttgatattaggatgatgctagcctcataaaattagttagggagaagtcccttcttttcaattgtttgaagtagttttagaaaaaatggtatcagctcctctttgtacctgtggtagaattcagctataaatccatttggtcctgggccttttttggttggtaggctatttattactgcctcaatttcagagcccattggtctattcagggattcaccttcctgattcagtcttgggagggttatgtgtccaggaatttatccatttcttctaaattttctagtttatttgcatagagctgtttatagcattctgatggttgtttgtatttctgtggggtcagtggtgttatcccctttatcattttatattgtttctatttgagtcttcttttcttctttattagtctagctagtggtctattttaataattttttcaataaaccagctcttggattcattgattttttttgaaaggtttttcatgtctctatttccttcagttctggtcagatcttcattatttcttgccttcttctagctttgggcttgtttgctcttagttctccagttcttttaattgtgatgttagggtgtcaatttgagatctttctagctttttggtgtgggcattagtgctataaatttccctcttaacactgctttatctgcatcccagaaattctgctgtgttatctctttgttctcagaggtttcaaagaacttcttgatttctgccttaatttcattatttacgcaggagttattcaggagcaggttgttcaatttccatgcagttgtgtggttttgaatgagtttcttaatcttgagttctaagttggttgtgctgtggtctctgttatgatttcaattcttttgcatttgctgaggcatgtcttacttccagttatgtgatcaattttagagtaagtgccatgtgtcaccaaaaagaatgtatattctgttgttttggggtggagagttctgtagatatctatcagatacacttgatccagatccaagttcgagtcctgaatatccttgttaattttctgtctccatgatctgtctaatattgacaatgggttgttaaagtctcctactattatcatgtgggagtccaagtctctttgtaggtctctaagaacctgttttatgaatctgggtgctcctgtattgggtgcatatatatttaagatagttagctcttcttgttgaatcgatccctttaccattatgtaatactcttctttgtcttttttatctttcttggcttaaagtctgttttgtcagaaaccagaattgcaacccctgcttttttctgctttctatttgcctggtaaattttcctccatccctttattttgagcctgtgtgtgtccttgtgcatgagatgggtcttttgaatacagaatacaatgggtcttgactctatgctgcttgccattctgtgtcttttaattggggcatttagcccattttcagttaaggttaatattgttatgtgtgaatttgatcctatcatcatgatgctagctggttattttgcagacctgttgatgcagttgcttcacagtgtcattggtctgtgtatttcagtgtgcttttgcagtggctggtaccagtttttcctttccatatttagtgcttccttcaggagctcttgcaaggcaggcttgctggtgacaaattccctcagcatttgcttgtctggaaaggattttatttctcctttgcttatgaagcttagtttagctggatattatatcctgggttggaaattcttttcttttagaatattgaatattggcccccagtctcctctggcttgtagggtgtattagtccattttcacactgctgttaaagacatacccaagactgggcaatttacaaaagaaagaagtttaatggacttacagttccatgtggctagggaagcctcacaatcgtggtgggaggcaaggaggagcaagtcatgtcttacatagatggcagcaggcaaagagagagagcttatgcggaaactcccattattaaaaccatcatatctgatgagacttattcactatcatgagaacagcatgggaaagacttgcccccattattcaattacctcctactgggtccctcgcacaacacttgggaattcaagatgagatttgggtggggacacagccaaaccatatcatagggtttctgctgacaagtctgctcttagtctgagaggcgttcttttgtaggtgacctggcccttctctctggctgctcttaacattttttccttcattttgactttggagaatctgatgattatgtgtcttggggttgatcttctcagggagtatcttaccggtgttctctggatttcctgaatttaagtgttgtcctgtcttgttaggttggggaagttctcctggatgatgtcctgaagtatgttttccaacgtggttctgttttcgctgtctctttcaggtaccctaattagtcataggttcagtcttttcacataatcccatagttctcagggaatttgttcattccttttcattctgttttctctaatattgtctgcctgtcttatttcagcaagatagtcttcaagctctgaaattccttcctcctcttggtcaattgagctattgatacttgtggttgcactgtgaagttcttgtgatgtgtttttcagctccatcgggcatttttgttcatctctaaactggttattctggttaacagctcttgggattttttatcatggttcttagcttctttgcattgggttagaacatgcttctttagctcagtgaagtttgttattacccaccttctgaagcctacttctatcaattcatccatcccagcctctgcccagttctgtgctcttgctggagaggtgttacaatcgtttggaggaaaagaggcactctggctttttaagttttcatcgtctttttgttgttgttgttgattctcatcttcatgagtttatctagcttcgatctttgaggctgctggcctttggatggggtttttatggggttttttgttggtagtggtggtggtgctattgttgttgcttccttttagttgtgtgtgtgtgttttgttttgttgttttttgtttgtttgtttgttttaacagtcaggcccctcttctgtaggggtcctctccagaccctattcacctgggtttctcctgcacctggaagtatcaccagtggaggctaccgaatagcaaagatggctgcctgctccctcctgtaggatctctgtcccagaggggcatcgacctgatgccagcaggaatgctcctgtataaggtgtttgggaacctctgttggagggtctcacccagtcaggaggcacgggaactgggacctgcttaatgaagtgctctggctgccccttggcgaagggagtgtgctgcactgggaggaatcccacttgtccagactgcccggattcctcagagccagcagcaggaagactacatctgctgatccatggagatcacagccgcccctcctctcaggagctcagtcccagcgagatcagagttctgtccctaaaatcctggctggagttgcttaaattcctgcagggaagacccagttggtgaggagggatggatcagggtccagcctaaagaggcagtctggccacgatccgccacagctgctgtgctgcactgtggggaattcctcctgggtccaaaccatctagtctccctggcgccagcaggggaaaaatggcagactggagccacagtgatgacagccacccctccccacaggaactcagtaatcttaagcagtctgcagccaagtggccaccaagaatctacacagctctgttcttgggacccagggctctgatggcatgggctcacgagtgggatctcctgatccatgggttacacggaaccatgggaaaagcatggtttcccagatgaagtagcacagtcactcactgcctcccttggctggaggtgggagcttcccttgccccatgtggctcccaggtgggctgtcacaccaccctgcttttccttgctctccatgggtcatgccacccacctagtcagtcccaatgaaagaacctggatacctcagtagctggtgcagaattcacttgccatttttttcttctcagtgggagcctccgaccacagctgtttctagttggccatcttggcccctccccaccaaaatcacactctttaatccttcctatgctgcccctggtatttaagacccttcatgatcaggctccagataccctctctagaccaaccttctgcttcttacttgcctgctcttgacaagccagcatcagaggaatgtctctgtttccagaacactttccaaggctgttagctctgtatctttcctcctgttgtttatctcttcagatgctcaggataactgacttatatttatattccaggttatttgcagagcaggtaacacgtcttacaaacccccatagccacagggattccttaaagctgggtgccagctccacctgcatcagaatcacctgggcccttgagagaaatgtaggctcccagacccctttcagaccttttcctggggttgcaaccccagaatctgtgttattcaataaagactcaattgattcttagtgatgccaacgttcaaggtactagacctggaacacagggtcttccaaacggaaccgcacaaatatctgtttgattttcataaagggcaccaagaaactttgctttccttaagaaaggcacctcaaggtctctgaatgaaacttcccacatggaatgttgtttgtgctctttctgcaagcaccatcagcagtttcagcttcttgggccgctaacagccaaagtacccattggaaaaaaaaaaaaagaagtctctttttagtgcattagatcctgttttttagaaatgtgtttccaaatataaaccaatttctttcacccggtgccagcaggcaccatgtgagcagatgagaagcaagtgaggtcagagactgcatggtctaacttagtggtcaggcatgcagcctctgggtctgtctgtctgcctgggcttgaactgggctctgccactaccagtgtgactttgatcacattatttaacctctctgcttctcggtttcctcatctgaaagccagggataataataatgcctacctggtaacattgttatgaggaataaatccgtcaaatggaggaaacatttaggatggaaactaacttgctgtaggcacttgggaacatgctgctgtgctcagcaggcttatgaatctttgcaattctaaacccaatgtttgaagctggttactgagcccatcaagtagagtggcactcttccctgcacttacatttctgcttctgaatttcagagtaagacaattgccgtggcaggattctcctgtgtcttaatgaaatcatgacatggaggccctctcccccaacacccatacacacacacacacacacacacacacacacacacacacacacacacacagaggcatgaagatggaagtgtttaagtctccttcgttgtactccttgcccttggtgaagagggattctaataatctaatgatcataggtagtttacatcaaaatcttcctattgcacaggctttagaaattaatgggaggggaaaggggtcaggtaaagatgtggccatgatgcataaatatctactgcaaaaattgcatgtgctactctaacatatatatgtaatctaaaatagttagggaaaagcagacttcaggaacagtatattttgcccctagagtgttctgtctccaggtagcaccttgggcaggtaactgtgtagtggtttttcctaaggggcaggaggaaatcaggaccttacactgttgaacctgttagcccccaaagtctgaccttggaattgaaccattgtctgctacatgattatcagacgaaatccacagtgtttagatactgaaattctaggaccacagttacaatagaaagagagagagatgatttaaggggcctatcaagttaggatgatttgttcctttggttgccattctctttaaacaaagcctgttctgtggataaacagaccatggggtaatgatatgcaggtatcgttcaaatggattgcatgactgttttttgtggccgcgcaggatagcttctgccttccccaagatttccctctctatgttgttctcagttatcttttctaattgttctcagcacccactttaaaaacctctcatcccctcataaaggaaattattttagcaggaccatttttaggaccatctgataggatgaaacactcttaaggaccattttccagataatgtctgctgaactgtcatacagaatccaaaactcattgcacacgcagtttgttaataactcaattcttgtatttgtggtcattgtttaaaaaaaaagaaggaattaaatatgagcaaccaaaattatacttgtttaaactgtttgagaaatgtctttgagcactcagtcactatcctttctccttcattttctgtacaaacatttccttggtgtgtatgagggccacaagcatctgctgctgcacactccacccattccagttctttggaaagaacaagacccccctcttctcataacacaatgggaaatgtgagtgatgaaagcggatttttttccataatcatttctataatataggccatcaaatgatcattatattttatgattccgtaaaatctgccgaaatcaaagctatgtaatatacgttgcagagggctctgctaatccttgccaaccacattcgtgcctggaccgaggaggaaggtctggtaactggaaacctgacactaaaggaattctaagcacagactaaaagcatctctgtgcacatagcatgggcgactcaagtatattagtttgtgctgattttttttaaagctttgcagtatttgtagaagaaccagagaagaaagcaccgaccccagctcagccactaaataatctatgtgtggcatgctcaagaatagcatggctctgccagatgtcgactttctgccaacgggtacaggcacctctcttagacagctcacaggagttttacatcatgttacttcctgccgttcaaaccccaaatttggccacagtcaattattaccaaaaaaggaaacccataaaggctactttggaagttaaaaaattagctttgttttggctgctaatcacacacatagtattttatagaaattaagaacaagattctaccctttggaaggttttctgtaagtgaaaaacccaatgcatatgcctaagccggacattcacacctctgctcataaattcttcatggtttttatactttctgctgcatatcttatttcttcacatactaaactcaccccctttcaaaacaaactatcttctagttgctgatgtgtctccaacttagttgtttttcccctctgtgactcttcaacttcatctatccttccacatcctaaaaggagctcatcagatgagatactgtaggagttcttacactctgccttgagacatgtagaggaagtgtgctcagttctgtattgcaagaatctgtcactgatatttgaagacaggattacaaatgatttcttttaataaattatagcagactcaagttttccccttcaataatgtcactcccactcatttgaattcccttgttctttcctggatggaaggaaagggtgttgagttacagcaggtggcagagaagtttgcataattctggattctgcctctcctgggtatgagtagcttatatgaaaatcatccatcacgtctgttctcagggagaaaagcttgggaggcactgggacagagggaacaggacaccaccttgacctcgggttcgtgttcatcagccctcaagcccaggtaccacacttgtaactatggtcatcacacctgggtttgacattgtctccctaagaccctgtgtttgaaatcctgtgtactgtactttgaaatacataaagatgttcctagattattgcatttatgacagagacaaagaaaatttctttgctgtaccatcataaaaatagtagttaactgacccttgaataaatacgcttagcctgtacctagtaagcccagtttccagttaatcttgagtcaagagagctctcaatttcctcagcaccagttagtcatgctgagctcactgggaagtcagagaaattgaatcccagtgtaagatttattgagcacctattgtatttcaagtactctgtagggcaacagagataagacagtataatcttgttcttggcaaacaagacaaataaaataacctctaccctgataaaatttacagtcattctgtgttggacccaatacaaccctttattcagcccaccatccctcctacttccttccttcttcagaatttagaaatcagtctcacctcaaccaccatcaatccctggctcccaaagaaagcccactttctcctcttttcccctaccttcctccagcccctacccacattcaaccttttatagttactgtatgtgtgtgggttttctctttactttaaactctcttgaacaaattcaacatacatttgtagagcacctgtgatgtgcaaagccctgtgttaagctcgaagggagatagttagatatgtaagactcagttccttccttcaagatgcttgtactccatgcagtatacaaccagccacaaggcagggtgaaagacagatgaggtgagaatgaccagctgtggcagagacagaggagagagattttctttgcaattgagggtggtggtgtagacataggaggattcaaaattgctcatgccccttcatctgttccagtaagtacagccacctcattcctagcaagaggtttgctattaattttgtccttccagtattgagccctttccctatacagaattgttttagcaaatgtaggaagatgtctttcatccttgcgtaaactgaaggtagtcagcacccagagctggctatctgaccagcttagtctctgatttccagccccccttttgcttaatgaaaaatactgacatactgacatggcaaaaagaagaaatccttatgtaaacaaagtgatgcttattgcttctttacatgtaaataacatatatctttgtcgtgttcagacttaatggttaactttctttattgcgtgcatctatgtgattgaaaactgcatgcctgagatagttcctatcagttttccaagcaaaatctgaatccttctggcctctggaaatgagcctaatccgaaataaaataagcaataatttcaaaatataggtattttcatgacagccccctctacgagttgtaaagaaaacaaatatgggcttgtttctctttccttaagtaaatatggtttctgagtaaaatttttaaattgaaagtttttaaagaaaaacagtaacatatacaaacaaaactcaagaagtcacatgaaaaatgaaaggtcttaaaatactgatacatttgttatgcggattcttgttttaatcagaatctcctaaggaagctgcccctggattcctcagggttggctcaaagcacacagcatccgacaccgtgatgagcattgctggggccccagaatggattggttttgggctttcctacaaacactaaatttcacacaaataaagagactatgaaaagagaaactcacgattaacaaaactaaaattttagctgccttttcttcctctaagttctgtagttgatgaggaggggcttattttccctgtttcaaaattcttcttgagacagagtctctttctgttgcacaagatggagtgtagcggcacaatctcagctcactgcaacctctgcctaccaggttcaagcaattctcctgccttagcctcccgagtagctgggattataggcatgcaccaccacgcccagctaacttttgtaattttagtagacagggtttcaccaggctggtctcaaactcctgacctcaagtgatccacccaccttggcctcctaaagtgctggaattacaggcatgagccaccgcccccggccaaaattagtttttttaataatttaaaataatacacacataatagtcagaagaacttagaagttgttctgacaaaagtctgtaggaaattctgttatgaacaaaatgttgttataaacaacagctacacaccatcccccaaaataaagaaaaattcttctagcactctttgaaccttaaacagtgttttagtaggccaactcattgtttttcttctctctgaaaaattaaaaatgctaactgttatgatgagttccacagaaaaagacaatttccatgacttcatttcttgacaaagaacagctacctctcttgctttctgccacatacaagcaaactcccagacataaaacctcccctcagaggaagcaatatgggaccacaaaagtatcttgaggtctgccctatctgcccacgggaagcctccccctcactgtgagctgtgagcactggctgcctgggaggagcaaggtgtgggagaagagatagcgactgtccccccatgtgctcgccgactgtactgtcacaacctctcagggtggcttctgccctgtcaccacttgatctggattctctctccaaaaatttaaaaaaacaaggcgtgcctgtcttttataatgctctgttttaagagagagaaatctccagggagagaacaggaccctaaaagtccaaggcctggaattcttcctttctctctttccattttaaacaggaagcattcatgctaagagagtccggagggagggctggttgtatgttcatttgaaggcaaataatgtttgtgtgttgcaaatgtcagtgatttatcctaagggcttaaaatgagtgcagaaaaaccacatgtttcacttcatgcagagaaatatcttcagtggattttgagagaaagtacaggttaagaaaaattttttgagtgtatcggatatctccaacatgaaccaaaaggaaatgaaaatgagcatggtgaggtggaggagagagacttaaagaattcttatgataaaagatataccgaaggctggaagttttctaaatcaaaaatgaaattctaaagaaagggaaaggtgaaatccagagcctttatttcccatggctagagtgacagattatccatttgtgctccatttgtcatgggcgatttaaaatacagcaaagcaaactgcactgaataatagcagctgatgctataataacttgtacacaaacaatttaattttttatctgaaaactctaactaaattaccccaagctcaaggatctttcattattatacatagccaaattaagacaaaaaagtagagagaattctattgttcatccttatagatttgttcacaagctgctttctacatgcaccgagctgggagcttgtcaaatcttcattgatttgagcaacttacagagctgttttaacatccacctccacagattacagggtgattctgaccctcattgacagtgcttgattaaccacagacactgtattctcacagccctgtcatttctttcaagtgtcctagcagtgtgtctgacattggggagctttcccttaattattgttgttgtttttcttttttaaaaattataaaagggggagtggcaaaaaaatgggaaggatctggggatggtggtggtggtgaatgtgtgcacagaaggtttatgagattttaagagctgcaaacagaactcatctgtttaaccccaggctagataaaatgcagtcatctgcacattgtttagaggcacactgcttctgttatggcaaacggatcagaagatgcttgttttctttagtgagagatccagacagggccactttctgttagtgtctattcttaccctggatgtttctgtgtgccttacccattacaaggtacaacttacagctggtttggcatttccctattctgctactggactggtgctacttcctggctttgtggtagagttgattactttatatcaaagctttaggtgtgggctgggtgcagtggctcacgcctgtaatctcagtactttgggatgccgagccaggcagatcacctaaggtcaggagattgagaccagcctggccaacataatgaaacccatctctacaaaaaaaaatacaaaacttagtcaggtgtagtggtgggcacctgtagttccatctactcggtaggctgaggtgggagaatcgcttgaacccaggaggcagaggttgcagtgagctgagatcgcaccattgcactccagcctgggtgacagaatgagactccctctcaaaaaaaaaattaaaaaaaaaaaaagagctctaggtgctctggcttgggactttttctaaggactgtagagcatttagggaggggagggacatatgaatccacaccaagatgtaacagcagccaaccagagttagaccaagatgacagcccgtttaaaagagcacctcacagatttagaaaagcgagtgcagtccatggaaactttatgactccaaataacctgaacatttctatcaccatgcctaggacagacttcagcccagcctgtcctggatatggtggtagaaaaggggagggaactaatgaccccatccttaagagaggcaaactcactgccttgtttaggaaactagtttggttactataataaaggccaacagaaaagggtataaaccagattgaagtgtattttcctctcatgcaccaatgtgaatggaagcaatcctgattgacatggtggctccatggcaacggggacccaggctctcaccttcttgttgctctgcctcccatagcacgtggttttcaccttgtggcctaagatggtttttctgctggccaacaggaaggagagaagggaagaagttcccttctcttctttttaagggcacgtatcacttctgctcccatcccattggccagacctatgcggtggccacaccaaactgcacaggaggctgaggaacatgttctccagccggacggccagcttaggagctgctaacatgtgtctcttcttctctttccaggggaggacccgcagatcctgtagactatctgccagcagcacctcgggggctctacaaggaaagggagcttccctattatccaggggctcatcctatgcaccctcccaaagggagctatccccgccccacagagctcagggtggcagatctccggtatcctcagcactacccacccccgccagctccccagcacaaaggaccctttcgacaagacgttccgccttcccctccccagcaccaaagaatgccagcctatcaggaaacaggcagaccagggccccgtgggggcagcccagaccagtacccttaccgaacccaggattcccggcagaagaaccccatgactgcagccgtatag

SEQ ID NO: 330 - DNA, 1070022 bp, Homo sapiens; identical to SEQ ID NO: 329

SEQ ID NO: 331 - DNA, 1070022 bp, Homo sapiens; identical to SEQ ID NO: 329

SEQ ID NO: 332 - DNA, 294817 bp, Homo sapiens
tctgacctgagagaattctttttattacgagtgaacagatgaactaaggtaagcgggtctcagccttccgctggtgcagcatctccacgcagggcctcagccccgtcctggccttgcctgaggactgcaccatgggtgttccttgggcatggaggaggcagcaggaaggggtgacaggagcaggagcaggtgcagggcacctcacaccacaggcctcccccacctctgagctgccaacagccaagactcctggcgaggccgggagaggaggggtgagagggaaggagggtctctgtgaaagcaagccccacccccagagcagagcagagacccaggtctgcaaatcacaccctccccccacgagttcctcctttgaggccagcagcacccgagggagggcaggggctgcacggagaccagagaaaggaaaaccccacagaagaaaactcaaagcatcagtcccatgcgtgtctgctgaacgagtgaatgggcccaaaggctcttctctacaaacggcacgcatccatccgacagggggccacaggacacggccggggccgtctgcgtctgtgcctgtgcagcccacaccagtgcagcccggggccctctcagacctcaccacacgcgtgcccagcacatgtgtgcacacgcagatgcaggagagaacacacaccaccgtctctttgcacacgtgtgcccctgtccggcccggggggctcatctctccttcacgtggttctgtgctcccgggcccccgctgccggccccatccccactgcccccactgtggaccccgccggccccgctgcatagcacctcggtgaggtcgtccatgatggcggtctctttggggtccagcaggttgaactcccgagcaaagaggatgaagtggacgtagagcgtgttcaagtgtccgtgcagctccagggccagcgtctccttgaagtgggcccagtagatgtgtgccagcacgtggaacaggtgtctgcagatcttcctcaccagggactcaaaggagctggggaattctctgcctggggaaggccaccgtgtcacaagctgcagacatcccttggccccaacagaggccaggcccctggcacccagcctggtgggtctggtacctgccacccacaccttgaccctgccaccctcagggcctacaaagccccagcagcaacagcttctgcccatcagcaggcaccacagggacttgccaaccccgggtctgggctgctgagacctccctgcgtgctcaggctccggaggctgcacctgccctgagggctgggagctcgttgggccatcctggccacctcctcaggaaggggcctgtgatcgggcactcgggcccccgtggtgtctccctgatggacacttggggccatctcccgggccaggacggaggtggcgatggtggcacaggcctctcctgttgtcccctgccgtccctctggcagcacgggagtggcgtggagccccaccacatcccaccaaaatctggacacaggcttggcggctgatacccagcccaagtgcccacaagctggacggtgagagcagcatgagcggcagaaaccaagaggggcccagtgcagccgcatggcccagagggccagggagatggcccttggccctggctgggctgacccctgcccaagggctccggcctcaccccacagcccaggtggctccatgctaagcagggactggggtggtgcagctgccgccctccgtgcctctgcccctcccggcacaggagcttggtcacttgcagacacgtcctgaatgctccctgccccactgtgaggatgaccgcccagtgctgggggagacgaaccgtattttgtggggaacacgtcctcatccgtcaccagcttctgcacggagctcatgacgaagtcaacgtactgtggggccgtgcacttgaccttcttcccccgctcgtcataccagtagtactgtctgtggagacagagacacggtcagggcatgcgcccgctgcacacccacccagccactgggtcccacccgctcaggtcatctgcgggcagaggtggcgccagcagcggaggtgtggcagacccaggtgtctccctccctggacatgcacactgtccccacacactgtctgcggggaccacactgcactctatggaggggtctgcctgcgctgacttagaactacgccaggatcacgctggggagcctgccagccacatggctgtacaggtgtgtgattaaatgaaggggtcatcttcgttttctccgcttctacatggcttcagttgtattcgtttacacaagtgcgtgctgctgtttttctgttgtattttgaaagcacacagaggctccttctcttcccaggaagctgtgctgtggctcgccggccaggccccaccctttgggagagccctgctctgactgctagaagccaagcccctctccggggaaagcagaggagggcggtggtctctgtgggtacctgcggctaacagcctggccaggacagggacctggccccctcttgcccctgtacacaagggcggccagtcctcatgtgagactcgtggccccagagcaggctggagcatcctagggacatggacaccctgggtttgcctcttactgttgggtccagccatgacaagggtgtgctctagttcatgttaatataaggtgacccccagcccctaacacccctcctcccccagcacaacaccaaaacccagggcacccacctggcagccaccacccctctccccctgccacggtgctgggtctcagtcctccaaggccatgcccacagcggccgcccccgcaggcctgaaccagggcatgctggggccgatgccgcagccccacccacaggcagtggagagtgctgtggtgggagtgctcacacctgagacacagccaacactatgggtcgggatttcctccctgagagccagctcccagctcaccacaggtgggaatgggccacacagcacagagcagtactggccactgagcaaacgccccctccacaccatggccacaaccaccatcgcctccactgccccagctagaccaacaggcagtctgccagtaccaggctccacatgaaccgctcccaccctcctcatccagtcacggttcctcttggaatggccctgggtggggcagtgctgaaaaggatggacccaggctccactctggaggccactcttctcttggccagctccaagcatcgtgccctgggttccagagcccaccaaggcacctggggagacgccccaagggctgagacagggccacggggggctcgcccacttcctgcgcagccagagaagccatcctcccagctgggcacagggcctccagtgtctccgggcacagggcctccagcgtctccgggcacagggcctccagcatctctgggcacagggcctccagcgtctctgggcacccctctgctgtgtccaagaagcccctcagcctgtgcactgcagatcccggggggagtcaccagagttaccaagaagctagaggatgacactgcaagccctgcatgctggcaccctgccctctgcaacagaaacagccatcaggccacctcccagcaccaccagggccctaggacaaccccctcccagcacccacctccagaatgcaaaccaggagctctcatgtgtgccctgtgcggggctgactcagcccacccgaaggggaagtgcagccccaaaatggacaggccatgaggacggggatgcagtgcccacacctgcctctcaggtgctgtcctccccctgggacagctctgcatgaccttcacgcccaccttcccaggctgcaggcctcaccgtgggcatcgccaccaggctgtcagaccctctgagaatgcagagacaacagtcctttcagcatctgctcctcgagaatgatgtagaggacgcacgtatccccactgtcctggggttcccagatggtgtaggggaggcccagcccctaagggccaggctgaggcccatgtttccagggcgaggacccagccaggatggctcagcactctgcaggagtcagacactggctccaggtaccctgacactgcaagctgacatctgatgcacctggccacaggtgtgcgacaggtctcaaaacagtggaggttagagacggaaacccttttccacaatgcaaacccagagaaagcagtaactcagggacactgtggattgtcccatctgttctgaaagatggaacaccactgtttcctgtacttcttcaattatcagtaaaccgtttctggtatatagttctaagatttttatccacatgtggactcacgcattcataaccacaatcaggacacgcggcggcttacgtggcccctcacacccgtgctgctgtgcccccagcaccccggggatggctcctcagggatgggccgcgggaaggaatcgcaccgcgcggatcctcccgatctgggcccctcttgcacggaggcccctgggatgcagtcacgtggcagacgtgtcggaagtccacggctcctcactgcccagacactgcccctgcagagatggacatggcgtgctcatctattcacctgtgtccctgccagcagaacagagtcccaggtggccacatcctggccagcaccagtgtcccgaccggcatgtgggcaggtggacatgggtctgcccatggtttcggcttgcctttctctaattgctaacaacacaggatagccccagctgccatccttacaccctctttggcaaactgtctgctcatttcttttgctgacagttaactggactgttttgttttcttactgctgagttgtgtatgttctttatgtattctggatatcagtcctttgtgggatgtgtgatttgcaaatgttttctctcccagcctggagtttgtcttctttctcttaaaagtgtcttgaagcaaaagttctgaattttgctgcctagtgtcaggtcataaggatttcctatggtttcttccaaaagctttggagttttagatgtttgcacgaggcatgagggataggtcagcgtttggtttttgacacaaatgactgcttttcccagcagcatttttgaacagactaccctttctcccttgaatttattttgctctttgtcaaaactctgatggccccgtttgtgtgggtctatctccggactctccatccacacgtttgtgtggggctgtctccggactctccatccacacgtttgtgtgggtctatctccggactctccatccacacgtttgtgtggggctgtctccggactctccgtccacacgtttgtgtggggctatctctggactctactgtgttccatggagctctgtatccattccttcaacactgcacactgtcttaattactagagtttcacagtaagtctcaaaagtgtgagattcctcttattttttcaaaatcattgtagctatttcagttaatttgtccctccatataaattttagaactaactggtctatacttgaactctgctgggatttggattgagactgcactaaatcaacagatcagtttgggggagaatttgtgtttggagtcatcttccaggtgataaacgcagtgcgtctctccatttatgtagaccttcgattttctgtaacagcatttcgtagtttccagggtgcagatcctgggaatgtcttgttaagtttataactaaggatcgcattatttttggagctattataaatggcatgttaaatattaatttcagttttaaatttcacattgctaatatacagacctatgactgatttgtgcgtgttgacctcactaaatttatattattatttgctacaatccttgaggttttcccaatcacacgtgtgcacagggatacagcaatcccccccatccacaggggatgcactgcaagacccccaggggatgcctgaagccacagagagcaccaaaccctatatatgctgcgctttctcctatacatacattactaaaataaagacaggcagacttgattgattgactgagatagggtctcgctgtgttgctaagttagtctcgaactcctgaagtgatccaccgcctcagcctcctgagtagccaggattacaggtgtgagccaccacacccagtgtaattcataaactgaggacaatcagttgcagtgagtggctggggtcgcatatcagggggtcccttgctggcctcctgcaggctcaatggcaacacgctgctgctcccatcctctcacctcctccacccacagatccaagtactcaacacgcactgtggctgtcacttttgcaatttcagatgtaacagcgaaattaaagggactttttttccctttttcacaatttcataaagaagagatttgttcttaccttagatcttagcaacctcacacacaatctgtttctttctagtcaggaactttcaccttttcatctttaggtcaaggaagtgctttctgtcttctctttggcatatctgaattgccagcatcacgctcttgcgctttgggccgcctcatgtcacataagagcaacctgagcacgagcaccctggcactgcggcagtggatccacacgggggccgaggcacagctgggccgagggaggaggaggcacacctggagcaggacggtggagaccgcatcacactgctcagaacagcatgcagttgaaaacttattaactgtttatttcgggaattttccattaactattttcagaccatagttgactgtgggtaacggaaactgtagataaggggggcttattgttttatttcttttccaatttggatgccttttattctttcttcttaccttatggcactgcctatcttaggcgagttctgatatactgcgctttccaaagagttggtccatttaacccaagccatagaattcatgtgcacagagggtttttttccaatacttccttattatccttttaacatccactgggtctacagtgatactcctctttacatccacagggtttagtgacactcactcctttttattgatcattgcatcttctctcttatctttgtacctactaaaggcttaccaatttattacctttcaaagtcatcacattttgatttcactcatttcccctattgttttaaaaatcaatctcagtgctttctgttcttatttactttcttgtccttgattttgacttattttgctctttttctagtttaagttggaaacgtagattactgaaagtcatcttctttttctaagaaagcattaatcctataaatcccctctaggcactgcttgagttatgtctcacaaattctgacatgctgtattttcctgtgtacagtttgttaaagtttttttgttgaggcatcctctcggacccatggactactcagaattgtattagtctgcaagtgtttggagactttcctgttctctgttactgatttctaatttaaccccaccatggtcagaaaacttacttcgtatggttttgattttttaaaatttgttaagggctcttttgtgacaggtatgctccatcttggtggctaatctttgtgaagttgaaaagatgggtgttctgctgttgaggctgcagtgcatgtgtcatttcaatccaacccacgggtggggtcatcgggctccgtgctctcgctgactgtctatgaggctccatcactgaggagagggctgcaatccccggcgatcatgtgatttctacacaggccgtccgtttgctttgtgtggaaagccctgttgtctggcgcacacacatttatggcaggatttcttcaagagctgctccttttctaattagataaccttcttattcctggtcacttccttcctcggagtctcctttggcactgacatagccacttccgcttccttctgatgggtgttttctcagcacatcttgtcctcttacttctcacccgcctgcaccacagcacctagagtggtgtgacacacagggtgcttatgccccacattcctatgttgaaagcttaaccccagacgcaagggtatctggagatggggcctttgggaggcgatgaggttgcaagggtagaacgctcatgaacagaactggtggctccgtcgccctgccttccttccagcaagaaggtgctgtctgtggaccaggaaagggaccctcaccagacactgaatctggctaatcagatccagtgacgtggtcagtgcccccttcctggtccacagtggatcttcaccttggactttcagcttccagaaccgcaagaaataagattctgttgttcacaagccacctagcctatcatgtttcgtgacagcatcccgaatgaaatacaacaaatgagcttcttgtaaacaccagagagttggttattttaaaaatacattctcataagctgcccagtcccgtctgttcatctgttagcatttaggttttccactatttgctgtttgttgcctctgtttctcattccttatggtatttcttctttcctgctttctcttgggccactgaaatgtttttgtatttcatttaaatttacctattctgattctgactgcgtctcttcacataagctctgcaaggcctgctcaaagggctgtaacacgcaactcaaccccacatgctctccatggcacccacacatgtgcttccactggagcatagcagctctcttgcccacagccccaccgccgccaggccccacagccgccacagccccaccgccaccacaggccccacggccgccctggaaatggcactgcacaggccccacggccgccctgggaacggcactgcacaggcactgccggacactactcttgtcttcttgcaccatcactggcgtctccacaaacactcagtgggaggaggccctcctgttgggagaactctgcagggagcctctggaacaggtctgctggctgtgagggctcttggttttgagtgactttggacactgactggatgtggaattctgggatgacctttcttttctcccagcactggaagatgtgtggggcttccttcttccttctggcctcctgggtttctaaaagtgccacggtcattcactgcggcatctgttgtcagtaccaggccaccgccgtctgactgctgacagaggatggctgccaagggctttttctttgcccccagttctcagcatttggttgcatgcatctgcacgtgtctgtgagccttatttggggtttgcttagcttcttaagtctgcaggtttgtgtctttgtgggaagttctcagccattattgctgcaatgtgtttccggccccgccccctttctcgtctccctaggagtcagacatcagcctttttgggactgtcctacaggccctagcagggaggagacgcgcctcaatcccagagccctcacacgacccaggcagacttgctggtcttttgggtggcaagtggccctgaggccctctgagaagtctccatgtttctcttagtttgagtggatttctgtcccttggtttgaaaggattcctggaaaggcattacatgcaattaattcacacacatctactaccaccatgatgccagctccagatgagaaggaccaagaggcaaatctgggtggcctaggccctccaaggggacataggtctgcccaacaccacatcctacactcctccaaggaccccttttccaaaccaacccagtaccacagaacatgcaggagcagagcctctgggaagggtgccaggccccgtctgcccaggagcagaggcgctgagccagcacttggccacaggtggctccagagccacagtggacacaaggctctcgagtagctctcgggtgctgccctgccacctcaggacccatctccatgcctgatccatggaggccaccgccgtctcacattgagcttgctcccctcaaagccataagcactgtccccatcttcctgggccatgcctggctgtgacacctcattttcctggggaattaagacagtgaagccagctgttgtctgtacctgccccggtgtcacccataaccaaaccaagctgtgacccatcatggccatgagggcagggcccagcaggactgaagccaaggggacgcctgccagctgcctgtgcagaagctccccttggcttcttgaaggcagaactcagctttgtctggggaccacgtctccctgtgccagggccaggaaagccatgtctgtgggcaggatgactttcaggacgcactcacaggcacacattctgtccctgacctgtgtgcactgacaacaacgggacatcagggaaaagcttccgccctcctcagccgcacatgtcccaggctaagcccagcagacccagcctcctcctgcctgcagcctccaaggctgctttcagcaacccaggcctggcggcgctccttcccatgctacgcaagtgaggtgctcagggccactaacggacacccatttactgaggaaatcagggtgcagtgcttccaggagagagctaccagcaccaggcatgttggatggtcacggagaaggtaactgagcccccatgaaatgaatggccgagcaaggacctgtggcctgcccagcccagccctcactgtcccatccagagctgtcacgggagccagcggagaagggctctctgcaatcttagggcattccttctggaaacgtctctgtccctagaaacatagcccatcaacccccaccagctcctgcaccttctgggccccactggggacctgggtagctgggccactggcccagcctgtggcctttccacaggaaggtggatgttgtggaaggcctgtgccaagacttctcagggtctccaggtgagaacggaatctgagaggacaggagcctggggcagcgggggctcagagccccaccgagtctcccaagagaaagtgggctgtagccaggcagcactcacgtgttgcacacggccatcgtctgacacgtctctcctgtgcagaactcggagatggtgctatactgcaggttgatgtggtggaaaaacgtcgtggctggaagagaagagaaggagccagatgtgaaaaacgccagagctgagccgccccgtccacccctgcttccagcaacaggtgcaggagctcggctgggtgagctctgcccgtccacgggccacattctcccctcgcggcagggggctgctgagcaccagccgtgggggtcccccttgaggaggggcttcgaggaggagcagggaggagggagggggcccgcccccaggcccccgcgcactgttgctggccagccactcgttaaggtcaatctcgcggggcagcaccaccagctccttgaactggaagtcggtgatcctggccttggtgtgctcaggctccaggtaggccttcctctcctccgcagcgggcttcttgccattaggcttggctttggacttcctgccaagagaggagacgcggtgtggtcactacacgcccatcagacccagggtctgcccggggggtcagttgtggccagcgcaggtgtagagggagctgcccgagcccatcggggcgacactgcctccctgccaggctcaaaggacaccaacgggacaccaacggtgaggctgctccgcagaggggccagtggagctgccttgcgtggcacctcctgggaagaagggctggcgctcccacttgccacacgggcccctgcacggagggcatcctcacccctcaccaagtcctccaaccagggaggggcccagggtttagggcccccagcgcccaccttccagttttccagtgctcttggaaggaaaggagaagcaaaccctctcactcctggcttcttttgagttggccagcctgtccctgcccctgccgctggtggccccggtgaaaacataccacaggccttgtgcagggcacctgccttcctggccagcctgagagcacggggcccctggcatcaggcggcagcctggcctgcagctccagtatccctgttgtccaccaggcctggggaggccacagggtgatgaggatgggggccaaaggtctttgtggcaacctgaccctgtccttattttttttctttcttgttttgaaaagttgctaatggtttatttaagagaaagagaaaggaaaaatgctccctgaatgccagggaaatgtttccctttcagcttctcacagcagatcttcgccttaaaaggagaccagcgcaggcctctgggggcagtgctgggagtagccagagccaggcagggagcaggggcaggagcaggggcaggggcaggggcaggggcagggaggggcaggggcaggggcagggaggggcaggggcagggcccctgggccctggcactcccactctgccatctctccagagcacagggcgtggggtctgaggaagaggaagcacaggtgtggatgggccacatgcagcgtgggcacttggggtcctcacagtacaggggtgggacagacagggtgagcttccgtgtagcctgcagcccctcgccccagcacagcgaggcacccagactccacaccagcctgtgccaggccatgcccagcgtgtccaccacagggaaggctctccccatgacgctgggcctggccctgaccaccggcaggtgggcctgcacctccctgccctgtgctctcacagcacagcacaccacaccccacccgggcagctacagcctgggctcggccttcccatttggaggggtgggttgcagtggcccaggctgccaagcgggctacaagccgtctccctgctctgtgtcttaggagctgtgtcaactggcaagctccaggtggcagttacctggtggtcggtcacgcagggctgccagcaggagcagctgtcagcgcgctcactctcagggtgtgccccagggcccactcagggaggctgccctactggcagttcctgcccccttgccagccttccaggctggggctaccttccacctccggtcctcagagagggctgggcaggggcagaacctggagacctggcttccctctcccaggctctggctgtggtcaggaggtagtgagcagccgccactccggcactggcacctcagcctccctgcctcttcccgtccacacctgctctcctagaacacagaagaaaagtacgcacgaggccctccaggctgggcctccccgagctgctcccccagtctcaccctgtccccagcacccagggctggccgggccccggagcttagtgcactgtgagacaagcctcctgcaagcctaccttctttggaccgggtcactcattcccatggggcaggtggacgggcactggcccaaaggtagtaggaccaaggggacgcgcaggacatggcctctgctccaggaacggctgtgcgggcaccaacagagggacttccatgggaaagccccgaacgcctggcagcacccacgtctccctgacctcaagtgccctccttcccagaagggcaggctctcagcgaaggcccaggcctgggcaggaagcagtcactctgaggcagcccattgctcggtccaagccagcggcagctaccgaggaggcctcagagcacacgacacctccatggcactcttctcgtccttagtcattcttggctttgcccagtggagaaaacacctctgcggcgccccccgcaggctcacaggctctgaaacaggctctgtgccgtccaggcccagaggtctgcccagtcactgcctcagtggcccagctgcccctcacccagggaagtgccgaggccctgcgccctgctcccagctccccctgtgctgctggctaggagccccggggcacagaaagaccaagtccttcgatgtggagggaggactgtgggagcaggccccggccgcaggcaggacagagatggcgctgaagggactggggagtggaccctggacctcagcccacccacagggcttccgtgaccacttggaagaagcagaagggcagatgctgtgtgcacagcccccaaaacaaagtccctcacactattccaacaggtgggctctgagcctgggtcctgcctggcaggcaccatgcacttaggagggccgggccagatggaaccacctccttcctgcctcccacacactcaccagcctcacctccctcctccctgctctagatgacctgtcctgcctgccacaggggtctgcaccctgtttgtgggcaccagctgctgctctgccaacttgcccatcttacaccaggcctagcaaacttctcctggtcctttaagagcctgtcaaatgccaccctccccattctcgccagtggtacccatgacgtgccagtcggcctccttggcacccagcacgtaactgatccctactgggaagtgaggcaatccctgctagacacaaatttggtgggcaagggaaggggcacagggaggcatcagagctgctgggctcccgtggaaaacttagacaaccacacagtcaacacacagggggtctcaccctgcccacagcaggtgcacactgcttcacaggcagggggagctggggagtgggctgggagccgcccactcctcatccgccctgagggacgaggacagcacaaccgagtgccctgcacctttgccacgagtgtcaacttcattatcacagggatggaatcctggccaggccccacggcccacaggaatggggtgctccaggctcagagacccccactcgcccagagcacgcttgctatggaagtcgagcctgtagaccctgaggtgagtgggcagcagcaggaggtggccctcatctggcacttcccaccacaggtcaacgccaaggggtggggcaggcacgaggggcccagaaatacaagtccccaagcccaggcctggaaaatacggtgaccaggcagcgtgtggggtgcaggagaaaggcccgcaggtgacgcctctgaggagggcatggtccttggaccccactcagccatctgcaccgggcccctcatgctccttggttcgggtgaatgtcagtgctggttggtccacccagagcctgaaagtcaaggctcccagtgaccccttcccccaagacccggccaggcagagcccccagtagccacccggtacagagcctgggtctcagcacaccttgctgcccagggtgcacgccacgggcacctcctgtcaccccaacatgcagggagggcaccacatgctggggtgcttggcgccacccccacccctacatttctgatgtggccttctgggtgttgagggggggcctgaaaactgcatttctaacaccgtgttctaacccgagttctccctgggtgctgatcccacttctgtcacacggcctcaggctgaggggtgggaaggcctccggagcccctgtccatctctcagcacagcctgcactgcccacaggcttcagccagctggaagctgtggagtgtggcttcttttcttctgagtttaattgtctgcccccccaaacaggtcagcagccccagacaaagcgagcttttaccagcctactgtgccctctgcagaggcccattgagaaggaaaaagccaagatggcacaaggaacgcccgcagacatcccagaccaaacgtccaaacaggcaggtgctgctgctgtcctagaacctcagccccacgtggccaccatgctccactgcgcctcggcccctccatgcatccagctcccagccaaggtggcttcctcatcgcttcctttgaaaccttcctgagccccagggaagggactccgcccgtcttccttagggcctggctgggctccaggcctgcctctgtgtctcctgtggagctgccttcggcatttggcctcagacacacaagcacacactggcacaggcacacacacacacacgccagtcccctcacaccactgatgtcaggcaccattcctgatttgaactcacgagtactgccaacttgcccacacatttccaaaacctcacagtttcaccttaagataggacatcctaggcagggtcaccggccggcactcttgtgtctacttgtggagccctccctgttgaatgcacaggtgatcgggagatagggaaggagcctatgaagagaaagatggagccgggtgcccagggacaggcagaggcacggagatgcacacgggtgccgcagcccccggcccttggagggcacgtccagcaggccacgctcgcctcacacccccaccaggcaaccccacccgggaggacacactcactgctgcagctggctgtgcctgccccactcccccggcccctcatgcccacacacgggtgcacactcccacacacacgggtgcacgctcccacacacttgggcgcacactcccacacacgcccctgcacacaccgagctgagtggtgtgggcagggaggcacccccgcagcaggtcagagaaagtacaggtgagaaaaatgtcaaaaatggattttccggcaacatccctatggcagccagcacaaaaataggcacccgggaaccccatgccacttctctggacaaggccacacaaggacagactccgggtcacctctgcctgggtggctgaagcccctgcccagggcacaaacagccgcacgctgggacaaagacaggcacacctgctggcggctgaggaaccacaccctgtgggttgcgggaggacaaggcaggctcctgtgccggcaaggtggggtcaaccccgaaggtcgaggacaccaagacccgctcctctcccacagagcaacaggaagtgcaggcggctaaggaaagccccactgggcagggctccagagcaaacccgccaggctggcccgggactgcacagccgcctctgccctggacagcttgcgtgtggcccagcacagctcgctgcacagccgccggccacactgggagggcagccacggacacagtccgccgcctccccaccctgacctccttcctgggggcaagaacagggcagacagatgtgctacacacccctcccccagccaggctggcaggtgttacctgagcactttgctgacagcctgaagcaccattttgcagcagagtccactttgcagggactggccgggccgggcttggtcttcagggagactgcagtggtctcccagcatgagtgggcgacgggaaggtggggaggagaagcggggcggggtgccggctggccagcactcgcaaatgcctgctgccgggccctccagcctcactccctggccaatgggacgcctggcagagacaaacagctgccccctttccagaggcaagggctggccaaggctggtgaaacgagggagcgtctgaattggccttttccaagtggcatggctgccagaagaggcggtgggggtgggaccagaagggaggggacagggccgtccttggcctgcaagaagggtccatcagaaaggtcctgggctccacctcaggctgccagaagaggcggtgggggtgggaccagaagggaggggacagggccgtccttggcctgcaagaaggatccatcagaaaggtcctgggctccacctcaggctgccagaagaggcggtgggggtgggaccagaagggaggggacagggccgtccttggcctgcaagaaggatccatcagaaaggtcctgggctccacctcaaggtcctctgctgccaagcccccaggaaaggccttctgaacacaggcagcaactctgctgacgagctccaggtcgatggcactcccctctcccttgtccggcccagcctagcccagtcagtgctcgggccagggacggacagacggacagacagatgggccgccctgccctgcagtgtgtacgcagctggaggcactcaaagtggctttcctgctggatggccctggagagagaaggggccgaccagcttctgcggtgcctggacggtgctgggctgaggctgctgccagccaggaccacagggcacccagcccaacagaaatgcccacagcagctccccatgggggcgcacagagcggcacggccccggccttccttctggctggtctgcacacaggagaccaccacatcctgaaaatgcaaacacctgagagggcaatgctctctcctcatcctgagtcagcgtggaccccactggcagtgacagccccctgacaacacggggtcatcaggagcatcccccacccgcatgggagccatacttcctgtgcttcctgccaatcaagagaccccagcatctccagccactgcccctcagaagctgtcccagcacctctgtcggtgtgaagccctgtaggagtcaggacacagcctgaggtaccagctgctgcggggagcacagagccatcaggaaagcagccagggtaggctcacccccatcaataccagcccccatgggagttgtggtgtctggactgcacgcacacacacagcctgggcgcacggggagacagcacaccaacccagcacagacacactctccaggagccacagcagaggatggccccaggccggcccccgcctccctaagcagcagcagcagcaggcccaacaggctgcagtttcattttccccactaggccagtccctaagccatgctctgagcagtgcgtaactggtctctacagaacaaacagcccggtgaggctcaggacgtccatgcgcccacaggccttcctctgccttggcaaggccatcccacagccctgtggtgccacacgcacctaggcaccgtgctcacggctgccggtctgccctcgggggctccaccaacagcagggacacaggtgctggcaggtcacccaagtggcaaagggagccacaggaagagcgggctccaggcctggggaggcccccgtgagtagcagggctgggaccaggaggtgcatgacgcagacctgcccactctcgggaggcatggcctggacagagaaggccgtgcagaggcccatgacagggagaatgagctgctgggggttggagggcagagcataaaggaagctggggatggtggaggcttcgggcacaagaagccaggcaaccaggcaaggcaatggtgagggtggcacgggggcgggggaacagtcaggacaaggtgccgggtagggtggggggagcacaccaagcgtgcctagtctggtccaggcaaggcagtggtgagggtggcacgggggcgggggaacagtcaagacaaggtgcccggtagggtgggggagcacaccaagtgtgcccagtgggtctggtcagcacacggcagctctgtggcttatgccactgtcccgagagggctgggctggcgccagaggaacgtccacattcatctgtgtttgttcactgggggacacgtgcagggagcaggtattcctattgatcaaaacttaggtagtggggcaggagtggggtagggtgaggggcagctggaacccacagacactgagcgacagacactgcactgggaagaggagcagacctggagcaggctctgcagactccacgaggagctgccacagaggcccgcaggccagtgacgggtgccagtgtggcctggccccgccaccccagaaaaggaagagcaaaagcaccttctgggcacagccagggccaggagctggccaggaacagagagcacaggagcggggcagaggcaccacgcaggggggaacggtcgcaaccaaggcgggacggggcagggggcacgggccatgtgtctgtgtcagaggttattttacctttaataagcttttagttttagaaaagtgttagatttacaaagaactgcaaacacagaatccccatggccccccactcactcttcctattgctaacccttacactaggatggtctgtttgttaacaatgaacaaatccacattgatgcagcaaggtccaaacttgactcagacgtctggatccatccattgctctcctcacgacgaggctgggctgtgggtgtgggtaggaagagcacagagggaaatgtccccctcgtcgccccgtgcccacggcccgtcctgtcagcacggctcatcgcgggaggtgctcccgatctcctggctgaggctgtgactgccaggcctccccacgcaaagacgctctcgtcttccccgccccgcaccgcgctctcgaacgaagctgctgcacgcagaccacactgaaggggtggggaccaccccttaccaccctgacggaggagtagctacgggaattactggaagttcggcaccagagagcggcctcttcttggtcactcatttatatattcagccatttgtttatattgggatgaagtcctggctattgaggctgcactccgagctagaacacaacactactttgttttgtgaatcacactgtccgtccttggccctggggagctcctgccatcagctgctgggtcccctgatgcacccccatcaacagacttttcattttggggcatgtcctgatttcctggcactgcagggtgctccaggctccccctgcattcccagccccagcccgggaatcagccccttctccaaggagccctggttcttttcattagaaaatattaaaaactggccaggcagccgggcgtggtggctcacgcctgtaatcccagcactttgggaggccaagacgggcctcccacaaggtcaggatcacaaggtcaggagatcgagaccatccgagctaacacagtgaaactctgtctctactaaaaatacaaaaaaatcagccgggtgtggtggcaggcgcctgtagtcccagctactcgggaggcggaagcaggagaatggcgtgaacccgagaggcagagcttgcagtgagctgagatcgcaccactgcactccagcctgggcgacagagcaagactccgtctcaaaaaaaaaaaaaaaaaaaaaaatggccaggcatggtggctcatgcctgtaatcccagtattttgggaggccaagaagggaccatcacttgagcccaagagtttgagaccagcctgggcaataaagggagaccccatctctacaaaaaatgtaaaaattagccaggcatagtggtgtgtgtctgtgttcccagctacatgggaggctgaggcaggaggatcacttgagcccaagagattgaggctgctgtgacccataatcacaccactgcactccagcctgggtgacggagcgagaccctgccccaaaacagtaatgaatgaattcaaaactgagacctggtcaggcacgttgattcacatctggaatctcaagagcactttgagaggcccaggtaagtgaatcgcttgaggccaggagtttcagatcagcctgggcaacacagcaagacccccatttctaaaacaattttttttttttaattatctgggcatagtggcatgtgcctgtggtttcaacaactgaggagctgaagtgagaggatcacttgagcccaggaggttggtggctgcagtgaaccatgactacaccacctcactccagcctgggtctacacaaacgagaaacgaaaacactaagatcagagcactgggtgggctcgttgctagtgggtgtcactgcttccaggccctctcagctggaagaacacggaggcacatgtgtatacacacatgcactcatacgcctcaatctccacccacatgtcgacatttgtatctatactaagctaagcaggggttcccctgaggtctccagcccacccctgcagccatcactgcctggaccacactggcccctccacttgctcgtctgtagcctcccctccaacaaggagactcgtggagagcttcgtgtttttaatcactttgtgaaaacaacagaagaaggagctcaaaagctacggaagcagcaaaacaatgcccccggcaccctcacaaaggcacagggaaagtggggtcacttaaaagcaagcaggaaagtttcacagttgagtccaatgaaaatcaagaagaatagaggagagtaacactctcccactgacaattaaaacatcccagaaagacacacacataacacagacgaaatcacacaacacagatgaagacacacaacacagacgaagacatacacataacacaggcagagacacacaacacagacgaagacatacatataacacaggcggagacacacaacacagacaaagacacacaacacagacgaagatatacaacacagccgaagacacacacataacacaggtgaagacacacaacacagacgaagacacacaacacagacgaagacacaacacagatgaagacacacacattaacacaggtgaagacacacaacacaggtgaagacatacaacagatgaagacgcacaacacagacgaagacacgcgcataacagatgaagacacacaaagacacacaacacagacgaagacacacaacacagatgacacagaacacagatgaagacacacaacaaagatgaagacacaacacagatgaagacacataacacagatgaagactacaacccaataagacaatcagggaaacaatgcaatttaagaaaatatttgaggccaggtgcagtggctcatgcctgtaatcccagcactttgggaggctgaggcaggtggatcacctgaggtcaggagttcaagaccagcctggccaacaaggtgaaactctgtctctactaaaaatacaaaaattagctgggcgtggtggcaggcgcttgtaatcccagctacttgggaggctgaggcagaagaatcgcttgaacccaggagatggacgttgcagtgagccgagattgcaccattgcgctccagcctgggggagaagagcgagactttgtctcaaaaaagaaaagaaaaaagaaaaagaaaatatttgaaaaaagaggcaaaataagaatcaggaatgagaggataaaccatttttgaaatgaagtctaaattagaatacaaaaaccaccatgatgtccaagtagaagatgggaaggaagaatttcttaaaataataaaggaaagaagagatttctgcttccactcatgacagagtaactgacactggacctcacctccactgtcaacaactacaaactgggtagaatatatgaagtgcttggcttcagacccaggataccgccgtgcaggacggtggcccctgcgcacaggcgatgactgggagcctctcaggctgcaggtggggatggtgaaaccacatggggcctgcagtctggagaagctgaggtggcagggatggaagtctcaagccgctgagctgttgaaatttgcaggatgaggaggcagtcaggacagagctgcacagagaagggactctaaaaacatcaacagggatccaaggaagcttctggacaaatagctgagggtgtcagagagaacatctgcaagacctggcagagaacagctctgggaagcgtgaggaagagaggttctggaggccacacggggcaggagacagacgtgttcccacacccagactggagacaccttgggcgaatagatttaacagagattccacaatggctgtgccatggggactgggctacaatagcccagagtgagggggttctctggacctggcataataaagcttaaaaacaagcctcaaacggatcctagctaaccaagagcaaattaactgccttccagaacaaaccacactactctttaagggaggaaaacagaactgagactttcaacaacattgctaccacaatacctagtgtacaaaaaaattactagacaggtgaagcagaaaaatgtaactcataaccaggaaaaataagtcaacagaaacaggcctagagataacaaagataatgaaagtaacaaacaaagactttaaaagaatgaaataaatatattcaacgatttatttatttatttagacagtgtcctctattgcccgggctggagtgcagtggcacaatctcggctcactgcaacctctgtctcccaagtgattctcctgcctcagcctccagagcagctgggattacaggcgaacgccaccaagcacagctaatttttgtatttttgtagagatgaggtttcaccatgttggctacgctggtctcaaactcctcacctaaagtaatctgtccgccttggcctcccaaaagtgctgggattactggcatgagacattgtgcccggccaatatatccaaagatttagaggaaaggttggacataatcaacaaagcaattagggctctgaaaaaatcggaaactccacaaaataataaacaaaaattcctggaactgaagaatacatcgaaaatgaaatttttgagatgaaatgaacatcagattaaacagtgctaaagagaagattacaataaaaacatcacttataaaaatgtgtagaatgcagctaaagctcagctgaggaagaaatttataaatgttcatattaggagagaaggcttaaaatgagtgattcatacatccaccttcagaagccagaaaaaggaagtgcatattaaatgcaaagtggaaggaaataacagaaatctatgaaatgaaaaatagacaaataatgaagaattaaacacaaagttagcctggaaaacttaaaaaaaaaaaaagatcaatttcccaagcagactaagcagaaaagagacagagagccaagagaggaagagggcataaattaccgatatcagaaatgaaagggacattcctacagatcctacagatattaagcgggtaacaaagcactataaggaactgaatgccaagagaaaatgtagatgaaacagacaaatttttcacaaacacaagctaccaaaactgacatacaaagaagtagaaaatctgaatttataattaaaaatctttctacaaggaaatggtgggtgcaggtggcttacggatgaactctacacacgatataagtaagaaataatacaaaccatacacatactctttcagaaaacagaggaggaggaccagcataatgctgctgccaaagtgagacaacagcattcctagaaaagggaaattacagcccaatatccttcatgaatgtggatgcaaaactctgtaataaaatagtaacaaactaattcaacaacgtattgaaaggataatacagcatagccaagagagattcacccagtaatgtaagcttagctaacacctgaaaatcaatgtcattcaccacattaatgaaaggagaaaaaaatatggccatctcaattagatgcagacacagcacatggcaaaacgtgtatgcaaactctcagcaaaccaggaacagaagggaccatcctcagctgagaaaggacacctataaaaaatctgaagctaacatcaaatgctgctgatggagtaaagattttccccctaaaatcagaaacaaggaaggggctctgagcacttctcactctcaccactcttattcggtgtcactcttataccagcggcacaatgaggccactgtaatgaggcaagacaaaggtatacaaggcataaatactggaaaggaaaaggtcgtcttgtttggcaggtaacatggttatgtaaacagaaaagtctaaggaaactggggcaagtctgctagaactaataagtaaatttagtggcatcacagggcacaaggtcagtaaagaaaattaattttattcctatataatagcaacaaataaatggaaaatacaattataaaactgctatttacaatataatttttaaatttaggaataatcttaacacaaatgtacaaagcctctcactgaaaagcacaaaacaatgctgagaaaaattaaagacctaaacacataaaaaaatttgccatggccatggattagaagactcaatattgttaagatgtcaattttcttaattaaatacaatcctatcaaaatcccgggataatttcttatttttaaaagaaattaacaagaagattcttggttttttgtttgttttttgtttgtttgttttgagacggagtttcactcttcttacccaggctagagtgcaatggcacaatctcagctcactgcaacctctgcctcccgggttcaagtgattctcctgtctcagcctcctcagtagctgggattacaggcacccgccaccatacccagctaatttttggtatttttagtagagacggggtttcaccatgttggccaggctggtctcgaactcctgacctcaggtgatctgcccacctcagcctcgcaaagtgccgggattacaagcatgagccaccacgcccggcctaacaagaggattcttaaatccacgtggaaatgcaaaaggactttgaaggatccaaccattcttgcaaaagaagacccaagtagcaggactcacacgaatttcaagacttaccttaaagctacagtattaaacaccgaaataaacataaataaaacagaataatgttcagaactagacctacacttacatggtcaactagacttcaataaaagtgtgaaatcaatctaagggggaaaggaaaatgttttaaataaatagtttggagaaaactgagtatctctgaagaaaaagaaaccttcaatccctacctcacaccaagacggatcagaaactcagacataaaagcaaaactacaatgcttctacaataaaacacggacagtatctgtgccaagctcaaagtaggcaaagatttcctagaatgtaaaaagcactaaccaaaaagtgacaaaatacatttcatcaaaatttaatcatacacacacttctattcaatatactgttaagaaaaatgaataggcaagccacggatggcatatatccaacaaaagacttctagctaaactatagaaagcaggtctacagttcaacaataaaagagacaactcaacatttaaaaagggcaaaagactggaacagacattttacataagaagacaaataatggccgataagtacaagagcaagtgccacgccttccagaatggctaaacctgcacagactgagaacacccaaggtgtggaggaggcaggaaccaggagactgatgcgctacaggcagggcgaggaactactgaggaaaaagccacaactactgaggaaaagggctggcagtttcttggaaagttaaatatgcatgtaggattccataattccatggctaagtactgacccaaaagaaacaaaaacatacatccacataaaggctcctacaagaacgttcacagcagcagtgttcacaatagccagaaactggaaacaacccaaagtccatgaacagaagaacagctcaacaaacgacagtatattcatacaacaaaacaccactcagcaacccaaagcataaaaccaccaccaagatgcaatgcacagctaagccccacagatgtgatgtcagtgggaaaacgccagagacaagagcggggaccatcagactccatgtatctgatgtttagaaaaggcccaattagtccttgatgaaaataaatcagacagtggctgcctgttgggaggggaggtggcaggcaaacagggctgactggtaaggcatgtggtggtgttttccgggaagacggaaacattttgcatcttgacaggggtgtgggctacaggggaattcatattcatcaaaactcacttaactgaatacttgagatccgtgcatttcattgtttgtaaattatatgtcaacttctgaaaaactaaaagtttctacaaaggaggaaagagagaaagcatttaagagaaaatggcagacaaaattaaagggaaaaaacacttgcaactacatatggaaaaggcacatgtcacctcagaccaactcacaccaaggcgttctagtaatattactagacttatgacgaacagaaagtcctttgataaaaggtaagtttgcatacaaaggaaagaaaattgtatttccattagacaccagtaacactttaaatcaaaaggctattgtcatggatggaattcccacgaattcacaggttgaagcccgtacccccagtgttgtgatgctatttggagatggcaccactggaggtaatcagggttagatgaagtcatgaaatagggtggggccccccagataggattactggccttatactgagaggaaggttctaggcagaggtcagcagtagctgcaaacaacacaaaaagacaacgagatattatgcacctcctgtggtggaacacagccaccagcggagccaactggcctccaaagaagaatgagaatgcgatcaaggtctaaatctagctgccaatttacaggaaataaaaagaatgttctaaacaataccacagcatgcaattagcaaaattcagaccctgggagacatcacaggaagagcaggcaggctccactaacaaagtaagtggatgggaaaaaaaacaaacaggaagggtggagtggatccagagacatggggcggagcctgcagcctggtcaccactcggcacctgtgcccatcacctctggtccaatgtcgcgctccagtgtgtaaggtgctgtccctgtaggggctagctgagggtggccctggaatttgtgctatttttgcaacttcttatgaatttataatgatttcaaaatagaaagttaaagagtttcaaaatctgtcatccaagtgcaacgcatggaccttatttgaatccacattcaacactctaaaaacaagtcatgagacaccagacaaacataaaggcttgatactcaatgttatgaagaaatcactacttttggtatgataatgaaacatcttatgtttaaggaaaagaatccctctcctttacagacatacagaatagtcacggatgaaacatgttcagaatttccttcaaaatcatctgggtgatgcgggaaaattacagctgaggtgggtgtggctttgaacacacgtacccaccaaaatcactcacccttcttttaaaatcagttcatgaatccaatctctatcaaagacatgcacagaatttctccagagagaagctgccccgtgaacactccaactagtcttttccctaacaacagctttccatcggttctcccggctcctcggaacagcagagctacctgagcttagcgatttatactccatcgcagcgtcgcagccgtggtgggggcatcatggggccacaacggaagagctctacggtcaggtgtggctcgaggatgtgagctcttctcagcaagggtgcatgcacagcactgctggctcacaaaactcatgtgcatgtgtgcatgtgtgtgtgtatgcatgtgcacgtgtgcctgtgtgtgcatcagcacaaagccaagaggtcacagtgttttgcttgtaatcaaagatcaccacgtgttcaaggaagaaaggaaaataatcccttcctaggagtcaaatcgatccacaggaaaagtcccataaatggccgaatggcagaattagtagatgacattttaagtcaggctacctgtatcccacccatccagaaagccagaagaaacatgagacgtggtaaacagagataaagaagatttttcttaaaatccaaactggacttccagatgtgggcatgaagatgtctgagatgagcaccatgggggccgctgcagagccaaggtggctgaactcaaagacacagcagcggcaactctgcagaggaaaccagagcagaaaaggactgaaaatgaacagcccatgcctgagctcaggccacctaacaaggacaagccacaggctggaaaacattttttcaacacacagatctgataaaggacttctatctaaaacagataatgacctcttacaactcaataacaagaaggcaagtcacccaataaaaaatgggcaaaagactgaacagaaacttcaccaaagaagagagatgattagccgaatgaagcacatgaagagatgctcaacatcactggccatcagcagaacgccaaacacgagcacaggatgctgcagccacgcaagggatagctgcaaccacaggacggccaggccatgtgcctgcaggatgaccacagatgagcatgccacatgcctgcgggacgaccacgggatggccacaccacgtgcctgtgggatgaccacaggatgaacatgccacatgcctgcaggatgaccacaggacggccaggccacgtgcccacgggatgaccacggatgagcttgccacatgcctgcgggatgaccacgggacggccaggccacgtgcccatgggatgaccacggatgagcttgccacatgcctgcgggatgaccacaggacggccaggccacgtgcccacgggatgaccacagatgagcttgccacatgcctgcgggatgaccatgggacagccaaaccacgtgcctgcaggatgaccacggatgagcatgccacatgcctgtgggatgaccatgggatgagcatgccacatgcctgccacgtgcccaccactgtgccgagaagcagggccctgaggctgctggtggggatgcaaaatggtggaactggaactgctttagaatgcaattgggcagcttctacaagcgttaagcctatatccacctacggtctgagcactgcactctcagctacttcatggaaagcacacatttctactgagactcgcacacgaatgttcacggcagctgcaagtgtgctggtcagaaaggagagaacctgcacacccaccatggggaggtgacacagtgcggcctcagcatccacggaccgcgcctcagccacagacaggagtggcctgggagacacgcggaacacggaagactcctacagcaagtgtgctgagtgacggaggccaggtgaacatcaggttcacactgtgattccgttcacgggaaattccaggaaacataaaggtgtgaccacaatgacagaagcttgtcagtggttgggagcgaggaagtgggggagagaagtgtcacagaaaggcaggagtaaactggaaccccagggtgatgggtgtgttcctctccctggctgtggctgtggcttcagggatacacatgcatatgtccacacttgtcaagctgcaccctttaaacacaggcggttcacggtatgtcaagcagactgcagtaaaggtttaaaagaaaagcaactcctctctgggctcctggcccagtgcctgcccattgtccccattagactaatgggcatctcagacttgaggcattccttccagaactggctcctcgggtgtcctctgcaactccagagacacttgctccatcctcccactgcctcagaggaatgtgggagtcctccctggacccctctcagaccccacatccatccatcagcaggtcctcacggctctacccacaaaacacgccggggggtgtctcttccccctacgtccctcacccacacacccctgcgggcctcctgtgccactaccatggtctcaggcaggcccccttgtgcccccaccctccaatccactctccacatgactgggagtgtgatcctggcaagtcagctctgatcccaccccctgctgctcaaagcccctcacgactcctgcgccatgcagcgaatgagcctgagtgctccccacgccgcctttgtgccctccccacttcccctcgctctggtccctcgagtctcctctgtggcctgggcacccagcacattggcaccgcggggctggccacctgtcctttgctgtggctggagcgctcctcctcagacatcccattttccggtcggccactcatttcttccgtctctggctgccctacctggcgctcctcagcctgcgacagacaggcacatctgtccagcactcctgttacaatgtaaggcctcttgtgtccactatattcccggcacccggaacaggagggcaggggtcttgtgtccactatattcccggcacccggaacagggggacagcaggcagtcaatatttgctaaatgaacggaagaaatgccaagtcagcatcagagcaagaaagcagctctcaaagcagagaggtgctgggtgagtggagggcaagcgaatgaaacctgtctccccttctcacccatgttctcagtccatgcccgtgccctgcagttgcacagtgacatccagggcaatgctaacacccagggtgccaggggatcctcaggggggctgaacctctccagccaggtgtgatgtctgcacgaaacactctgccccggtgcttaccagggctcagtcacccacactagggcggacgccagcactaaatgcgcactcaactagaagggaaccacagccccggcactggccatggtggcatctgggggaagcagacctcgggacttgtggcacctgtgccaagggaagggactgggggagagccaaccacgtgccctgtctgttgaacgtgggatctggcccagttgaaaagggcctgcggcagggtggccagctaggcagtgagcgtcgggtctgcggctcttcccgtccctccaggcttgcctcccgccccgccaccccgcaagtgcacatctgcacacacaaccacctcctgtggctgcactgctacctctcatctgcttctacctcctttgatttgcctccaaccccactgcgcctgccatggagatgggaggccaggggacgaatcctgcacccctccacacccagccagaaccaccaccgtctctctgtgcctacagtcaaccctcagcccagccatctgttcatacttgcggccttcctcgtgcctgatcctgcactggacgattccggtgacactgagcattcatcactagctgcaattgtgttaagggacagagatgagggtgccggacaactgtacatgagggggctgctctggagatcccccaggcctgctgccagacgctgaagccccagccctacccagtgcacagatacacagctccacacatcgctgggctggggtcccatcaaacctcagctaggaaggcctgttccatggattacccacgtcctcctccagcccacccaggccaggggcctcaggtgccaccagagggaggaaggcctgatggtcagccccggggtcagcccaaggtgaagatgtggcctcataggtccacaggccctcgaactgcagtgtcctgcctggtgctgtagggagacggccctgctttttgtccccaggcctgggcccccatgactcccaccaggcacgacctactggctcctgggcacctgactttgaaaagccagcatctgacaccctgctctcctgcagatccttctatgagcagatggatacctgctccaggcagtaccacgcggccaggcgaggacaccctggcagcccccagcgccctgagggagaaaatgtggcaccacaggacatcctgggttccatcccagctcccccacagcccaggtggggccatcaggccagagtgctgctcctggggagctccaggcacagcgtgccgggggcgctccgggcaggctcccctctgagctcaggtcacacgccctctgctcacggcgagcccaccacagcccggacctgtggccagtaagcccagggtctcagcatttgaatgtccaaaccgataggctgcgggaagaggcgaccagggaaggggaagggcgtgggatgagggaggcctcaggggtgaggggctcaggcgacaaagaggaggagggctctggatggctggagagaggcatgtgcagaagagagctggggaggaggctttaaatccacccaccaaaagcacagtgaggcggggtgcggaaagtgtgtgaggttcggctctggactctggccaaggcacagaaagctgaggctgcccagcctgcagagcctgtggagaagggatggggaggggaaggctggcagcccagaggaggcagacggagaagtggacagatccagacagccctgggccgcagccagacatgggcgcgaggctcgtctaacagggctggagccaggccctggccctgacccggacatcctggatgccacaccacgcacactgtcacctcaggtggcactgctcatccccatgtagaagtatggaatccctacctaggccctgtcccaccctggagacagaaatgaggcagccccaggtcaaccgagagacacccccaaacagctccttcctctggctccagactgggccctgtccaggtgaccgcacacatggtctgtagtgccggacacaagggcagatggccaagaccacagaggccacaggagcccacagagccggctgccgcactgcacagctactaccgtgggtccccagaacagcgggcaccccaaagcagggcccctgcgtgggcacaggtgtcccccacacactctcatacattgatgtctacaaacggccacatctggggcaacttcacaattggatcgggttcctggggcaagatccacttgtcaggaaagcacagacaatggcaaagcggcttctcagtgcctgtcacgagtgagcatggccagcacgctctccagagcacatgggagagtctggtgaggggcccttggtctccaaggtcacatggcacccgctggccctgtgggctcctggacttcactggaagtgacagaggtggctggcaggcgctggccaagggcgcacccggctggggtgtgggagccactcctcgcaagccgcatgcccgggagagcactctcaggaagaggtccagaatgagcggcagccttctgattgccaagagaaagcgccacccgctcagccctggctggggcagctcgttcctgccttccagtcaccagaagcccacagctgagagcctgcagaaaaggagatgcccccaggcagaaggaggccagagagcccaggggatgcagagagggtgactgcctggcccgcccacccatgatgggagcagagtgctcctagaacggagaggagactggcaggggcaaggaggtgggagggagcagccttcagctgcactccagatagcatccgctgccctttctcagcagcttacgcaatttatagctgagaaatggcccatgaggtcgaaaatcacaatgacagctgcaccaagggggatgtcagccctgggagggcgagaagaagggaggtctggactcaggaggcagttttctggggccgccagggccttgtccatggaagggctcacagcacctgcccactgggcagcccacatggctggcggctcctggcacccacgctatgctctcagctgccccagaagctaagactgttaaacaaggggcactgaaaaaccccaggtgacaggagagccccatgtgtgaattcttccccacagctcccttcagagtagactcagccagctagagaactcaaggtggaggctgcagcgagcggggagaaacccacgctgtgtctgcactcacgcgagtccaagacagccagggcagggcactctcgggactcccagaagacccccagggcttccgcagcagctgtgtcacgagacatctgcggcacagagtgcctaggctaggccggggacctgctctcctgaccacacaccaagcccggcagccacccgagggtgaactgaggggaaggggaccgcactggggcacggacgccaggcacagacaccgaatggctggctttgtcagaagactctaggcaaaccgtggaataaaacgcgagggaagggaaagagactcgttcacagagaaccttctaagtgccaggcctcgcatgacattggcgtgtgcttcccaggcatcccccgacttcagccaacaggccgctgcagggcagacctgaacagacgtgcacagcctcaccggaccctccgctaccaaggaggcctttgattggaactcaaggctgcctccctctaaagcacggtcctgttgcagaaaaaacaaatttagccaccccagcccaacactttgggaggcctaggtgagaggatcacttgaggtcagaagtttgagaccagcctgggcaacataaggagacccccccaccccatctcaaagaaatcttcaaaattatctgggcgtggtggtgtacctgtggccccaactacttgagaggctgaggtgggagaactgcttggggccgggagttcaaggcgacggagctatggttgcgccaccgcactccagcctgggtgacagtgcgagaccctgactctctaaataaatcaatgatagttaaaggaaacacaaatgtgcgttttaggaaccaaacacactgcctttgaacttggttccaggacccccaaaaatggcttttgaagcaagtaagccccgaggtagggatcggcaacactacccagaaaggaaccacgcccacatcaagctaaaggttgacctgaaggggcgctcttacagggcctgcccaaagaagggagtagctggattctgagaacagccagtccaagagcagcgctccagccagctctgaataaccaggcttcagaacccctcgacttcctcaactggcacccccgagacctgtccctgcccattttactgataaggaagcaagctcaacaggatattcatacagggtcctggcatccgctgatggcgttttcggatctagaaaagagaccctgtacaaacactgaaaagtaccactggaggttccaagcctccctagagtcctggaataccacctctgtagcggcaggggcagagaaggttttaaaaaaaaaagccgggcgcggtggctcacacctgtaatcccagcactttgggaggccaagcagggcggatcacaaggtcaggagatcgagaccatcctggctaacatggtgaaaccccgtctctactaaaaatacaaaaaattagccgggcgtgctggtgggcgcctgtagtcccagctacttgggaggctgaggcaggagaattgcttaaacctgggtggcagaggttgcagtgagtcgagattgcgccactgcactccagcctgggtgacagagcgagacgccgtctcaaaacaaaacaaaacaaaacaaaacaaaaacaaagaaacgtctcaggagccacctgagaaaagctgctctatgacttcggacagtcaggagcactgcatggagccttggacgtccacgtggagcctccatactgtgcatcagaggcagggaaaactggagttgccaagcaagtaaaaccccggctggagtcggggagagaccactcaggacacacatgtccatcggcaacacaaatcaaaaggagaccacagaccatgaggaagacgcagtctggactaggaggggatgggcagatggggcaggtttctgcagggagagccactggtgcaggggtgaacatggccccctaagccccgcacttcccctcacacagcagccaaggctatttctgtgctgacccccgtgctggcagcctggctctagccttcacacgtgactgtcccccaagaggggacagcagcatgtggaaggggaaagagcttattcctacatgcccggcccagagcgcagcacaagcccatcctgccctggctcacctcctgttcccaggggggcactgccctcctagttcccacagcccagtcagcagaggaggaggcagaggaggagaaaatgccatcaagtctaccccaaacccacccctgctcctagcaagctggccaacaagcctcacaccaaacaggaaagcacccgaaacacaacagctttcttccacgccaccctagtaggagacagtgatagcctctcctcctagtgcaaggggcctctctgccacagctgacctggaggtgccaacgtccatggggcctggacaggctgtggcgctgccagcatgcagagaaggactgaagcaagccagggccatcgtagccctgaaagaagtcccaggcagtgccacagggctcgtaccctcagacagtatgccttccaagcacagcacagcccgtgggccaggggacatccaggaaggaagacaaggggggccaggctgggggtcaagggtcctcctggggtaagggtgatcagagactgccaggaggccaagagccaggtggaggccatgcagaaggagccacctggagccatcggcggtggggctgggggccgagatttcggtataaatttagaaggcagagtaatgcaccaccgcacctccaaaactgtccatttcaagctcaagtcaagccaaactctgaacaattaaagtggctactggagcctgcctagtcattctcccggcccccagccaccactgactgcgggagggcaggggcctccagggatctctgacccctctccctcctgatgcctgcatttcgctcatccaggaaaacccctgggctggggggcaggtaggacttaagagcccccatctatcatgctgctgaaaaaagtggaggagcccccacactcacctgctcacagcaaggcggtggggcgtggactgatggttaaaacaaacaagagcgctcacgatccctcaggagctcacaggctcagaaaagccaggggataggtgagaccctgcctctctgtcactctgcgctctccccacccccagcttcacagagcccagcagggcccaggccgcctaagaacagggtggtggagccctgccaggccacgctgcccttctctggctggtataaaaaccttggctgcaaaatttagtccaggctgagtccctgagtcccacaggaaggaagctgggagccccacaagggaggaggagtggcctgcgagagcacaacccccaccccacggccccctggagctggcgagaagtcagcccgaagcgcccactcgccggctcctgaggacgcctggctgtggggaccctcttggtcacgggcctgaccccgggtgctgccatggccacctggcctgcaggggctcaaacagaaaaactggaaatcaatgtttttgtcagtatttttttccccaaaaaatattgagatcagtcgagaaacagcttttccttagaaaaatgccagagagaaatggaaacgtgccctggcgctctggaatggggtggggcggtccagagaagggcacaaccccgagagacgcatggaggtgactggtgccctgccctcccccctgcgctctggaacagtgcggggggggggggggcgcctccagagacggacccaaccccgagagacgcatggaggtgactgtgccctgcccgcccctctgcgctctggaacggtgggtgggggtccccagagacggacacaaccccgagatatgcatggaggtgactggtgccctgccctccccctcacagccctcagcaaagccacccgccataggcctgcgggagaacgggcactcctgatgtgcacgcaggcagctctgggtgggcagggcagcttcctgggcacacaccagctacactgcaaagggtgtggtcaaacgtcactgcacagacccccttgaggtgacagttcgaacaaacaccatcctccctgtcctgctgtggacgctggtgtggggtgcgcctgggacagggctctggcccgaggtgtctggtaaagcgggtaacagggtggactccagaaggctgggaggaaggcaactgaagacccggaagcccactcccaggggaaaaggacaccgggcgggcaggggctgctcctgcaggggcacattcccctctaataggaaacgctgtttttgtctgtgaaactggagaaaatgcgtcacatgcgggagaaccccacattccaaggcaagaggagaaactacagcgggaggcgccacggcccacacttcagattcctcaagtggggtccgtggctgaggctgcgcagggaggagacacagcacagggtgcccttgggagcagaggggtgccaacagctgtccccacacagggcgaggcctggcctggcagcctggtccctcatgcacagtgagttccacgcagcctctgcactggccacccagccaaccctgacccagcctcgggcctcagccagagaatcctcctcaaacccaagtcaccagggcctgcctctccctctcagggtcatgcacgtgccccctgaggccagccttaccccggagtcctcagccccaggagcctccagactgttcctcccacccccaacatcattactgccagcctttgcccaatgtcatctaggagaccccagcttccacctcaaccagagatgccatccgctctgtgtcctgctgggtcctaacagtccaacaggagcggaagcaggagtgcagcagtgattttctgctctgtcctgggagctgagaacaggggcagtgctggcagctggaacctgaaagcgtttgagtgagtgagctgctcatatacaaataagaatgtgtgcaaaccaataagaacaaaatgaccatcacccctccccaaaaaaaggggcaaagaaaaaaccattcacaggcagaaaataactacaaatggttaataaacataagaagatcaacttgcctaatttagaagcaactgaagacaagaccttccaatgacagccagtgccaggcacccccagccgagaagctcctcagaacattgagaatgtaaaatgggaatttatctcaagtattcaaactcggaatgactatgaataataaacctgaatgaagcattgctcataaaagaaaatgctggaaactgcctaacactcgcagggtctccttagcaagtcctgctatgcagtcatcaaagagggagaagagcccagtgggcagggacctggaggtcagcgccagggctgcgaggcacccgggaggtgagagccagggctgcgggggggacccgggaggtcagagccagggctgcggcggggacccgggaggtcagagccagggctgcgggggggacccgggaggtcagagccagggctgcgggggggacccgggaggtcagagccagggctgcgggggggacccgggaggtcagagccagggctgcgggggacccgggaggtcagagccagggctgcagggggacccgggaggtcagagccagggctgcgggggggacccgggaggtcagagccagggctgcgggggggacccgggaggtcagagccagggctgcgggggacccgggaggtcagagccagggctgcgggggacccgggaggtcagagccagggctgcgggggacccgggaggtcagagccagggctgcgggggacccgggaggtcagagccagggctgtggggggacccgggaggtgagagccagggctgcggggggacccgggaggtgagagccagggctgcggggggacccgggaggtgagagccagggctgcgggggacccgggaggtgagagccaggcttgccgggggacccgggaggtcagagccaggcttgccgggggacccggaaggtcagagccaggcttgctgggggacagctggaaggtacacacctccagagctttaggggtaagcctgtgtattttactttctttatatttctccgaattgttggaattttccatgttaaaatacatcatcaccacaatcagaagaaaaaaaaaatttaattttgggaaaagtgaaaagacctccaaagaaaatgcccagaggaggcattttattctagtttccaaattttcactaatcttccttttataattgaaaaaaaaaagtgcactatctacattctaacagatttttgagaagtacatacaggaaaacatttcacagtttcctaaaaacttaaacacacactcgatgatgcctgcctcactacgcgcctggaggcttgtctgcgaggaatcaaaggaatctggtagtgatggctgaaaactgggtcccagatgctcactgctggggaacagggacatcagtcaccgaatctgcactaagctccaagaggaccaactgccacacgcagtgtgctgactcaccagagtgggaaaaccacgcagaagatagcggggccacagggagcatccaccccacattctagaatggagagagccacacagaagacagcggggccatggggagcatccgccccacattctagaacaggcaaaacctccagcaggacgaggagctttcctgaggatggcacaggctgcaggcactgcccacacagacctgtaggttcaccaaaacttgctgaattgcatgcctgaaatcacagaattctgccgtatgtaaacaacaccttcaacacagctgcttccaggtgtggtagctcacgtctgaaatcccagcactttaggaggctgaggcaggaggatctcttgagcctaggtcaagaccagccaaggcaacacagtgagaccccatctccacaaaaaaaataaaaattagccaggcatggtggcgtgcacctgtggtcccagctactcaggaggctgaggctcctgggatgtttctatcactgggaatcgtgacttttcacactgcaggggatgagcctggtgtgtcaccggccttgcctcctggggctgtctgaagctgctgggcttctggatgtggcccccccgtgggtgtgcaaaatcctgtatcataaaaaaaaccagctgctcacacgcacacttctccaattcaagcagaagctgctgaagcacaaacaaggtgatggctgtggagatgggctggggggctgggcggccacccccatcaggtgggctcctaggtggttggtaccacggccgggacaactcactccatcattagaactttcttcaggatggaacacagggctagggttgaattttcctccgttttaagaagtaaactagttttccctcaaagggaaatggtttcccctcaaactgtctttaacaagtagacactgcacgtagaacaaggaagaatgaaaagcatgggcgggtaccatgaacacatgtgtgtgtcaggactgcaggcaacaggcacccctccgccagtctcaggtaaggcgccgtcactctagttgcttacactgaagccaggtgcagcctgttcagaatgtggaagacccaagatgggcttgaggcaagacaggtggcagaggtggccccccagcgaaacacagctggggaagagccctgggcctccccggcagactccaagtggttcctgacgaccaggggcaaagtctcatctctgactccccactgctggcacagccacacacggtggtcctgctgcccactgcccactctctccgcatccttagacccttcctctctcctcacattcgacctcctcagaacttcctgaagtgggtgcttgggaagtaactctttcagaactcacacatcagaaaatattttcattctactcttacatcattgacaggttaactgatgctgaagtctactctggaaatccttttctgactgcattttgaagaccatcttctactttccaggttggaattcatattctggttctcagtacactgtagataacctggtgctacgctctgaatgtgtcccccaaaggcatgtgctggaaactgaacacccagtgctgcagcgctaggaggtggggcctggtggggggtgattaggggtggggctgggaggtggggcctggtgggaggtgattaggggtggggctgggaggtggggcctggtgggcggtgattaggggtggggctgggaggtggggcctggtggggggtgattaggggtggggctgggaggtggggcctggtgggcggtgattaggggtggggctgggaggtggggcctggtgggcggtgattaggggtggggctgggaggtggggcctggtggggggtgattagggatgcgggatgctctgccctaggaatggattaatgtgattctgaaagggcttggggctgtgagttccacctcttgcccttccacctctccccacgaggtgacactgcacaaaggctcttgccagacatgggaccctccatcttggaattccaaacctccaaactgtaagaaataaacctctgttctctgtaaaccactcagtctcaggtattgtttcagcggcacaaacagacgaaggggttttgttttgctttgttcttctctctggaagttgtaaaaatatgctctttatccctggtgtcttctggtgtcgccttttcattcactgcattggacactgtgtgagcccatttcatctgtgaattcatttctggacaactgtggcgttcctttggtgatttcctcccttctgtttcctgctcttcctggaactcctaccaagctacagtgacccctgcctgatgctcggtttccgtacctttgtgctcctggtgtccatgcctgatacccgccctgcgcagtcggcctgctgggaagggcgcgcagcaccatctcccacacctcactggctgtccgatcctcctctctcaggcactctttgctgtgcaccggacgctcctttctgtacaagtctgctcttgctacgtggtctttacaactctgaggagacccacgaacgctatgctttactctttggtttgggctggcttcctgctttttcatctgctttggtctatctggtgacccctgccccctcacatcacatgtggcaggaggcactgcaaagctcactgatggctctaggtgcacggagggggcttcgctgggggagtctggctgtattcaacacctttccagcatcacaggaaacgacttaccagattgaagggactcacccagcatccacgtcattgaatgcagaggccacatcagggaacacactgacatttcagaacactaagggacatgggtggcccctcctccccactcccagtgcccaagggttttttctcttggctgaggagactcccattctctgctggagggtggacctcagctgctggggtcctgaggacccggtgtgggaggggcagaaggggacctccctggtggatgtggaaagctgtcaaggcttcatgtgcaggatgatgccctccactacgcctgggtctcagcggacagtgctatgatcccacgtgctcggactaatcctccagacacagatcagacatgaatggggtgtccagctgcttctaaacacacctccagcctccagaccagctctgctgtcttcagctccaccatccaaggggctcccagactccatgggagccatccacagtttctcagtgaaaacacttcccctgctggtcagatttcagctttcctgagtttgcgttcattccacccgaccctcagctttccaacttccaaaatgtgtctgctctcgtctcctctgcactctctgctcctgcagatttctgcctctccgaaactccctgggcgcttatccaagtggggtcgagaagcagggccagcacagaggctcactggtgctcatcagccagagccctgtctctctgctcttcagcatcctagtgggacgggagcacccagggaacacaagtgcaccatgacgcggagcccttcatcaccgcaggccacggcgcttgtccttcccagaggcccccaaccacagctgctgagcgacacccacaccgcttctctcttcacacagcggactgatgaggagtcccgccaagcaggagctctgagccacagcacagagtgtgctggcccaagtccacgcctgcatgcaagctcagccatgcgtctaatggcaataaccgtggaatgagctcgtgaggttcggagagtcccaccccgacggggagagccacagggagccccaatctcggcagtgaccggctccaggtccccacgtaccgtgagagtggggacagcggtggacagcagcccttgagcagggcacaaccttcagagagacctcgacaagtgaacacttaaaccaaggtcgaccctgggggaaacgcagacctcctcccagtgcccccttcagaaaaggtactcaaacactggctcccatcatgagctgggcacggaaccaggcatgggtactacctgcctccagggcttggagctcgggaggggaaccaatcccgggccctcgacctgggaggtgccagaaggccctcacacaagactccagcactagggtggggaggttaaagtaaacaggacagaggggttcaactaagacaatacctttgctcacggtcagaggcgaaggcactgatgccagccggcgccgactcaggtgagcacacaagctctcccgccgcggctgcaccacatgcctgataaagggacagccctggatgtctagttcctcaggcacgtgtgcacacatgtgtgctgcgtagcactggcaccccattcctgttctgccccaggtagctggtgcattccccggtgctcaccggctcgaccccccagcaacacgagagacctcacagagggagtcacactaacgtggtcggggctccagagcgaaaccccaaccactatgctcacagccaggaccgagcaggctgggccaacggcagtccctgcccagcgcccggctccctccgagtggccagcagcgccctctggtggagactggctcggcctccgcggcactgcattcccacggcagtggtccatctagtccccaagtcctagaggaggcccctctctctccctcagccctggcagggtccttggcgcccattctccacacctgcactccttggccctccaggaattaccggcctcaggggcgctcctggaagcagagaaggggatctgcctggaccttcctcagaggcacagccttcacagaggcacgaggggctttggagcagaggaggctgccacttatcagccagacggcctgggctcaattcccagctgcagggccctggccagtgacatcacctctctgcattttcccacctataaaatgggaatgctgacctccagcatgtcctgagcaggtagaagattgtggccctccccggggaatccaacaccagcccctggacacccctggatgctcctgggcatggcaagaccagcaaagtcacctcccagctgcccaaaaggagtgtccacaccaacaggggcagcagtgacccgagtgcttctgaacacaccatttgggcaatcatcttcaaaattaacagaaccaaggtgacgagaaaaaaggcacttctatggcaagctctgctccgagtggccatgaagaagctgaatcttctagctgtgcaaacagaaggtgccaagtactggctgctttctaggtctctctaggtctgactgtcatccccctcctatcagccccagggcagtacccaaaacacccactgctcagcggtggccacatgaatcagaagcacggcatcctgaggccatggtaagcaaatcacaggagacggctggtaatgaggacacgaaatatgctcggcctcaccaataaacagagcagcctgatgcatgtgaaaccacatgccgctgatggagtggggggcagggaaagactggcacccgccctgtaggggaaggggacagttagacagtggtgaaacctccacatgccactgatggagcggggggcagggaaagagtggcacctgccctgtaggggaaggggacacttagacagtggtgaaacctatcaggccagagggggaacgggtgcccgttcttagacacaagcaagggagagacgagccagtgcgggccctgctgcttgagcactgcacggtggggtggagtggaccgccacaaacaggcagaaaggagagagaaatcggagtccagtcctgtttgcagcagggctgcgttcaaatgcagagcctgcaggggatgccgttaggcaggatccagaacagaggaggaacccatttttgtttcagacaaagaaaggaagacaggcatgtcccggtctagcacacaggcccctgtggggagggatggaggcttcagtgctacttttcaccactgtaaggtgaagcatgtgactttacttttatagtctctcttccaacgatgaagaaaaacattacataaaccaaaaaataaaacacagagccacaacaagcccccccaggacagttgggccagtgcccagcctctgtggcccccgttccaggacgaccccaggctcactggagaggatgcaaagggcagagagtgcccaggggccaggctgcccggccccacctccccggccagcagcactctccggccctccagagccacaatgggtacacgctaccctcatgtgccggctccaccccctcaccttctgggggttcaaccccctgcctctccttctccaccaccctccgccatgccacaaacagctctggctgaggccaccctcagctggccgtgtcctcaattcccatccctgtaacacagggcaggcacctgtggaggctgatcatggcctcccctgcagccacccgtcacagctccttccagctccttctctctcgcaccagctcttcctgttgtcaccgctacccccacctctggctcccccaggcagcacgctcagggtataccagacagctcacctccagttcactgtgtccagagatgtctgacacaggtaccgtgtctgcctctgagaggcgcccccaacgcctgccatctctccacagacgatgccccaccacaactgctcagggactcccggccgccatctccaccacctccctccccagagtgaggcttgtcaattccctccgttatcggccagagcaccctggaagggggtcgagcacagctgggccagacgcaactcccacctctcagttcttcaggcaggctcctatcactttgtccctccattttgccacctacataacagggtcacggtaagcgccctgcagggtgtggcggtgagcagggggacagtcggaactccagggctggtcacggcagcacctgtgccagcactgtgcccactgtgactctgcctgatgtcacagctataggcctaactagccacataaccacagagaaaggaggtggctgagaaacaagggtctggggacagtaggaagatgctgcctgctctgacagacaccccccaccccacccgctgccccgatggagcccacttggccatatttgacaaccccagacaggatgcagagggacactgccctccatgactcacctcaaagagctcacttggaaggggaaaggaagggccatgaaagggtgaaacgcaatggcttctccctcccgtcctactgtgtgtccgcagcggttactccgcagagccgccaggtacaacagtcaagacatgggaaaacctcaacgcccaatgatggatcaagggatggggaaagtgtggtgcacacgctccgtggtgacccccgcgagactggcctgcgcacagggacggcttcacgcgtgtgacagcaggggagcaggacctccgggccagacaagcctgcggggagctgggcccccgtggtccctggagccgcctgcctagggctcgtctgcacagccagccgggccaccctttgtctctgcagcaatggttccgggtagaacccaagaacgtgcatttctaacaaggtcccaagcaacccactgttaagtttcacctacagctgcctccttacatattttaagttccacctaaaggtttctttgtacatcgtgaactatgacaagtacaggtgtaaacagatcatagcctatacttgtgccaatcaccaagttttggccaatcatatgtaggtaactgttcgagctgtgttcaaataaggcaaatgccgagcgtaaccaatcggctgtttctatgccttacttccgttttccgtaggtcactttccctttccataaatcttcccccacagggctgctctggagtctatgagcctactctggctcaagaggctgtcaatccaagaatcgtttgttgttcaattaaagacctttacattaagtttttcttttatcactgcccttgctggtgcccacaccccacctggggaaccattgccctacagcgccaggcacacacctggcctctctgcacctccattctggggcagagatgcaatggggaccaagtggggccgtgtgcacccagttctcagcggcacggtgccggcacgcagcagactccccttgagggtgagtgagtgtagcagagggacttcgatgcatgctctgcagggtcctccacacacccccagcacacatccatccactggacacctgccccaggactgccctgggactccgaacccaagaactcactgcccctgcctcccagggaaggccagcaagtgaaggaacgaaggccaggatggaaaggaacaacagatgtttccagcaaatgctaccatggacagaaacccagcatgctacaggggagcaggaggctggggtgtgaatctgggtcatttctgggcagcccctggccacccaggcagaagcacaggaaacagactgcggtgctgaccagagatgcaggacacggaacagagcggtaagctttacaccagtgaggacggcgagtgctggaaacccggaggcattctagttgtcatcacaaggggggacaccaggagaccgtgtccacaataacacacagtgggctttataagaagttaccccaaaatcaggtgttcaggataaggctgtgctggaaaaggaagctcagatggaatcaagagtgtccagaaatcaccagctgcctcacttgacacaagctgtctgctcaacagactttagaattcccaacctcataattagtcaaaagggattttaatgcaaccattcagtaatatgaaatcaagaactatgactgcaaaggagattgaatgttccttttaaacaacgtaaaactaaatactattgaatcagtggagaaatgaaaaacagagtcttgctaattttcattaatggagactgctttaagtctttcagtttatgaccagcctaggcaagacggcaagactctgcctctataaaaaaatttttttcaaaattcgtggggcacggtggtgcgcacctgtggtcccagctactcaggaggctgaggcaggaggatctgttaaacccaggaggtcaaggcagcagtgagctgtgattgcaccaccgcactccagcctggtctctaaacaaaaaataaaaaccaaaacaaaaaaactatttcggtaagaaatctaggctgtaacaaggccatgtggggactgcccactgtttctgcagctcactctgcgggcccggggtcagatccccagtttctcagggtcgtgttctgttccctttgctcatctctcctccagtccccagggaagggcttggtctccacggcgtcaggaactagactgtgaacttgcacgtcaatactgagagtggggcttccagagagcagccgtgcttgctgccctgcccctctcaggctgcagcccagggagatgccactgagacgctggccatcgggctggccacccccgggctccctccatcctcacggtcctgctctgtgctggcagtttccactgaagtccccctcccagtatgcagcaagcctgatctgctatcactcgctcacaccatgcctccgtgtctcccccacatctcacatgaagtaacttctgagcctgtttcaaagtttatcctgaacagggcgggcagtctggccccttcaccatctctttctgtgtgggtgcaccgaggtgtctccctgcagaagtgcattctatcctatgctggggtaaagatgcaagtcactctcaaactgctgagaaaagacccacgtgcaggtactgagagagagaaaacggcaaggcagatgtggcagaaacgctgacactggccaatctgggagaaggtatgcaggaattattcacactactttggcaacttctaactttgaaattatgtaaaaatttaaaaatataaacgtcagaagcagctggggccaggaggtggcagataccctcgagggagcagcagtgcatctgacagccgcttctccacagcaacgccggaagccggaggtcggcggcctcacgtcgaaagagggctgaaagcaagccaaccaagaacacgacacacagcgaaaagctctgccaagaatgaaggacaactgaaggcattttcagacagagactgagagggcgcccccagcagagtcacctgaaagaaaatccaagaaagctcaaggctgcagcacaagcagaggaaaactggtcacagacgcaaaaggacaaacccagaaggacaaaggaggaaggagagggtacagccaaagagatggagcacaaaaccagccaacctaaataaataccagcgtacaagtagcatgtgggggtccgaagtgtacagaatttaaaacacagcagtagcatgtgggggtccgaagtgtacagaatttaaaacacagcaagtgctcacaactcaagaggggaagtacccagaagcggtctagtatcttgggtacttcggggaggcggataaagctgttaatcaacatcagaccctggaggtttagcgtgtgctgtaagaaaaccactaaaggagggtgtgcacggtggctcacagtgtaatcccagcactttggaaggtgaaggtgggtggatggcttgaggccaggagtctgagaccatcctggacaacacagtgagaccctgcttctacaaaaaatcaaataaaataaagtacctaacttccaaggcaatttgaaagaaggataattaaaaaataaaaagaagaaattcaaacaaagcatgggaagatgaaaagcacaagatgggagttccacacagcagcgagcacaccaggtggaaagggttagcaaggcgccctgacacccgctctagtggcgcggtgctcactagacacccgctgtcacgtgcagtgcgtctaaggcttggggttttcccgggctcaccccaggggagacgtggtcaagggctctttcccagggctcggggccgtttgcacgtccttcttcatgaggcatctgttcaagcctctgcccatcttctacgggacgagctgtttcttgttctttgttggagcccgtggggaagtctggatctgagctccggtaagttctaggtatggtaaattccccctgcaaaagttgctttcttttttttttgaaacagagtcctgctctgtggcccaggctggagtacagtggtgagatcatggctcaccgcagccccgacctcctgggctcaagggatcctcccacctcagtccccctgagtagcggatgccaccacgtccagttaatttatttttatttatttatttatttatgaggtctcactatgttgcccagcctggtcctgaactcctgggctcaagcagtcctccagcctcggcccctcaaagtgcagggattataggtgtgagccacggtccccggccagccttttcagtttttgaggaatatctttgataaacagagctgcttaattttaatgtaaaccaaattatctatcttttcctttatgatgagtactttttagtcctgtttaaaaaaacttttcttaacccatgggtcaagaatagcatcttctataacagtgctgttcaagagaaatataacacaagccataatctgagccatggatataattttaaatgttctaatggccccattgaaaagtaaaagaaacagccaagattaattttatttaacccaacagatgtaaaatattttcgacttacaatcaatacagaaaatacaaggtgccactgtatttttttcagtctagcgtattttacactcagcacatctctagcgctgccaagctacatggctggaggccgtgctggacagcagttccagaaccttctacacttagacctacattctactgggctcaattattctttgtagggtgtgaggtacaggccaaggtttttttaaatatggctatctggttggccagcatgacttatgaaaaagactggctatctgtgccatctctttttccctgtcttgatcactcttgccagattttccactatattcctgttttcaaagaatccaactctggcctcgatgactatatctgtgggagactgactttctgctttgttaacttctgctccagcctcatttccctccatccaccgtctctgagcccagctactgctccgagagtgacgagtacctgagggctgtgaaccgctcctggccggtgtgcaccctgcaagtctcagcatggcatatttttgttatctttcagctaaaaagtatgttgtaatttccattacaaattcttctttgtcccactggttacttggaagtgtgcttcctaatttctaaatactaggagtatcactttgctgatttctagtttaactccacttgggtcaagagcacactccagaggaattcaattcaccgagataagcggaggttttggtcaacgttccatcagcgtgtaaagggggcacacagcctgtcaggggtgggttccctattcttcctgtcaggtgaaatgtgtgaatctggctttgaaatcttcatgctgacttgtgagtacagctgagctgctgggacaaaggcccaccatcccaggccccaagtccttccctggtgttagcccagggcaggggtcaaacttcaccctccaacaccttcctggggccccagccatggggcagccctgttctcaccaagggctgtcgaggagccgcaggaaggcaggaagaagaggaaggacaagcatcttccagacggtgactagaaagctccacctgcccccacctatgtctcagtcctgaagctcaggacacaagggaggctggagttcaagtgcctgagagcccacagccagagaagcttgcacggggtcagaaagacagacgggagtcagcaggtcacagccctgtgcccacaacaggtggcaggaaagaagctcagagacctgacaacagccacagcaaggacatgtgtgcacacaggccaggtgtctcggcagaactgcagacactggagggccagccaggctgaagtgcacatgggccacacagggtggggctggagagagacaggggacttcaccccacaggcaatgggggtccaccaaagtgccttgtatataggaggatgacatgtggatcctctcaggtggctgtgtggagcatgagtcaaagataaggacatacatccccgccaccgccaggtgcctatggctataagagcctaggcctcagcccagggaactgcgggcttgcttagggaatccagcaaaaccctcacagccttctggatggagccccatggcatggatggcgaggcgtgaggggaggcaggacgtggccttcctgagcagcaggctcgaggcacgggacacacaggccaccaccacaacttcaggctctgtaacagggacctacccacgcaaaaggtccttatctgaaagggctccatcctcaccctagagccctccacacgtcattttgggggacattttatttattttattttttatttttttgagatggagtcttgctcttgtcgcccgggctggagtgcagtggcacatcttggctcactccaacttctgcctcctcggttcaagcaattctctttcctcagcctcccgagtagctgggattacaggcgcatgccaccacgcctggctaattttttgtaatttcagtagagacggggtttcatcatgttggccaggatggtctcaaacccctgacctcaggtggatccacccatctcggcctccgaaattgcagggattacaggtgtgagccaccgggtcccatttcattattttgattagaaatgaaatgacctgcccaggcgcggtggctcacgcctataatcccagcactctgggaggctgaggcgggcggatcacctgagctgatccccagcctgctggggaaggggaaggaaggtggccacaggccccagcatagtacagactgacgcccttgaagtccacactgcaccgtgggcccagacagaacaggcctcccgccccgccctcacagaggtgcctcgtggacagccactgcatggcatagcaagtccctggacccaggcctgtccagaccctcgtgggagtgggatatgagctccacaaacgtttcggggggcacccaggccccaagtccctgttccaccaccagggcagctcaggagccaggacacttagctagtgaaccctgggacctgctgcactccgggggacactgaagagctcgggagccgacaaaccacaaatgctgctacttagaacctgtgtgtccaacaaggagaagacagcaaaggagggaagactgctgggcaggagagcacccgagacaccaccactcctaccaagaagtctctgaggacaactgtgggccaggatcctgcgtcgtcagcacagagctgccttcggtctgccttggagtaagggcctcggagaggcacggggtcacagaaaacaacacttttattttcacatgaattataaatacccaggaaccctcacacaattcagcttggcccagcacttcttcagccaaaaaggtaggaggccttcccagcaggaataacagaatgtacttgaagataaaggttttaatgaaaaagggtttctaaacctcctgacagtggccacctccagaaaagcccctgggtctccacactcacagtgcaggagtgaatgtcaaaaagcactcccaaggcagggcacagtggctcacgcctgtgatcccagcactgtgggaggccaaggtgggcagactgcttgaggccaggagttcaagaccagcctggccaacacagtgaaaacccatctctactaaaaatagaaaaatttggccaggcgcgggtgtctcacacctgtaatcccagcactttgggaggccaaggcgggcggatcacctgaggtcaggagttcgagaccagcctggccaacatggcgaaatcctgtctccactaaaaatacaaaaattagctaggtgtggagtacgcctgtaatcccagctactagggaggctgagacaggagaatcgcttgaattcgggaggcggagactgcagtgagccgagatcgcgacacagcactccagcctgggcaacaagagcaaaactccatccaaaaaaaaaaaaaattacactggcctggtggcatgtgcctataatcccagctactcagcaggctgaggcatgggaatcgtttgaacctgggaggcaggcggaggttacagtgagccatgattatgccactgcactccagcctggatgacagagcaagaccctgtctcaggggaaaaaaaaaaaagcattcccaagaccccaagcacgagaggaagcaaatcccttctgtgcatcccaacgcagagctcatctcagaaagctctgcgtccaggtgtccaggaggcagccagctggccaggcagaggcataccctgggtggtcagacccatccagcgcctgctccctgccctgggcacgccaggtacagcaggggtacgtgtgggtctgtggagaagatgaagcctgccctgaagcagtatttgttacacatttatgaaggcaaggaggacacaggaaactgttcagcagaaaacgctgctgtcacgaagggagagatagccagctttgggaaatgaaggtgcccactctgccctcaaggaagcagcaagcctcaactgcacacccgccacacagctacccaccagccccaggcagtctcaggccacacatcccagaggccccgtggcatgaaaagaggatctctgagggcataatacccgactccccggtggggagtaaaatcacctctggagcacagccgggcagacaccaggcctgcacccccgtcggcactgggggtggtgcctgtggaccatcggcggctttaaattctcttggctgctcccgttccaccatcccctctgacagctaagaacaggctgagggcgggcaacgggagtaggaattgggtgggaacagcgggtggcagcggccgggcagtggcaactacaggtcacacagtcaaccacggttcccttgctcagagcctgtaactactgccatccactgagcttccaagagggcctcagactttacctggggcttcctgaattcacctggttgtctgggaggactagtgtttcttgagagacggtgagaaacatggccctaagccctctgcgtggccccgtgcccactgccgtctccatgctctgaggagcctcagtgactaaacgtggtcccaacctgtaccaggccataccaaagtcctgaacaggtcagtggtgtcaggtgccagcgtggcctggatttcttcctgacagaggaactaaccagcgcacagctccagccactcagaaaggaggcaggtgggaggctgtaaaagaaagtaagggacaggcctggcatggtggctcacgcctataatcccagcactttgggaggccgaggcgggtggatcacgaggtcaggagttcaagaccagcctgaccaacctggtgaaatcccgtctctactaaaaatacaaaaagaaaaaaaaaaaaaaagccagttgtggtggcgggcgcctgtaatcccagctactggggaggctgaggcaggagccaggaggcagaggttgcagtgagctgagatcgcaccactgcactccagcctgggcaacagagtgagactccgtctcaaaaaaaaaaataaaataaaataaaaaataaaaagtaagggatggtgaaaagaagagcatccctcaggcgccagccaagggcaggagcgggcccagggccagcaggtgcccaaggcttcctggcactcgccctcccaggctgccccctggcccccagctcccccggcccccggctctccctggccctctgggctggctcgcagtgtacctgtcctctgcccctctgcaggccaggggagtcgtggagacactgcctcgggctccagcacttcccatcgtttccgcctgggcttttacttttctctttaagaacaagctctaaaatcttaacactcaagattaatacccttaaagagaacccatgccagtcataagaaaactggaccagttcaagacaaagtaggcaaagaccaagcagataatggcatggcccaccgtgcatagaagcatcggccatatcagccctcctgcagtaaacacggactaaaccttggcaccgctctctgcctgtcaacgtggcaaagatcttcttcagaaaagaccaacacaagtggcgggcaccgacctgtggaaacaccagcactggcaccacgctcccttcccagggacttgggaagcatcacacaacctgggaacgtccccattcccaccggcaggggagcagtggacaactcccctgggtagcaagagtcccactacagagtgaggctggttttaatgttaagtacagactatcgctgggtggtaggaggatttgcttttgattttctgggttttttttcctgtattttgtgtctctacaatggacatgtaacaccaagtcccaggtgagcagggatgtgtccttcctcctaaggtccccccacccccgcaggacaaggcacataggacaccagcagggtccaatgggtgctgggaagatgaatggctgctgagcacaacaacctgaggccaggccctgcggagccagaggcaggtgcgggtcagccccaccctcagcaccactcctggactccaccagccagcgctacccactgttacaaaagcatcaacccagagggagctgcggtgacagggaagggtcccgctgtccctgcccgcggttccctctacccaccctgtggggccagaaacccggctcagtaaacctcacctcccatgcacctttccttccctgttggagaccactgggcccatgctgaggtcccgtttgctgagtcagagaatggcacttgggaagccctgtggggtctgtcttgctgagtagccaaggaacccacccagggctggtaagaccactgccagtgcagagagacgtctggtgaaggggcgtgcagtgcctccacagagaagcctgaccaaacacgagaaaggacaaaagcccacaaacagcggcttctgaaaacaccgcggacacagccacacaggagcagcttatctgctcgtagcctgttttatacgatttctgccatttttgctagggccagcttgctgcttggtaagtcccaggcagtgtggctcggtgggttccggggtgtgctccccatacctcccaagacagtccaggccagcactgagtaccgacaccccctcagaccggcgactagggctcaggaactcttcctaaacgaggggctgcctgagcagcctctccctagaggcgtctcccgggccacactgaagccctgtcacagtgacactggactgaatcaagctgaaagcttgggtgaagccacagaacacgttgggccatggcctgcacaggccgacgctcacctgagcgggcaccatgaaagctcagcaatggaaacgcgggctgtccagtgttggctctgcctcggcagccctcggtggtacccggagacagcacctgccccacctgcacaaccccatggcccacagtagtgccgggctgcacgccctgggaggaaaactaaatggcaggaagaggaaggtagcccgtgaggagggccgagccctgcccagaagttagagggagagagaaaaggccttggtctctgaggtgaccagccagggcctcctgaaggaggcaggaggaccagggcctcctagagccctcctccatccagaggcaggctgtccactcttaaccactcccacccccagatccaggtggctccgtgactccctgaccaacagaaggtggctgaaaggatgtattgtcttccagccattttcatgatggctctcctgggatgaaggccgtcccggcagaggcaaagagaggccacgtggggagtcctagagcccaaagtgtggtctgggaccatgaggttagcactgtctttacagtaccacaaaggtgccatgtgccaaagccttgtggaagccacctggcctgtaaaattacagcaggataaacacagaacctgacagatccagctctcgagatttgcaaaaagtaaagccactctatttatttgactctagaagataataggttttttttttaattttaaaaatattacttatgttaagatatactgggtttttaattatttctaaatgaattaaagttgttttacattctcaattttaatttctgaaagatgaatattcatagctccatcatgtaaactcaataaggactttttttttaattttagaggcagggtctcactatcactgagactggagtgcagcggtgcagagctcaccgcagcctcagcctcttgggttcaagcaatcctcccgcctcagcctcccaaacaactggaactagaggcatacaccatcacatctggctaattctttttacttttttgtacagatggggtttccctatgttgctcaggctggtcctgaactcccagtctcaagtgatcctcccaccttggcctcccaaagtgctgggattacaggcagaagccaccatgcccagcctcaacaaggactttaaggggtcctgagagcaagaagtccaaaaactctgctctagggtgaggatataaaactctgcctggagagatccatgtgggggaaactgtggcaccccagcagacacccatgacagcaaggcccctgagggctgccagcccagccaccacgggtggcagtgcaggaataacctgtggggccagagccccacccaccagcccacagatgcgggaaaggtgatgaggcctcatgttaggcccagaagtttcagggttggtcactcagaaacaggtgagcaggaaccacccacggccaagccggaggctgctgagccatgcccaagatcagagacgcacgcgtctggagcagcgcctgacacctgaccctggtggctgaccatgcggcctgcctggcagtcctgggcatgggatgcacacccgcaccctggcccacccaggggcagaagaggggaccacgaagttgtgtgttttctgctgagagcatccaccagagcagagctgctcaggagggcacacggtgctgcaggctgagcatgtcacacgcagagccaaggccgcctgctgggaagcccaccgctggcagggagcacagcctacgcacagaatgatgctctcatggtaatactccccacggaaccctgcaggggttcattttattctatattgtcatcttttttaacattaaaaacttggctaccggtgacactgattatttcttttaacccacaatattcataagatggttgccaaattgtaagagcaatctgacctgccaccgaagcctcctgagcgcagcctgaggtctccttgctgttcctcctgtcctcagactgtcccccatgcccacatgagctcaagggctttgctggcacagctcttcagctcagaggttatccaggtgatacacagccaggctcaccagttcctgctcacagaggcttccctccctgccccttcgtctattcaactgatacgggagctgagtcacatgcgctcctgctggctaaatttgacacagcccattcatcaaaatattattaaagacgacaatcgactgaaaaatattaaataaaaacccacgtgtccctggaaccatgagggggaggaggcaaaggcagcccttctgagacaaagcaccagggagccagggctccctccataggcctgcatggcgagtcccctccctcacctccgcaggtctcagctcaacagcaccttctcaaagaggccttctagagctcctattcaaacagctctcccacgcaccccctccaggcaccccatcccacacctccttactcccgtccccctcggcagtggggaagctgcccaggggtggctcctgttgcctctgttcacgcgtgtccggagcactcagagcaggctgcgcgcatgcaggcctccaacaggaacctgactcaacccagattctcaggcccacactcttgtatttcatgacaccactgctatgacaaatggtcctgtcacatgtggcacaaagaacagggcacgcagcagaagggcagatgtgccgggaggaggaacccagagcggccgcccatgtagagggctggccgcaggctgtggggagaggccagggctgtgcaagacaaactcaacacagacaagccatgctcacgccagcagctttcaacccacgccggagctaattttatgctcctgggctcacgcccaggcctggccccaggctcaggcatctggctcctcagggccacctggcaccatcaggcctttccatgggctgaggacaagtcccagcaaagcaggagttaggagcttccgtagacggtgcaggccaaaccccgagacaacagccccacctgggctcctgagattgcattgctgtggggatagggtctgccagcccacagcctgcacagccaccatgtctggaggggaaaaggcgctgctgaaagggtgcttggaagaaaagtctcccaacccgcaaaggtcacgggcaaaagggaaacagcatggtgcctccatgctttccaaccctccagcttgcctgctttctgcagggaaaagctgcatacctttgtgggagctctttgcctccccgcccaccacagcgaaatgctcgatgacacagaccaaaatcaccaccacgcagggcgaaaaacaggagctgcggcacttaactcactcacattaactaactcacgttagccccgggacatccgcaaacaactgcagggatgaatgaacagacattccagcccagggagccgtgtgcgctggcaaaggagaccttcaaagagaagggagccagggacagcaacgcgactgtggccacagtccacaggccaagcagtgccacagatcacacgtggcctggaagccctgcccaccatctccttcttttctctttaagcttccacattttgtttgttccaattgtttctacttccactgaacaccaatgggtgtgccccagccaggagaaatcctgtgcagaaaaaaacaaacatggtgaaggcaaagaatgggaggctcttctggccaaagacagacgggaacagcacacgcccttcccttccagacaggtctagcactggcaggaggctgcacaagcagtaatcaccacggagaaacaaaggccacggccctgtggctcccaaccagcactaagtggccctaacaaaagttgcagtgggccctggtgtttctaacccagaccgctgtgtggacaaaggagaaacactggggtgacaggggcatggcacaggggtcctccctcacagtggcctcaacacccctcctcccgtaccggatgaccgcagcagagaccacagcttcctctggagagggggtctggtggtacaccaagcccctgctcgatctgacagcagcacttggcaggcagacccctagggtggctggctttcccagggctgggaagaggccctcatgagccaggacacaagggtggcacttggtggtggcaaaggtgggggctgcgctgtctcagatacactcgtgatgagaaacgcagccctgctgtctaccagcccccgaccaggggaggccgtctgcagctcccctggtgggctcacccccagcttcaaggacacttgtgcaagggttcctagtagtcagtccgagcaggagaaatgggaggggtgtcgctaggggtttacggggaggctcattctaaaaagggctccatgtatccacgaccactgcttttttttttttttgagatggagcctcactctgtcacccagactggagtgcagtggcgccatccccacttactgcaacctccacgtcccgggttcaagtgactttcctgcctcagccttccgagcagctgggattacaggcacacgccaccacgaccggctaattttttgtatttttagtagagacggggtttcaccgtgttagccaggatggtctcaacctcctgacctcgtgatccgcccgcctcggcctcccaaactgctgagactacaggcgtgagccactgcacctggccgaccactgctctttttaaggttaatttggaaacgggagggatgatggaaaacttttttttaaagaagaggactctgaatgcaacaccaccctaggcaaacacctctgaaacccaggcctaagagtgccctggtggagccctgatggaaagaggctattcctgaaaccagaccttccagggctgcccgctggagatacagcagacctgggccagccggcttctctgctcacacctccgcatgtgctgctgcttcttcctgggccacctccttcctccttccctcttggaaaagcccttcatacctgctctaaccgagccccctgcttttggccgcactcacccactcctcaattctcctgctgcctggggcccttctctaccagcctgacagctctaggaaagcgggaatggctgtgtctccatctctggacctccgccccagcacagagcctggtacacggcagcccatgaactcaggaatctggggcccccggctgaggaacaggcccagctcactgtcctaaaagtcacagtcacaaaccgcggatcagtggtggaaggagagtggcagatgcacatctccccaggacggaattgcacttggtgatgaagaggacggagctgcagacacacgcaacgccatggatggacgttcgcaacactgcgccgcataggacaggcacacagcccgtgtactgggattccatttgcatgattcagctcacccacacagatggcgggagactggtggccgcctcgaggctggaggtggggatggggagcagtgccagtggacatgaggcttctctggggcatgatagcaaagttctcaaattaaactgtggtgatggttactcagccctgtaattttaccaaaaattatttaattgcaaacttaagttaactttatggtatgtaaattatacctcaatgaggctgttaaaagaactctagagattcaagcaagttcagcctgggtgtcctcataatcagaatcaattgtcaaccaccagtaacatcctcccatgcggcaaagaaaagaaagaagaaaaacaaggtcatcatcactccattcacattcctgcagagacacacactcacgagattttatctcggtcagagaggaggacccctgaaggcagctgggagagccaagttagtaagcacaagctagcagccccaaagaggccctccccactcacctgcagtctgtcttcaatcagagctgagtcagtaagcacaggccagcggccccagagaggccctccccattcacctgcagtctgtattcaatcaccagcactgtggtgccacagcccgagcccgctaacccacagttcacctgctgcttggagagtaaccagggcactggtgtcaaggcaccgtgcggcctcagaaggagccaggagagccccaaggaagggtgcctgagatacgtgcccccttgccctggctgtggccagccagagaaggtgcctggaggagaggggcctttccccacaaactccaccacactgggccctgtgcagggccagcaggagggcggctacattcccatcagtcgggaggggaggaagtgtgtttcctctcctgtattcccagatgctcagctgctcctgggctgtgcgttccgttgggtaacactgactgcacacacacctcttcacaaatgcctgttgtcagttgaagacaagacaaaagtttctcctaaactccaaacagtgtgtggtagagttcctcccttccctagcctccacagaaaccaccgcagctcaagcttctcctctccacctgcctacaactcagtggcgcgggatgacatcctgtcactggctgcccagaatggaacagagcttgtatacaaaaagtggaaaccgctttcaagttacaaattactctttgtaaaaggaagaaagagagaaaaaaaagtttacctttacagctacttcaccagcaaactcaaagcaatgccaagcaaaggaaacctacgagaaagagatggtggagagccatgcctgcaaaccttctccggaaaagccccagccacgctcatcatcaccagtcctgacgtgctgggctctgttccggtttcccgagcaggtttccctgcagggcccccgttcctcaggagcggctaggagtgctgatgataaggctgctagaatgctcagcaggccaggctcttagctcttctcccagtgacaaggaagacatggcttttcacttgcacatccacagaacactcttccggtgatcagaagagaacacggcaggcaaaggcactgtttgctgctactgtcaagtccatactttgtcatctgagatgaactaattcaaagaaatcctttctttaaacaaaaacttttaaaacgtaagagacctgtattccaaactaactacttggctgacagtgagtgctttgaattaattaaaaatatcaagaaatagtcaaaaataacacatttccccaatcccagactgacagctagttgaaggattaatggccaacgaaagcgctggcaatgaccacacaaaagctgctgagataggagcaagcttcttcactcaccgctgacccctctccagtggcagagcctgattaagtgagcagtggaccagaatgagagagacctgtgggtccctgcggctcgctcactcttcagcttttacaacttatttttatagtagatgctcaataaacatgtgaaatgagcagagggaaggagagacagagtagtccctgggccctctctgccctgcatccttgtataccagcttaaaacaggctctggaggaaaagcagtacttgaccactgaaatgtacctcttaaaacaggaagcacagccaggcgcggtggctcacgcctgtaatcctagcacattgggaggccaaggtaggcggatcacctgaggtcaggagtttaagaccagcctggccaacatggtgaaaccccatctctactaaaacacaaaaaaattagccgggtgtggtggcaggcgcctgtaatcccagcgactcaggaggctgagaggggagaatcacttgaacccgggaaacagtgttgcagtgagccagccaagatcgcgctactgcactccagcctgggcagctgagcaagactccgtctcaaaaaaaaaaaaaaaaaaaaaaaaggagggggggaagcatatatttaaggaattgttaaagaattcatgattcacaacgtccaatagatttgaaaccacatatgcaaagataactgcactccatgctaatcccacttgaaaatctcactgccctcttggaactgcccacttttacagccaggcaacggcaaacacctcttccctggccagggccctctgaggcagcagctccaaggtcctcaccagccttcccctggcacccagacccagcctggggcccatgagatgagtgtaccaccatccttccctggaggattacttggttaccaaagtcttaacaagggtcacaagaatctgtcccccaggctggtcgtggtggctcatgcccataatccctgcactttaagaggccaaggcaggtggatcgcttgaggtcaggagtttgagaccagcctggccaatacagtgaaaccccatctctactaaaaacacaaaaattagccgggcatggtggcaggcacctgtaatcccacctacttgggaggctgaggcaggagaatcacttgaacctgggaggttgaggttgcagtgagccaagaccatgacattgcactctagtgtgggcagcaagaatgagacaaaaaaaaaaaaagtggcaactgacagaactgcttgtactgcagctccagctaaacattgttttcaatctggggcacatttaaagctttcatgcactcttgggtctcttgctaattagttaagaacagcacattcagtaagtactggtcagagagggtaggttagctgccccacgtctacttccatttcctttttcttctctttgcttctccccctcttcctcctccttccttctcctctttttacttagtaattgaatgctgagcaatatgaccacaggaaaaactattttatccagcttcccaggtaggcgaggtggccaacgagatgtaaggtgaaattattgcatagcttccaggaaatcctttttgtccttcctgtctaccccagccctgtcccagtctcctgcttcctgaccagaatagacaaaaaaaatgatggctggagctcttgcagccaccttggagcatgaggaagtgatgatggagagcagaaaggcagaaagaacctgggttcctgctgaaactcagaaccctccacgacaatcctgattctcttaccaaggtgcttatgttatttgaaagaaatatgggttaaatcatcgttcttccgaatttctgctacttgaaggaaaagacaatgtctaattgacacatccatcggtgtatcatggtgctggaggtgaaacagcccatcctttactttgaaaagaatgttctcagatcattagatccccaaaatgttgccaaatccctaaatgttcatgggatatatctcttggcaagcacatgtatattttttctctttttctttttttctttttagacagagtcttgctctgttgccaggctggagtacagtggcacaatctcggcttactgcagcctctgcctcctgggctccagggatcctcctgtctcagcctcccacatagctgggattacaggcgtgcaccaccacgcctggctaatttttgtatttttagtagagacagagtttcatcatgttggtcaggctggtctcgaactcctgacctcatgatctgcccacctcggcctcccaaagtactgggattacaggtgtgagccaccgcgcccggccacacgtgtattatttagcctctagagtatctaggtcctcggctccggggcctgtgaacgtggcatcattcatacgatgtgatatcctaagagacaatcaaaatctgtgtggacgaggccgggcgcggtggctgacgcctgtgatcccagcactgggggaggccaaggcgggcggatcttgaggtcaggagtttgagaccagcctgaccaacatggtgaaaccccgtctctactaaaaatacaaaaattagctgggcgtggtggcaggcacctgtgatcccagcactttgggaggctgaggcgggttggagaccagcctgggcaacatggtaaagccccatctctaccaaaaatacaaaaaaaaattagctgggcgtggtagcgtgcacctgtaatcccagctactccgaaggctgaggcaggagaattgcttgaaccctggaggcagagattgcagtgagccgagatggcgccactgcactccagcgtggcgacaagagtgaaactctgtctcaaaaaaaaataaaaaagtcgatgtggatgaaattgtggcagagcgaattcgagtttgcaggaccctgaggcctgagtggggaggtatactgccaatttctccaaataacaacaccctgcttctgatgttctctgtttattgggattgaggtgggtgtggctgcctgatcaatagctgaatcataactgttgattggctccaataaggacaccacgtctggaagaacagctgcagttggaatcattacatctttcaatccactgtcaatcaccaacactctctgtcttccgcacagacaacacgtgggagtgagactggaatcctagaggggccccttctctgcaactttggggtctgggagggtggcacccatttctgggcatctctggagattaaggtttgcttttggttgacagttctggcaggaaggaagacccatagcgtttcccactcagccctctcctccttccattcacccattcatctgacaaataggtagtgagtgccaactacgtacaaggacaaggcacttgtaaggtgcctggagaacagtagtagacacaacagactaaagcctccccttgaggagctgtggagtgtcagtgaaaaaaataataaagcaggcagcgcattcaaaatgaccagtaccctggggtaaacagagccagggagagggtcacggcacactcagtgtcatgggctgacgtgtgtcccctggaaagataagaggcagttctaacccctagtaccagtaaggtctgaaagggaccttatctggaaaaagagtcactgcagacgtcattttttgttgttgttgtttgtttgagatggagttttgctcttgttgcccaggctggagtgcaatggtgcgatctcggctcactgcaacctctgcctcccaggttcaattgattctcctgcctcagcctcctgagtagctgggattacaggtgtccaccaccacgctcggctaatttttatgtttttagtagaaacgatgtttcaccacattggccagattggtctcgattataggcgtgagcccccatgccctgtccacagatgtcatttgttaagatgaggtcctggtggggtgggggcttccaatcctatatgactggtgaccttataaaaaggaggaatttaggctgggtgcggtggctcacgcctgtaatcccagcactttgggaggcagaggcgggtggatcacctgagatcaggagttcgagaccagcctggccaacatggtgaaacgctgtctctactaaaaatacaaaaattagctgggcctggtggtgggcgcctgtaatcccagctactcgggaggctgagacaggagaatcgcttgaacccgagaggcagaggttgtagtgagccaggatcacaccactgcactccagcctgagtgacagagagactgtctcaaaaaaaataaaaagggtcggggggagtttggacacagcctcacgtagagaagacagtgtgaagagacacaggaaggagaaggccatctacaacacaaaccgaggagcgacacctggagcagacccttcctcacagccctcagaagaaaccagccctggtgatgctgacaatgtcagacttctggcctccaggactgagagacagtccatttctgtggattgaagccgcctcgtgacagcccctgccctttctaatcaggctccttccttctgcctggctctagagcagccccaggggctgctgtgcccactgggagttcctggccagagaagtgaggggcttgattttcccaatcatgcttccatctagactggggaccccttacaggcaggacctttgtggagatcctcgggcagctgtcctccactgtggggtggaaagctggggcttccaggataagggtgacctcatggcatgtttcaggggaaagacctgattccccagtcaaccgctgactccaggatgcaggccaagccctgcggggtcattcacggactctgctctgaccctgtctgtccttctctcgggcccactcattgcctttcggggccagcaggggacatagctggtgctcagcgtcccctctctgtcccaggctgcgccgccgagaggccttggcacggggtaggcctcgtgacacacacattctcctacgctgcagagcctggagaacaatggctccctctcacctctgagctggttcttgtgcttgggacagtccccagtgaggctgagggtagccacagctgccagcgcctgcctgggcagcccctccatccccagcacccccatggttcagcattccctgtacctcctagacctgaacagagtctgatttggggatggtggcgcagaagcctgccctgcctcccggtcccaaggtgccgccagctcttccaagccttcaacaaacgcctcagatgccctcctgctgatcgcactgtgcctgctgtcctgctcctgctccctcacttaatccccaggcagtgacaatccagagaggaggctgaggctcctggaggaccagaggcttgtccgaggtcactcagcgagtgggcgggcagctggggttccagaaacatctgctctcaagcccgccattgtcccaccatgacctgcctaccaaagggatgctcctccctgggtcttgaggaaacagtcaaggtggtcacccttgggagcaggctgggcagtgttctccaggcttcagtcatccccgcctcccctccagaggccaggacagcccctgcatttggcttagctctccgtgggggcctggtgcccctggggtgaccggaatgcaggcagggcatgaggatgctgataatcagtgtcacctgggattatggctggggccgtcccatgagccaggtgcagccgaaagctccgtgtgcatgacctgaagcagctgccagtgctctctgagagggtgccctctgcctccctatctccaggtgtggctaagtaaacaggccacggcggcaccacagggaggcaggctgggtgctcctgctcatctctggtggatgctgctacccacatccagggctgtcacctgcccattcacgcacggccctccaggccacttcctcccccaggacctgcaggcggctgcaacaacccccatcaaaggtcccgctagccaggattcactgaggtccagtagagggagggctgcagcctctgctcccagaaagctgccctgtcctggccaggagcagtggctcatgcctgtaatcccagcactttgggaggccgagacaggtgtatcacctgaggtctggagttcaataccagcctagccaacatggtgaaaccctgtttctactgaaaatacaaaaattagccaggcgtagtggcacatgcctgtagtcccagctactcgggaggctgaggcaggagaatcacttgaacctgggaggcagaggttgcagtgagctgagatggtgccactgcactctagcctgggtgacagagcaagactttgtctcatatatatatatacatatatatatatatgtacacatatatatacatatatatgtacacatatatatacatatatatgtacacatatatatacatatatatgtacacatatatatacatatatatatgtacacatatatatacatatatatatgtacacatatatatacatatatatgtacacatatatatacatatatatgtacacatatatacacactctcatacacacacatatatatgtatatatataaaatatgtttattattttatgcgcacacacgtatgtgtgtgtatatatgtgtgtgtgtgtgtatatatatatatttatttgagacagggtatggctctgctgcccaggctggagtgcaacggtaccatcgcagctcactgcagcctcaacctcctgggtacaaacgatcctcctgcattggactctcaaagccttgggattacaggtgtgagccaccgtgccccatctctgagcatatctttctggggcacacaattcaacttgtaacaggtgcagttaccggccacatgattcatagcatatagggtgtgctttacctgaggctgagacggggctcatctcccctgggaatcattcttgtaaggtgccagtgatctgcaaatgcagatgaggcctgaggctggggcacaggccacctgccagctggcaagtgcaggatgggcagagtccttgtccagacctgggcagagagcgctcagggcaggcagcgtccaggctgccgtgggttgctccttgaggccctgacccccagggtcacctgcaggccattccttgaagcaaagaggtgactgacctggggagttgggaacctgccctttgtgtccccaatgagcacccttcctgccacccccacccggccgggatccaccacccttcctggccggtggtgccagcccctaacaaaacaccctttcaggcaaggacctgcaggtttgctccccttgccctggggacagagtctgacatccttgggaactgaccgttccctgccccctccccagctctaggaactacttcatcctgtgcactcggcagggtgcccggccctaggtgggtgtgtggtcggtcaggggctcccgtggctgcagtcatgggctcccctgcactgcggggcttcgaatgtgctgctactgttgggaaggagttgctcctctcaaagaactcctgctcatcacacaaggcctctctcacatgccccttcctccaggcagccttcctgagtggtggcaccttttgtacacacctgtcacagaaaccactgatctcagagtgatgacagaggcttgtttcccaggcacgggggctccgaggggccatccccagcaccagaagggttccacacatgttaatggaaaaaatccacaaaaagcaggaacgggaaagtaagttactgacattccacccctccccaattcccattttgcagacaagaccctgaggccccagagggcccagtgggtgcggcacagtatggaactggcccccacagagctagcctgtgcacaggttccccgtctccctatgggaaggaggaggcaccaggcctgctccagctccctctcctggattgggacactgaggcccattacacaggtggggtactggcaggacagctctgccctccagggtccagtgggagctgctgctgctcccacaagccacgcagtgcctggagccagactgggagaagctgtcctggtgggagcctgtgccctgggacacagagtgcatggtgcacatggccaaagcgtggcctggaggcgtggagggtcaggaagcagtgaaggagcagggcctcggcctcgtggggatgcacccacacagtaactacagatggaggccaggaggctcagccttcctcctggctctgcctctagccagctggggttcactattgtcccctccatccactgggtagggacccctagatttcaggtccccaaatgtacatgtctcatcaacagatgcagcagactccgtagggaaactttggaaatacagattcctgagccctgcccccacagaggctggctatgtaggtccctgggccctgcatttaaagatccccccaggcattgctggagggcaggagggtgggagtccccggaccagatggaccctgacagcctgacagcttttacttatcaaacccatgcgggccccacctcctgggatgctggctctgcaaactcacctctgcggagcccgttcctaggactggttgccagcagtgtggtgagggcagtctgaagggttcccggtggtggtcatagagcctgcacacgcctccttctcccaccgatacctgttatgggtgggattgtgcatcccacattcatatgtcgatgtcctgaccccagtacctcagaatgtgacctcattatttggaactagggtcactgcagaagaacctagttaagatgaggccacactggagtagggtgggtggacggccttgtgaaaggctgcagcgaggggctgaggcagatgctccctcctggccctccacggagcccacctgcctacacctggatcttggactcatggcctccagaccttgtagagacatttcttttctttttctctcccttccttcctttctttcctccctccttccttccttccttccttccttccttccttccttccttccttcctttctttccttctttcttctttttttgttttgttttgagacagaattttgctctgtcacccaggctggagtgcagtgacgccatctcagctcactgcaacctccacctcccgagttcaagggattctccggccttagcctcttgagtagctgggattacaggtgcctgccactacacccggcttatttttgtagttttagtagagactggggtttcaccatgttggccaggctggtgtcttactcctgacctcagatgatccgcctgcctcagcctcccgaagtgctgggattctaggcatgagccaccgcgcagggctggagagacgtttctgttgaagccgcctggtttgcggtgcttggctccagcagcctcaggccacacacaatatcccagggcggcaccctcaatgccaggccctgctgggaagtcaagggccgaggtgaacatgccctctgcacggtaggggattcagagtgccgccctgcacctgggctgggggaggagcgcagagcacaccggcagaccagggaggggcccttccaggaatgcgctttgtagacagctgggtagggctggggcggactaaggggcctgcggggtctggcggaaccatccaggtgagggcgtggtggcgggagagccaagaacagcagctaggtgtactgcttacctgagaagggggggtggccgcgaagggggttggaggcgttgggatgggggcctagtcagacgcaggtggccgctgccatttggcattgcccggtctggaggacagggagaaaacctggctggagacacagctggtcactgactgcctgagtccctggggccgcggtgtgggcgaccttcctgcgggacccgcaagcccagagcaggtgcaggttgtgggtacagctgaggcagccgaaggaccaaggggagggccttagaaggagggtgggctgggggcgcggggtggagacagggctgtgccttcctcccagcaggtgggttcccgacgggtgggcgtgcgtgcagggcccccggcccgagaaccggccccagcctcggcgggcgcgggcagcagatggcgctgccgggctgcgctccgcctcgggttcggggagcgccgggtgggggtggcgggcgagcccaagtcgaagcccgaggcgggagaagagctcatactacgttccccgggccggacaggcgggctccggaggggcgctcgccccgcccatgcgggacaggtgtttgcccacctaggccccggacccggagccgcgctgcccacgtgctcggagcggagcagctgctccccgcgcccgccctccacgccagcagtgcctggggacccggacccgcgaggggcgcgcaggacgcgggagccgaggagcagcggcgctttgcggatggagagcgccgcggagggcagtctgggagtgggcgcggccccgccgggcgtgaggtcatcgcgagcagctggcgcaccccccgcgcctgcctcccggtcctcggagcccccggctgcgccccgcggcgcgcgcaggttgggcaggttctgggctctgggcggcggggcgtggaggagccctggggcgggattgtgactgggcgcttcctgcggggttggcggcccggacgccggtgccacccgagccacccagcgatgctctgggccccctacgtcggggctgacctcaccgcccatcctggcggaccccgcccgctctaatgggaccgcgcccaccctacactggcctgcagccgccgtcctcccggctgcgggttccttgccctcagggagggcggggccgccaccagctgcccggagaggtggggggacccaaacctcccctcgcccacaccaaccccgtcctactgccctcaatcctgcccctcctggagtttcttgttacggtccacacaggcgaagggccccatcggccgcgccttgccagccctaatgccctccgagaggcggaggccccacagtaggaacccggactgaagtcactccctggcgctgctaggggctcagggtggagggctcaagggtgtccgggaagggccttcgcccttcagcctcaaagcccccccagtcctctggttttctgttcctcttttgggcccccagcttgtgagcgcccgctgggtaggtgggcaagaggtgaccgagcagaaccaggcaccgggaccgtccggtttgggtctggcttccacactggctgcagtgcgccctgccccaggccggcaaagtctctgagccccattcctgccgctggccgaaggattgggttgggcgaggaagatatggaaactgccccacaagcccccctcccacccccaggacgccgcccccaccggctaggctctgggcaggcctagtgtccactgatctcgccaatcggccctgtgttccagggctgtcgggggtctcctgggccaggggcttgacggagggagtggggtggggagggtggagaggcaccggaatctctttctgcttgggagtgggggcgggcggatatcaggaggggccactgccccgcagatgacccagagccgaagaccgcgggctgtggccagcgcaggctccacgcgccccgaccctcgcggcagggaggccccgcccactgttgggcaggttcttgacttcaccctgcttccccaaacgtttccgggtgcaaacgcccctctgggctggggtgggatgagggaggggagccctagaatggagttttgttttcctcctctggcatcaggtgctcaagcccaagctcctccctccacccgcctctggcccttccctggcttctatttccagctctccttggctatttatagctgcgaccggccggcaattgcgtcagtcaggggcaggcttcggccggcgatgccaacggtgccaccagtccccctacattcccctacccttcctgggtagtcacctgccctgcgctgtcctggtcggaggccccaggtgtgtggggggcgggagtgcgttctgcaggtgcgctcagccatgagggcgcatgtgctggggcagagtgggagggcactggacttggtggggggggggggcagcagaattcctggcggggaaggggtaagcggcgtcttcccctttccttcccagagcttcctcctgggagctgcctggggacaggccactgttccttggtttcatgggtggtgtctgcaaagactgggagagatgcccctggacctagcacccgtccccctccccccgcccaccttccagaatgaaggcccttcactgagttcctctcctctcaccccactactgaggcctccctctccccagcattctcactcaactccagttcagctcccataccccttccctccctgaggccacccccaacccagcccctctggagggggacattgaagggttctgaagcaagacaagtctacctgctcagtttggaaggactgaagggcatccacccaggcacttgcctagtgtttggcaaaggcctgccctggcatcgccctgcttgggggtgggaggcacacgcatgttcccctcgccccaccaggatcccctctgagctctggtccccacagtcagggaccactcgcttcacaaacaagccatcatcacgccttcagggcctagtgtcttccacagaggctcctaccccaggagacccattcccaggggcaggagtggggcctgggactgtgggctgccttacaggtctagaccctcacccctgggccagaaggctgtgctttctctggagggactgtgccgccgagccccagctgcctgcagggataattgagtttccccacgtgctcccaccatggacacaaggcatttgttgtgaagctctgctgagaatcagcccctcctctcccaccctctgtccagggcccgccctgccctgtgccctgcgcccttccggggaggttggggcaccctctgctggtgtccattgtataggcccctcaaagactccatggcttccccttaacagcaagtcctcccttcatcttgcccacaaagaaccactcttcttagacactcccccaacccacctgccattcagagccccatcgagatgcaccctcttcccgtcgggccttgccttggccagaggccttcagcttctgcctggctccccgcagggcgctcctacctctgccttttctcccatgctgtggacctttgcaatgtcctcctgccccacctgcccccagcccctccaaacacaacctggccttcagaggccaaaactctcctcctgaaaggcttcctgagaactggccctctgccctttctcctgctcagtctcttcagttctgagctccggaagggccttggtaagtccatccacaggagtacagtggcagctggcaggggtgccactgagaccagcctccagcttacttccagggatggctcggcaggcagaggaatggtgcctgagagaccaggaaccaagcccagccccaacttggcccctgaccctctaagggacattgaccaagcctgttcctctccctgggccttggagagggtctctcctgtgatgtcccactccaagacagttagtatgtggcttattcattggacattcactgggtaccttctgtatgcaaagaccaggtacccatctgcagtccaatggagaatggaggtaagcacaagctggctttaatgtaagactaacagaagtgcaactaacgcaatgtaacattattacccacccaccttcgctccctccctccctctcatttacccattcttccacctcctatccaccccatcacttctccacccgtccatccatctgtccaccttcctttccttctactccctagccacacatctacttgcctatttatgaatacccatttatgtattcatccatccatccatcctattcattcctccacccattcatccatgtacccacccaccccactcatccctctacccattcatccatctgcccatccatccatccacccacccaccccactcatccctctacccattcatccatttgctcatccatccatccatccacccacccatccaccccactcatccctctacccattcatccatctgcccacgtatccatccatccacccacccaccccactcatccctctacccattcatccatctgcccatccatccatccatccatccacccaccccactcatccctctacccattcatccatctgcccatccatccatccacccacccaccccactcatccctctacccattcatccatttgctcatccatccatccatccacccacccatccaccccactcatccctctacccattcatccatctgcccatccatccatccatccacccacccaccccactcatccctctacccattcatccatctgcccatccatccatccatccatccacccacccatccaccccactcatccatctacccattcatccatctgcccatccatccatccatccacccacccatccaccccactcatccctctacccattcatccatctgcccatccatccatccatccatccacccaccccattcatccctctacccattcatccatctgcccatccatccatccacccacccgcccaccccactcatccctctacccattcattcatctgcccatccatccatccatccacccacccaccccactcatccctctacccattcgtccatctgcccatccatccatccatccacccacccatccaccccactcatccctctacccattcatcatctgcctatccatccatccaaccacccaccccactcatccctctacccattcatccatttgctcatccatccatccacccacccaccccactcatccctctacccattcatccatctgcccatccatccatccacccacccaccccactcatccctctacccattcatccatctgcccatccatccatccatccacccacccatccaccccactcatccctctacccattcatccatctgcccatccatccatccatccacccaccccattcatccctctacccattcatccatctgcccatccatccatccgtccacccacctgcccaccccactcatccctctacccattcattcatctgcccatccatccatccatccacccacccaccccactcatccctctacccattcatccatctgcccatccatccatccacccgcccaccccactcatccctctacccattcatccatttgcccatccatccatccatccatccatccaccccactcatccctctccacccattcatccatctgcccctctatccatccatccacccatcccatttatccctccacctattgatccatccacccatccaccccactcatccctctacccattcatccatctgcccacccatccacccattcattgatccatccatccatccatctacccacccacccaccccacgcatccctctacccattcatccatctgcccttctacccacccatccatgcacccatccatccatccaccattcatccatctgcccatccataaattcacctatccatccatccatgtctccctccctcatccacccatctacccacccatccaagacccatccagcaactaaagctcttgtcctggggggagacacagctgtaggcagggcaacaagcctttaggggactctacgtagcagttggaggccagtccaccagtgttcaactcttgcttcaccgcctactttgggcagctcttggaccactaggagcctgattgagttggtaaatgagaccccctccttccatctggagtcttacactgcccccagggtcctgagacctatgtgccccagatgggcatcctaggagaggccgtcacccacctgctggagctgcaggtgctcctgcgcacagggggtaagggagcacctcggtgctgcttgagtcagccatcagctctttccaggcctcagttttattgactgctgggggctgcctgagttataaatagatgttcttgagccaaaaatagccttgcgggagcatcagactatgtttctagctttcctcctttttgaggactcttaaagatgcaggattcaaggaccctacctcctcctgcagcccccgaggagggactggccccctcctcttcccctctcttgcttcctcttcctcctgtctcatgagcactcacacacacggtctggacagcatcactggttgggaggggtccctgggagaggtatactaaacctggaagaagctgcatgaaccaggtctgtgtggtaaggacagatctggtatcctccgccacagtgtagacaagcctcagcccgggctgcacgcacactgtgaatctttgcagcctgtggcacctgcagcagccaggtctgccctcggtggggggtgggggggggggaggcggggctctgcaggccgggctggggctgcctccagggagaggaccctggaggctggggacaagcctgggggagacaaaccagtactttctaccacataccctggtgtgcttttaatccttgtatgacatgcacattacttaagatttgaaaagctggttggaggccaggcacggtggctcacacctgtaatcccagcactttgggaggccaaagcaagcggatcacttgaggtcagtgagattgagaccagcctggccaacatggtgcaaccccatctctactaaaaatacaaaaattagccaagtgtgatggcacgtgcctgtaatcccagctacttgggaatctgaggcatgagaattgtttgaaccggggaggcggaggttgcagtgagcggagatcgcaccattgcactccagcctagatgacagaacgaaactccatttcaaaaaaaaaaaaaaaaaaagtctggttggagacactatatatagctagacccctatttctgctggtacgtatatgcacccacacacatgcacacagcacacagcacacatggaggggctgggagggaagcatccaactgttcacattgggattgtgggagtgaggggactggtgggtaacactgaggttttatatcgttttaagttatttaagcttttactagcctgtaacaactgaaaaagtgtgttttacaccctaaaggtgcagctgaggacctgtgcccatgcctggcccccagggactattctcagagctcacccgcggtgtgagcctggggcaagtttccagacccaacacaccaggctctggcctcaggcctgcctcccagcagcctctgcccccaccctgcccaccaccagtctgaaggaagaggcgcggagtcgtggggaaaacatccactttaagctttattacaacacattgtctccaaatacaaagggaggggccgggagcagaaggtgcggctgtggcgggaggggctccaaggggggctgaagggccggcagcccagtctacagagactggaggctcagcgggggacctgcaccctctcctccgctggacttcccagcaaataacaggaggggccgggtccattttggggcgatcccaatgccaggcagtggccaggtgggaggggccggagagaggcttggagaggactcagggctgggtcaggtgaaagccaccaggtggggccctggcccgcctcccgcagcactggaggaggcagtggccaggtgggaggggccggagagaggcttggagaggactcagggctgggtcaggtgaaagccaccaggtggggcctcagcccgcctcctgcagcactggaggaggcagtggccaacacaggaccttcgcccccctgctggctgctcactttgcggtaaccagtgcctcaagagtgggagcagagacagactgagacagacagcccccctcaacggcctgcagaagggacaaggggaagggggaagggagaagggggcccaaccagtggccccagaccactgtctcccggacagcacaggggtggggggcgagaagcgggaagccagtgcatcctcctcacccagggtctcctcagaaacccaacgcaacagacatatgggaggcaaatttacataattaataataattaaccaataataataaatacttaaacctctaatccatagattgcaaatacaacgatagcttattttcttgggggaacaggagtgggtggggacagagggaacgggaacaggacttttgctgaaaggagggatgacaggaacacagagctgtgggtgaaaagaagaacaaatagaagaaacagcagagagggcggctggctggggcgggatgggcgcctccctggccctgctccaggactcaggactgggtcctgccctgggctgcctctccggccaagcccctggcctcttcccacagtgactggccccactcctagaccctaggacatctgaagggcaggggtcccaatggcccgagggggtatggggcaggggcagcaggctgacccacctgggcccaaaagccacttgtgtttgggggctggcatgccacctagagagagagcaccctgggaaaggggtgaatgggagtttctctcctgagcggccccatgggggtgggggcaaacgagggggctttacctgtcttgaggcagtgctccctaagtgaagcaggcctatcccagcagcacaggggcttggctggcgcctgaactccctgtgtgagcagcacctgctcacagagcccctcagcctgcaggtgcacacctgaattccaagttctgcctggggcatggctgggaggggggcggggcagacctggaacagaaccctaagaccaccccctcctcatacctgggggtccagggcttcctgcccagtggagccagcactggctagccaggcgcctcctgcctgacccccggaggccaagctcctctcctgcaatggtgccaccctgcccggcaggcagctctgggggcatgggcaagggagaagggagggccgcagccctctaggaatggcctttctgagccactctgtggctggactggggctctggcaggagttgggggcactaacacctctgtcctcccctgggctgcacctcatctgacgttccagaaccccctgcccgaagcccctacacacactgttctatttctcagcccctctgaacaccctggcaccatgaagcccaatgcctgtcctcccctgccagagaacagctctggggcaacgggcagcggggtgccctccttgccaccaagatttggtgcctggagctgatggagggctggccgcacctctccggggcacaccagctcctgctcctccatcctatggctttggtgcagagccctaggccggcgcagagaagggagggagcaggggaggtgggtggggggagaaggggggttctgcggctcagtttgtggcaaagaagtttttttttcctttttttcacctttttgttatgtaaaaagtgcacgaaagctcggcagcctttgcaaaggtcagcagtgtttcctggggcgggggaactgggaggggccccaggcctggcacccagcttgcgactgaaggtggcctcgtattgcttagaaacgtatgtttcagtttaaataccagacagtaaaaatagagctcgaggaccacccgcactgttgccaaatcattgccagaatgaacagcttaaataaataaaaaatcgaaatatttacttctcgataaaaatcccagtaaaaccatttacctttctttgcattatatataatatacatttataacgggcctggctgcgggcggcggggccgagggcagcggaggggtcaggacacctcgatgacctccacgctgcccgagaagctcgcctgcttgcccagggcggccagctcctcgccgcgcgcgcgcccctccaccatgccctcctcgaactccatctggcagctgcggcgcttgaactgcgtctccggggccggctcctcgggccagccggtccgcgcgtcccggggctcagccctcgctgcctcccgccgccgcaggtcgctgccgccgcctggtcccggggcgcccgcccggccgaagggcgcaaacagcaccccgcccgccccctgtgcgccctcggggctgaagcaccagggcccgtcgggcgacggcgtgcctggggagtcgagcggcggtgcccaggccccggggccggccggctggccagggccgggcagcccgggcgccgacagggccgagaggccgtgccgcggagtctgccgggccgcatcgccgaagttcaggccgaggctgtgcgcgggggagcgcgcgggggagccggcggggggccggggccgccggcggggccgtgggcgcgcctcaggcgcggcgtccgggctgtccgggctgggcgaggacaggcccagcgcggcccccgacgggctgtccagcttgcagagcttcggggcctcgccggggtcggggggcccggggccgtcgggccgcctgctaggggcgtaggcagacttgatgtccagggagaaggagcgcttgaggcggttagtgtcctgcaggcggtccgaggagaggtgcaggccgcgcaggccctgctgcagtgcgctggtcgccgggggcgtggggggcgcggggggctccccgcccgcgctcaggccgccctccctggcagccgcattccctgtggcagcgctctctgaggtaggtggtggcagccgtggcagcggggccccggcggcaggactgggcggaggctccggcgtccctgagggggtgcccgggtcgccctgcagggcggccagcagcttcaggctgcgctcgtactccagcagctggcccaggaagttgaagttgggcgagatggacgggcgcctgtccttcacgaacctgcgggggaggaggctcagtcccaggcgcccgccggggccaggctgcccacctgacgcacccgctgggcacccacgagctcatgtgcgccaggctggtctcaggccctcctcccttgccacgggtcctggacggtggggtcattctggtgcaagtgggcagccgggggaagggaagcgacgctgtgagccacaagtgcgcgactggggaaggtggtacctgtaggcgtcgtcggaggacatgcccatggtcttcatgatgtaggcgatggcgatggtggcagagcgggagatgccagccagacagtggacgatgacttggcagctggagagcttggctttatctgggcaggtgggccatgggggccaggtgagggctaagactgcacagcttctccctggcccaggtaggggaccccacccgcccaactgccaacagttccggctacttcctggggacccctcctgtgtctgtggccacacacagctctagccttcctctagccaggtccctgccctccgcccaccgcagactcaccgatgaactcgatggacttgtccagccagggcagcagtttttcacagtagttgtcgttgatggggacccgcatgaagcggctctcgcagatgaagtcaggcttggggcaggagttgctggcgttgaggacgtagcttattccattttgcgtcatcagatcctggaggggcgggagggcgggttggaaaggggtgggagaagctcggggcgggagtgaaggtggaggcttttcctgccctgccgtcaggagggcctttagaatcctgggagccttggaatttgtcccagatcccagtgtatccaggggagggcccaggaggcctctctggtccaccctggcaccctgggcccgtgcggggggtggggcacggctggcctccgactgcaggccccacccacggctggtggtgggctcctaggaattttatgattgcctgggtggtggcttttacccttttccctcgtcaccatttttaaaacatgggattctttcagagctggccagaggcccagtgacatccgcagcttggcatgccagctccccgctcctcccccgagccctgccgggccctcccgcaagccctgctgtggtccttccaggggcatgggtggggagcctggggtcctcctgggcccccacccatgcttctcccacacccagctcatccactgccttcagctcctttcctccctcatcccccgctccgctgccaagctgcttctggagctcctgcccctttcccattgaccaccccccgaactccactgcacacacaccttgtttaggacgtccttctgcgagcccaggtagaggtgaggcaggatgcgggtcaggcccacgctgggcacaggcaggcagggctgggagaggctcatgggtagcagggcagcaggcttgccctcgcagaggccggggaagcaggaggagaaggtggcgaagccccctgtaggaggagggccgtcaagtgggttgagagaacacctagggctccctgtccgcctagggtgccctgtccgcctagggcaccccatctactgctgaggatcagtcacacccagcccagacccgagcctgagcccagccggcaagcctctggcggagcacctgctctgcccgcggtggggggagggggtactgccacacatttacagcctgcacctacgcccacattcctcctcatgctaattaggggctgacccagctgaggacgccgctaggatgcccgtaaaggtggcgttgaggtggctggccatcacggcacgcgctgggcccaggcaggggtgggctcagaggccacaggggtctcctgctgagggtgtgtgtcacacagcccagaggagaggccctcacgagcccggccatctcccatacccatggcctggggccaggctgggccttcctcctcccctgcactgatgcaatgcctccctgcctccagctggctgggagccccaggcctgggcttgggtgccaggaccaggaggccagggcttccgagaggccctccccgtccccaggcatgacatcaccctggcacagccctcggggcatttgctgtctggttatggctgtactccacccagcaggggaggacggagagtggagaagcccggggcactgggggcacgcagagcaggcagtgggcacccgctgcacacgtgaccagcgtgtgctgctgccttccacacacgtccaagtccgaggccacaggctggtgggaggaagtcccctgccctgcaccagctggaaggacccgaacgtgaatccctggatgtctgactcagtgaccatgggtagtgcacaccatggctctggtctcagcttcctcctcctgcctgccacacagcatcatgtggttccaagaagataatgagcacgaagacacatggtgagaatggacctggccgtccctgacctggctggggcgaccaccgatgtggaccagaaactgggcagcacccacctggtggctgccagctcttgggagggtgaagccagcatggcccagcaccaccccgaggacaccttccagaacataagcccccatggcaagccggctcctgcttgtgcagagcctgaggcagctgggctgaggcctgccctatcccattggacggggcaggggagtgacggcgggagctcagggcctgggaaccccagggctcttttttgtcctggtttgcagaagaggctggtgccacatgtgtagcaggtgcccactgcctgccccgcgtgcccccagtgcctagggctcctcctctctccattctcccctgctgggtggagtagagccaccctggataactcctgaggacaggggagtgtgtgcaaacccccaaccagaacacctgctgtgccagctccccgtgtccctaaaaagggcgtgacgctgggggactgtggagataggggaagctccaggctgggtgggttgaggcagcagccttggaggaacagtctcttctgtgggaacctgctgactggacaggggaaagcaggtaggtgacttgtcaccaacgacgccccagcttgcaggttcccctgagcagaggctgggatgggcactgtagctggcttccactcactgttctgagctggggtagccctggatgttcccgctgcaggacagccccggggaggcggaagggctgcaccacttctctgcagactcttctgccacctgctgcctctcctcctccctgtggctctcccagggattttgtgccttactctctgctttctccagggcctggccaaaggaggaggtgctggggattccatcagtaccctcccacctctcccagaggaggtaaaggcaggaaagtctctggacaggtgcagagaaccgacagctatgtcagcaattccccaggaagcttcccaggacctccccaggcggagcaggtagtgtggatgtccctacacaccccactgtggatgccaggcctagcagggaccgaggctccagggatttcagaaccacccaggctctgggggtgagtgataagtgaggggtgttggggttcagtggaccctttgtaggtcccagcactctttgggccctggggaggcacccctacccccaggcatctccaaaggcgccttcccagtatccctgctccctgactcgggggtttctggggcagcgcctgcagttcacctgttactcacagtgaaatcccagacttgaaaaaaggcgtgtgtaccaggacatgtgcctgccccatgccacctgggagaccctgcaagcgcttatggccacagtcacagacgcacttctgcccgccacctccatgacccctggactccccgccagggcgggggccgccaccccacccacttgcagtgcagtcgcccggccaagggtccaaggccgactgcgggccgctgcttaaagggccaggcccctctctcatcccttgccgcttgccccccaacatcgtgagcagcgcagctggagtgggggaagaggagcggcagggggaggtgggcttcacagcagtcctgggaccccagcacagcctgtcctgccactgtttctctcccgcttcccgcaaacctgccctgctgtggggaggacagaggcttggtcctcacattccggcctctactgtccctgcaaatggaccaaggagctgtgttgcctgtgccgcgggatcctggaacatcccttctcctgggtgaggggcagcacccctgccccccccaatatattctttcccactctccctggttcttcgcagagccagcccagagcaggggctgtgcccaccacagggtgggagggagcctgagggcagagcccgtgggcctgcctgggtgtcgccatgagcccactgtataccacggggcctgggactccttggcagctgcacttctggagaaaaggggacacagcctcaaccttgcagggcagatgtcagcacagaaaggcagttctgagggtggcatgaccaggccctgggagtgccctcctggcaaatcctagcacaggcccggcccctcccatgcccatactcatccacgcccacctgcacacccatgctgtcccacccaccagtgctgggtgagggccccagccccccaaaccgtcccactctggcctcgagggagacaggcccttccaggcttgggactttcctgggatctgcctgcaggtagggaggtgccactctgggacctttctcagcctccaagaagagtctcctgactcccattcctggctagggcagcaaactggcctttgggaggggtcctgttacacctggtgagctgtaaaaagccccaaactactctctccccgccccccaccagttcagtcctcaaactggacctaggggaacagggttggatcagagtgcgtcattctgtggcttctggttctgagagttcacacatatgcacacaaatcccaaatctcacccagacaagcacaggcgggtacatacacaaatatacctccatgtatatacatgcatatacacgtgcacacacgtacatgcacatatgcgcacacacaggcatgcatatgcccatacatgcacacatgtacatgcacacacatacatgcatgcacatgcacacacacacatacatgcacacacatgctcacgtacacactcgcagaggcagatgctggtcaccagacgcccagagccatgcacagacgcacagacaccctctgaccatggccacccagcagtgcagggtgctggtctcacccacagagaggtggggagggagcctggcctcaatgctcttgcccaggacactggaccaccctcaagcctcccaggtgccctttaggtcccaggacatgccatgtcgggaggtcggcctggccaaagcggctgccaccccttcatcccccacagtcgccctcaggctgggtgaaggtccctgcttccactggatgcagggccaagggcctggcttggctgcctactcctcaccccaccgtgcctgcaccccacagtcccccatatcctctgcttgcctggaacagcccctggtagcagaggccaggcagaaggagcctggacaaagaccccagacctggatgggggagggtgcacatccctgggacaggccagctccgtccggctctgggacctgggccgaccccaggaggtggattctacagacacgccctcagccacagcccaaggaaagaaagaaccctctgggaccacgagtgtgtgagtgtatatgagtgtgtatcagcgtgtgtaggggggcggcttccctgcctccagggcttggggccagttgcccaggctgcttttgggccacagggatccctgggggctgtctgctgggacccaggcagcagccttggtgccaggctgttgccaggcaacctgcactcagctgggctttcggaggtggggggacttcctcgggaccccacggctccaactgagtttccagaggatggggcctctgcctccggcttctgacaggagctccgggagtgggaggggctcccagcctgcatgccttgccctacacctctggagcccagctgtactgtgaggtttccttctgtgttgaggatagtcatattggtgggtcctgaagtgtgggcgtcctggggagaggatggtggggcctcaagaaccacagatgtatggagatccccccgtgcccagcggacacctccctgatgccccagccccagccccagccccactgctggcggagcaagtgcctcggggaggcgtgggtcatggactcaccagtgaggatggccacgctgtcgaagcagccgtccagcttgctcagcaggatggagaggaagctgtctgcggccagcacgctggcgtcccgcgtgctctggtcatagaccaccacgtcctgtggctccgtagcctccacctgggggccatggggcagagatcagcatgccgcctccacctatcgatgccctggccccgtcccagatatgctggctcaagggaatagtaagggcatcagatgatgggaggcaggcagctgtcaccttgctgcctggaggggagggcaggtgcagtcacacactctcctccatctgccagaggcccagatgcacacacccacaccacacagcaagccatgggggcagggaggggtggactcctgccctgcgcagctgtgcccccatgccatgcacatgggtgaaggggacggacgctctgggccaggcctgtgtggaggagacacaggtgagtgcgatgggagcccaggataggacctggctggctcccagggtggcggagggacagagaagctcggccctgaaacgcatgccttcgggtgtgggctctcagtggggctaactgtgtagccagcaattctgctccccaccctatcccctccccaacccccagcggagaaacagagggctgcagcaggaccccaggcccctgcaccaattccggaggcagcagctggaagctgggttcctcctgccctcctcccccaccccaagggccagcccagatgttgagcggcttttgctcagacagcaccggtgcccccgccctgcaagcacacactcagcccttaagccagctgagccgccaaccctgggctgggtgacgtcaccggcagccaatgggatcgcactctgccgggagtccttgctgggggtcattaatcaccagattccccttgttggaaaccaaagggagccgattctggccttggggtgggcggactcctggccagtggccatcccacttgagtcctcccatgtcccagctctgaacagggcctatcagtgacccagacccctctcaaagcctccagggccaagagcttgtcacccttgtcccctgcgaggcagtagaaggaggaggtgccgccaccttcacaggtcaacagccccgctggtccctccccagctgcacctgatggtcctgggcagaatgagctgtccttccccagaaggacattcctggggggccacagagagaattctgggtccctgaatactctgcgggctgggggaagctgtgggacggggacatggactgctcacgtgtgccttttgaccacccctcctgtcctcacagcagtggaagtggaccacacagctgtccctgtcccgtgtaggccagctgggctgctcccactgccatgtggtcacaccttgctattccactcactgctcccctctgtgagcctgggttggccctggccacacagtcctatctgcgtggggagggcccggcacctctgtgcagaagctgagcaaggaggccctggagggagggtagggaagggtgctgcgggcgggggtgcgggggatgccctgagcaggggcaacaggcagcggtgagaggcaagtgccagggaggactgctccacacgcccctggctgtgaccccaaggagtcgagtttggactggaaggcagaggaggggggtgctgcccgagctgagggccccttagctgtggaccctggacgtgatgcatgcctggtgggcagtgggctgggtacctggctgcgtgcagccggctggatgagctccgcaatggtcaccttgccctgctgcagccgccgcttcaccagcttggagcagcagatgttgacggagctgagcacatgccagctgttgtactccacgaaggagcggctgtcgatgaccagcggccccccaggcccgccccgcagcaggctggccagcttcttggcatccatcaccttcctcgggagccggtccccagccatggtggggcaatgggtgctggggagggtgacccctgaagtgaggaggggctgctccgacggcccaggtgtggcctcgcgctgggagtgacctagcacatggtgctggacctgcagggacagggggatggtcagcagtgctgcgggcccctgggtggcacccagaagctccccaggacagatcagagctgggagctgcgcccaccaggacacaccaacatgtgcccgtgggaacccttctccctctggagagaccccgtccaggtcacaaggccagctctcagcaggatgcaacaaggcagaggggggcaaatgggccccacagagaagggtctgagggctggaagaggccaggggtccttcctgtgggccctggggttcacggacccttaggcattccagaacattccatctcatccctgggacacaggcatctccctgctgtgacttctgcatcttttccaccacaggacccccagcaagtcggggtctggactgcacctcaccctcccacatggtcaagctctctgccctcctccgggcttgctgtcctcacacctgcccctctctccctagcacagccccagggagtccaatccctggagacttgactccagggcagctccgtaagccgataatccagcccctggtggatggtggccttggggctgcctccactggagagtgggctcccgggggcagccggatagcaggcgggtgcgggaggggctcaggcacagaggcacggctcctttgccactgctgccctcctgacctgcaggctgaggtttagtgtgcgccacgtgcctgctgggggtgagtgcccagctcctgcaggggcgtgttgcacccacacagtgcctctcccctagcggagcctggggtctaggaggctccttcatgggctgatagggcccaggatgggaggggcggggcagccctgggaggagggtcagtgtcggggaccccgcaggtgccaggccctcggcatggcctgcaaaggcctcagactgccgggtgggcaggtggagtagggatgtctgaggatggagtctccggaagcccctcctgcaggcttgatgacaagcctgtcactgccccactgccgggccccatctccctgtcacctgccaggactggccttcctctgggtccactttacactcacagcccctaggaggcgcatagtgttaaggatgatgagtttgctttaactatggggaaaccgaggcttggggcagggttgggacctgggtcacacctgggtcacacacagatgggcactgggtgtccctgcaatgccatcttccctgtgcccccacagctgccaggcagtcaggaagtttactccacccagctcaggactgagggaaggctgggagatagatgtaccctgggccctgcgccctgtgcaaagcgggctacggtgggtagcgggccctcagcaagccagacccccaacccacagccacaggaggcactggggggaggcgccctgaggacacccatgcactgcaaacagcaggctggggacagaggccaccaccgtttctggactctccaggtcagctcccaggccggcgggggccagtgagagagttcacagagcagcaggtgcaaggctggtgtggacctcgtccctggcccagccccaactccacactgaggggcaggtcccagctcctccctgcccaggagccccagcctcgcactcactctccttctccagacacttcaagcttggcccctgcctggcccctcccgcctcgactgggcccaggcttctgtgcattcccaccatccctcctgttgccagaggccagggaaacacctgactgtggatgggcagcctcagctgaccccacggctgacaccagggattgcagtggcacctggtcagcagggcctcaggatcccactcagataacgttcctgggctggtgctccagcctccaccacagggtggggaacgaggcctgggagtcctctccagggccagacccagcaagttcaacagcaaaagggcctgctgcctgcctgctgtggagggtctctgcctgccaagggggtccctgactacccacagggggtccttgatgagctgtttgtccttcccgagttctacctgagccttgcacaggtggtgagaggcgagggcccagatgtgtggttctggtgagacagcggctccaggtgccccgtaggatacccaagggtccagctcagagacccagaaccccgagaaggctgcagtggcagggacacttgggctgggggtcttttgaggagctgccccggcctcaatgtcctcatccgttaagtgggggtggattctctctcactgaaaacaacagaagcaaataccccccagtgcagggaggagggcaggtgtgaggagaggccctcgccctctctgcagccagggcctagccttcatgcagccctgagtcctgacactgccatgagagacctcggtgcagccagccagatctgagacccagagggaggggagggaggagggcaagtccagctgcagggtggtgggcaggggctggaggggcgggaggacgggtcctggcctttacctggccctgctctgcctcctaagcaacgctgagctggagctgggcctatcacccacaatagtattgttatttgcagccgaaggggattcattagcaagttagcacctccatcgtcaccatggcaacagcagaggtgccaggcaaccgctgctcctgcggcagccaccaccatggagcaggctcctctgcagagtgggcacgcgcccctccctgctctctcctacccaccccagcaggtgcccggcagtgcagagcccagtcctcagcccctccgctcctctgccctacctggtcctaaccttccttcccactccaggtacctgctgtgcccagcatgctccctgcagctcgccggctccccgccccctcagaggccttctctgtactgcgaagggctggccgagtgccccctcctgcaggaagcctctgtgccatgctggcctctgggagagcatcctcacccacagggtctccctggacctacagctcccagggggacatgttcctcacctctgtctccccagatgctaaggatcggggctcagctatgccagggatggggcaggttgggtggggtggggagcagagacactaaggacagtctggtgcagatcagtggggccagcactggccatgtgggaacagaggtaaggaaatgtggatggtgttggttccatgcctctcctttcacggccccacatgccaagccctcctgagtacctgtggccctgctattccagtgcctaggggttggggggtgagaggcagggctggggacaggatgccccctagcacagccccatacacccttttcaaaagtctttgagcccaggaggaagcagtttccaagtccaaagtcagaagaaggctcctcccaggcccacaccttccaggaggcaccaggccgccaccctcccctgggacacagcacgcctggctccagtgctgcgtgcacactgccctctgtgcgtgccagaacacacctctttgcacacccactccacacacagggctggtgctccttacccacaatccacctgccctgtgtgcaagtacccacgcgtgaatatgtgcacacgcgtgggctggacatacactagagtacacgcacgtccttgccctctgtatgcaggatcccctgagaaccccaggactccagtacccgaggggtcagcttcagactccttacaaacacgagctcccacacccagcgtctctgtgcagcacattcctgtccctgagcacagacgggaccagggagtcccaggccacccccagctctcaactgacagcatccttaccatgttaccttctgctcagcacctagaaatggggactcactaccttcagagacagctgccaggactgtcaagcatggggggatgggactgtgtctccccctcacacctaggcaggctcttggagctgtccggctcactgttacccagggatgcttctggaggcagaaatcgtcacactaaggaggctgaggagagactggtgggtggcaactctgggaggcagggaccctgcactcacacaggtcagctcatcttccctcactgggctcccccagatgccctcatccctgcctcccctcagctcccttggctagtgctgtaggacccaagctggcctacactctgctccgctggcctggggaagctgtggacctgggagaaagtggggtggggcggggggctccctccgatcccaggaacggggtccgggcagggcaggggatgggaggacttggcacaaggggccgtgacagtcgagtctcagagccggacatatccaggttccctcccttcccaccagacctgtgtccctcctcctggtcactgtgccacatgctaaacatcaggaccagtgtggcgcttccaaggttcactgccctgagcaactccggcagagggggcctcagcgggtgcagttctcatggccagagtccaaccacctctctctcactgtgggtctgcccctttccctgccttctgcaagaagtgacacctaggtctccccaggccctagctgatgccccttcgaggcacctgtccagtggcagcctctaggccctgacttcagccccagcctgagaagagaagggtcctggagcagagactgactctaagcgtctttctgcacctctgttaatgggactttattcccagaagcctccccgaggacagaggataccaggggaatagaacctgcccagccacactcgtgcagcccccggctggctgcagcaggaggtatttcagcgagacttcaggatgaacttccagctggggtcacatgatctgccatccgcatccagtgcttattagcagtgaatgcatgggactgtcctcctggtggagggctggggcctggggtgctacattcacccctggaccgccctaggtgcaacagtgtctctgggtgggctgtgccagaagggaggcaagggagagtgccggggtttggatctcccctcagaccccccgctggggcacaaaaggagcttccctggcctgcagcaccccacccccaccccaagctgcacagcaagagcactgcggagccacgctacatcctgccaccccctcctccatcccacagtgtccccgccccccatcactgcagcaccagagcccctattcccctcagcagaggccggtacaccccgcagcagggagacggaggcagattctcccagaaggggtgaccctgttggggctgggcctattgttgccccctcccctccaggccagactattaggtatccccacctggtctgctccgcatcccaggctgggcagctgggcctagcgaggtggctgcagcagcctggctgtgccagcccctcccccagcgccgcggctgcctctgcagcaggcggaagggcgcgggggctttatccctcaggggccggctgggcaccccgggatggggaggcagtgcggcctggacactggggggatggatctgcagccctcccccccgacaggggaaggccccttcccgggtgtcccaggccagaggccgtcgcgtccctcccacggccgaggctccacacctcccggaccgactccgggccagggtccgcctgctccggttctggcccccgcgggggtgacgttcgggacgtcgggggctcgcgcagatccgcgctggatctcaggcggccctggtgggtcctggatttttgtcccccccccattccacacccaaagaaggagctgcggggagaagggcggcaacgcggcgggcgggcgtgggctgggcccgggtccgccgggcgttgcggggggcggggaaggggcctccctgtccctggcgtcctggacggccgtggccgctcattccggggccgcctcctcctcccgggcgcccaccgggtgccgctgccccagcgcccccgacgcggcgccctccgccccccggcccgggccggtgaaccccatccccggcgcccgcccccgccccgccggcgcctccgctcacctcgctcgcgctcgcctcgggggcgctccggggacccgcgccgcgctcagggcgcccgctcggccgcgccgtccatgggcccggcgggggcccgcgcagccggggcaggggccgggggagcgcgcgggccgcgtcgccgtcgccgccgtcgccgccgccaacgccgcggggagcgctcgctcgggccggggcgcgcgcactgcgggcgggcacgcgcgctcgcggcgcgcatcccagccccgcggctcggcgggcgcggccgggaggttccggcgcggctcgggctcgggctcgggctcgggctcgggcgtccggcgtccggcggggcgtcgtggggggagccggctcggccgccgcgctcggccgcgagtgacaggcccggggcggagggcggggccgccggcggggatgaggtcatgccgagcgaaaaaagcccctgacgtcacctgcagccaatcagcgcgcgcggctcgggggcaggtgacgtcagcggagcccgggctcggggtgaagctgaggcggctgccgcggggggggggcggggtgcagggtgcgggtgggtcgcgccgccgccgccttccgccctcaccccgggaccggctcttaaagggaccacgcggcgtccgggaccccgcctccaggaagccctcccggccccgggccccgcgtcacccaggccccccgtcacccgggcccccggccgcgtcgcacagaccccggacggtccagctgagcggctccgggcgcgaagtcctccccccgacccggacaggcgccggcgccgctccccccttctcctggcctttgttggcgctgggccgccgccggggagccctccccagacccaggcgcggcgttttacctgcagcggctgtgctcgccccgccgcgacccccgcaggacggagccggatccccctgcactcgggcggacctgggaccctcagaggcgagccggctgcctcgggtcacacatccgcgaactccgggggcgggctccccaggacgccgccgaccccccacgacccccagccctcccgcttccgtggaaagccgccccgacgacccctgtgcgggctgttgaggggccgcaccccgccgaccgctgtgggaacacctccgcgcgtgcggcggggacgcggcgagtccggggcaggaagaacgcacgggtaattgcaccttcggcaggtgttgggcgggagcaagggggtcagactcgcgctgcagggggagggcgggggaggcctcgctgtcctggaggaaggggacaaagacccctgcccaggagcctgggagcctttgaaagtaatgattttttggcgggggggggttgtcacgagacaccctagacatttctaaaaggccccctccccgctgccgggtggagagggagcgtggggggatccgccttctgcccccgagcccccagccagcctgggccccccagggtcaccctggggctctgaagggggcttcggccgctggttgaatgaagggccacagaaaatgaagctggcgcaacgaccgcagaaccctcagtgggcaccaggaccacggagctcagggtgccaatggtgatggctgggggtggggagtactgtgggcagcaggggatgctgagcggggtttggggctccccctttccatactcagtcttcctgccagcctcagagctgagtacaccgttggcgattaataagcgcttgcagctcccttccctggccagcctgaggggagcggcagtggcccgtatggggtgggggtggcggtggagtgcgtcctggcgcagagctggcacacagcacaaacaaacgccttggcgggagtgggtctgtcccggaagggagcccaggggttattggggttggggctgcgccccaaagcgggagggccctgcgagaagggaggccctggctggagggggaccctgagactggaggtgccggacccggatgcggggccaggtgagtagggctgcctgctgcagccttgctgggtttgaaaagtgggggaggcttggccctgggagggggcaggaggattcaggctgagacccggagggggcgaaggaggtccttgaggaggcagtcacaggcctgaaaggacctgggacccgcaggcatgggagctgttagccgttagatagaggggctgtcgcctggggggaagcctcacctggcttgttccccctgccaggcctaggtgagcccgatgggcgtgtcttctgcccagctgggatgtggccagcatctgcctgtggcctgggagtgcccattgtcccctaagagctctggttataccctgggcagctactggccaggctggagcaggtggcaggcagcgacctttagtccctcctggaggctcccagggggcggtttggaggggaatacggctcccctggagggcctgggctgtccctggggggcagagtgccctgggcggcgattgttataatccccgtagccattttcatgcaaataagcactgagagcgttaggttctgcccctaaccaggctggcggactagggaggtggcaccctggggaggacggtggtttttctgcagccccgccttagttccacgttgcctttgcacccagcagaggccggcctgggcggtgggctcaggggcctgggtgcccgaccaggtcggctcggctcagctcagctcggcggccgcaccgcctcccggcacaggtgtggacgggggtgggaggcgcgaccagggagggggctgcggtgtcagtcccggcccgggcctgtagacgccgcctcgggggtctctggggctcgggaggaccttgcgaggggccggggaggcgccaaggccgcggcgagggacgtgcgggggtccagcagcctggggcggggacgcgcgctccgggccgtgcaggtgggggtccgagcggggccggcccggcggttcgcgcgcgccctctgccgtccgcaggccgtggcgcaggctcggccgcctgaagctcctctcgcctccgggaggacgtccaaggtcgtttcttaaagcatccctattgcgcagaaggaacagtggggttcacttttctcgctaatgtgcatataatcgttgcaactaattatgtgtagcaaacctccatgccactatttccccaacttttttaagtcaaggcatagctaactcaatacaatgcccatcccagctgttcaagtagactttttctcccgttatttctttaaaaaccgtatgattttttcttgtggtaaaatgcatgcaggaacatacggtgtgccatattaactatttttaagtgaatttggcagcattaagtacattcactttctgtgtaaccgtcaccaccacccatctctggagcttttcgtcttggaaaactggaactctactctgtcctcattagacaccaacttcccaaccccctccccagcccttggcacccattattcaagtagatttttttttttttttgacggagtctcattcttgtcgcccaggctggagtggagtggtacgatctcagctcactgcaacctccatctcctgggttcaagcgattctcctgcctcagcctcccaagtagctgggattacaggcggccactaccatgcccagctaattttgtgtgtttagtagagatggggtttcaccatgttggccaggatggtctcgaactcctgacctcaggtgatcctcccgtcttggcctcccaaagtgctgggattacaggcgtgagccactgcacccagccagtagatgggttttgacaactgtatatgtagttttatcaccatcaaaatgagacctagaaactttattatcccagaagttccctggtgccctgtcctcaccctctgacctgtcaccgtgagttactgctatctgttcgtacactttataaaaatggaaacaatggaaacaaacaatgagaggacttttgcccctggcatctttcactcaaggaaatacttttttttttttccagacagagtctctttgttcccccaggttggagtggagtggcgcgatctcagctcgctgcaacctccgactcccggtttcaagcgattcgccagcctcagcctcctgagtagctgggattacaggcgcccgccaccacgcccatctaaattttgtattttttagtagagattgggtttcaccacgttggccaggctcgtctcgaactcctgacctcaggtgatctgcccaccttggcctcccaaagtgctgggattacaggcgtgaaccaccttgcttggccttaaggaaatacttttgagattcgtccacattgctgctttcccacaacctgatgataacgtctgtgtggttctgtatttcatgggtgtatggcaagagtggaaccaattctttattttttacatattagattattttcatatttgggctataaaaaactgcagcaggccgggcacggtggctcatgcctgtaatcccagcactttgggaggccgaggcgggtggatcatgaggtcaggagatcgtgaccatcctggctaatgtgatgaaactctgtctctactaaaaatccaaaaaattagctgggcgtggtggcgggcgcctgtagtcccagctacttgggaagctgaggcaggagaattgcttgaacccgggaggcggaacttgcagtgagccgagatcgcaccactgcactccagcctgggtgacagagcgagactccatctcaaacaaaaaacaaaaaagaaaacaaacaaaaaaactgcagcagacagcatcctattgtatatgcttaaaaaaagagatatgggatccctctattttatccaggctggactgaactcttcctgggcccaagtgatcctcctgcttcaggcttcccgtagctgagattataggcacgtgccaccacacccaactcttacatgtttgtaacacacttctcagattatttttctttcttccctctctctctttctccatttccttcattccttccttctgtccttctgtccttcctgtcttccttttctttcttgacaggatctcactctgtcacccaggccagagggcactggtggaaatatagctcacagcagtctcaacctcctgagctcaagggatcctcccatcacagcctcctgagtagctggcactacaggcatgtgccagcatctccagctaattaaaaaaattttttttggccaggtgtggtggtgcgtgcctgtaatcctagctactcgggaggctgagacaccagaatcgcttgaacccaggatgcggagcttgcagtgagccaagatcgtggcactgtactccagcctgggcaacggaatgaaactccatctcagaaaaaaaaaattttttttgtagagatgaagtctcactatgttaccgaggctggtcgcaaattcctgggctcaagcaatcctcctctcttggccttcagccttccaaaatgctgggattacaggattattttctttcctagtttttttttttttttttttggatggcatctcgctctgttgcccaggctggagtacactggtgcgatctcagctcactgcaacctccacctcctgggttcaagcgattctcctgcctcagcctcctgagtagctgggattacaggcgcctgccatcatgccctgctaatttttgtagttttagtagagacagggtttcaccatgttggccaggctggtctcgaactcctgacctcaggtgatctgcccgcctcggtctcccaaagtgctgggatgacaggcgtgagccacagcgccccctgcccccaactcccatgtccccagatattgcaaagttgccctgagtggagaattctaataacttgccagcaggctagaagaactccatttaaaacccttgccagggctgggcatggtggctaacacctgtaatcccagcactttgggaggttgaggtgggcggatcacctgaggtcaggagcttgagaccagcgtggccaacatggtgaaaccccatctctactaaaaaatacaaaaattagccgggtgtggtggtgggcacctgtaatcccagctgcttaggaggctgaagcaggagaatcccttgaacccgggaggtggaggttgcggtgagctgtgattgtgccattgcactctagcttgggcaacaagggcaaaactctgtctcaaaataaaataaaataaaacccttgccaacacttgggattttatgcattttgattatagctgcattacttgatgggttgactaggaggacactggagtgtcttctcacacagactccatatttagtttgaagacgtccttctatattgccttataatcttccccagggaggccttacagtcttcccattgcgtatattactcctgagcttatgatttcggttgctttgtgaaaggttataaaaaccacaatttctgatgtgttgttgcctgtcatgggctggctgtcgatcaccctctctgacttctcttactcctccaagcaggccgcctgtaggttcacttggatttcccaggtagatggccctatcatctatgaatctgcactttcgtttctttccaaacctcacattgcttgtttcttgtcatattgcatgggctggcatcaccattataatgctaagtggacatggtgatggtgggagtcttagcttccattccccagaaagtagccagatgcaaagctcagtgtacacattttctggaagggaggaacacaccgagccagggaggaggtgaagctgaggcaaggctgcttcttactcagctgctgtggctttttggaagttgcagctcagctggccacgtctgcacaccctctcccacgagaccatacagcgatgctccacctcagaatggtccacagggaggaggaagggagaatagtttctctgcaagctccttcctgtcttctgctctcataggtcagagttgctctcccgaggaattaagttccctgcatcttcaggtggtgttactggcccctcttggcagctgctgggcaggccagagtgtctgagggtttggggaagctggcacattgtgtggagtgagagagaggttcattaaaattcccaattattcctatacattcccaattatagtcccaattgtatttgtggatttatctatttcttattttagttttgtcaatgtttgctttatatgttttaaagctcagttatttggcacatagaagtttaggattgttttctgtttggttgcatgaactctcctatcatcatgaaatgttatctcttctaataatggttttgtttcaaagtccacattgtctgatcttactatcattatactaggtttttgaaaacattaatgtttgcctaatatatctttttttttattcttttgctttctatcttcctggatcttgatatttagggtttgttttttctaaacaacatgcatcttatttaacttctctctgtttttttttctttccttttttttttgagacagagtctcactccgtcacccaggctggagtgcaatggtgcaatctcgagtcactgcagcctctgcctcccagattcaagcgattcttgtgcctcagcctcccaagtagctggaattataggcacgggccaccacacctggctaattttttgtacttttagtagagacgaggtttcaccatgttggccaggctggtctcaaactcctgacctcaagtgatcagcctgccttggcctcccaaagagctgggattacaggcatgagccaccgtacctggcctaatttctgtcttctgttagcttccgggttatgtattcattatcctttaatggctaccttagagatggttatatttatttatttatttttttgagatggggtctcactctgttatccaagctggagtgcagtggcataatcatggctcactgcagacttgacctcccaggctcaggtgattctcccacctcagcctcctgagtagctaggactataggcacctgccaacacacccggctaatttgtgtatttttggtagagatggagttttgccatgttgcccaggctggttttgaattcctggtcttgagcaatccatctgccttggcttcccgaagtgctgggactacaggcgtgagcttctgcacccatccagagattatgataacatattatcagttaataatctcgtgtcttcataaacaaggcaagaaccttacaactatttaattctgtttatccctctcctgacttctgtgctgttgtcatatattttacttccacaaagtttaaaaattttataggacattgaatattgttttatttatttatttagagacggagtcttgctctgttgcccaggctggagtgcaatggtgcaatcttggctcactacaacctctgcctcccaggttcaagcaattctcttgtctcagcctccgaagtagctgggattacaggtgcccaccaccatgcccagctacttttttttttgttttttttttgagatagagtcttgctcttgttgcccaggctggagtgcagtggtgcgatctcggcgcactgcaacctccacatcccgggttcaagcgattctcctgcttcaccctcctgagtagctgggactacaggcgcatgccactacacccggctaatattttgtatttttagttgagacaggattttaccatgttggccaggctggtctcgatttcctgacctgtgatctgcctgcctcggcctcccaaagtgctgagattacaggcgtgagccactgtgcccagcccttggctactttttatatttttagtacagacagggtttcatcatgtcggccagtctggtcttgaactcctgaccttgtgatacactcacctcggcctcgcaaagtgctgggattacaggcgtgagccaccgtgcctggcccttggctactttttatatttttagtagagatggggtttcaccatgttggccagtctggtctcgaactcctgacctcaggtgatccgccctcctcggcctcccaaagcactgggattacaagcgtgagccactgtgcctggcccaatcatagttattttaaagcccttgtttcctaactccaatatgtggcttatctgtaatctgcttcttctgttagctttccgcatgattattgatcactgtttcctgctgtgtcctgtatctcgtgctttctgtcagaggtatgcctcaaaggaccgtgggggtccatatctagggaccgtggggggtccatatgtcgggaccgtgggggtgtctatatctcgggaccgtgggggtccatatctaaggaccgtgggggtccatatcttgggaccatggggggtctatatgtcaggaccgtgggggtctatatctaaggaccgtggggttctgtatctcaggaccgtgggggtccatatctagggaccgtgggggtccatatctagggaccgtggggggtccatatgtcgggaccgtgggggtgtctatatctcgggaccgtgggggtccatatctaaggactgtgggggtccatatcttgggaccatggggggtctatatgtcaggaccgtgggggtctatatctaaggaccgtggggttctgtatctcaggaccgtgggggtctgtatctagggaccgtggggatctgtatctagggaccgtgcggatctgtatctagggactgtgggagtctatatctaaggaccgtggggtctatatctagggaccgtgggggtccatatctcaggaccgtggggatctgtatctcaggaccgtgggggtctgtatctcgggaccgtgggagtctatatctagggactgtgggagtctatatctaaggaccgtggcgtccatatctagggaccatgggggtccatatgtcgggaccgtggggggtctatatctcgggaccgtgggggtccatatctaaggaccatatgtcgggaccgtggggttctgtatctcaggaccgtgggggtctgtatctagggaccgtagggatctgtgtctagggaccgtgggggtctatatctagggactgtgggagtctatatctaaggactgtggcggtctgtatctcgggaccgtgggggtctatatctcaggaccgtggggctccatatctcaggaccatgggggtctgtatctaaggaccgtggaggtctatatctcgggaccgtgggggtctccatctaaggactgtgggggtctagctgctctcttccaacagtgagcacgtggcctccctctctagtgcagacagggagaggagctgaacatttcgtctacccgctcagttagggattgggccacttcagtcaatcgtccctctgtgtggctttcctggagttttggttaagagcctggccagtccgtgtcttcttatccctgacaggctgtcagagagtcacttctttccctgaggtacaggcttagctctttagttgtctgctcaggcagcttcaaaatttggaaaatgtcttaagggccagattaacctgtgcctggggcaggaccccttcctctagaaaagctctgtgtactaagctccacaaggctatgcgagacttcagcgcacctgcggaggcctcaggcctcacttcttagcctccccagaaatttgcaaatgtcccagttttctgctccagcccctgtggttgccaagagccctgctgggtatttctcccagtagaattcctcttccccagtgggaccgaggctcagctcatacccagcactggttaattccttaaagggagagaagccgacattcagctcatcttggaagggctctctctgaatgttttcatctggttcttgttgcttctacagttctccaatgtcttttttatagatacatttttccggtatttcaaaattgtgggccggatgcagtggctgacgcctataatcccagcactttgggagggtgaggcaggtagatcacttgaggtcaggagtttgagaccagcctggccaacatggtgaaaccccatctctactaaaaatacaaacaaaacaaaattagctgggcatggtggctcatgcctgtagtcccagaaactcaggaggctgaggcaggagaatagcttgaacccaggaggcagaggttgcagtgagtggagatcacactactgcactccagcctgggcaacagagtgagactccatctcagaaaaaaaaaattgtggtaagatacatacggtaggatttcctgaagttatttatttatttatttatttatttatttatttatttattttaccatctgagttctgtaattaatgtggccttctctggttgctgcaatgggattgctgaccttccatatacatcccctctggaatgtcatatttgcattcttctggctttttttgtttgttttttgttttttttgagacggaatcttgctctgtagcccaggctggagtgcagtggcgcgatctcggctcactgcagcctccgcctcccgggttcacaccattctcctgcctcagtctcctgagtagctgggactacaggcgcctgccaccatgcccggctaaatttttgtatttttagtagagaggggggtttcaccgtgttagccaggatggtctcaatctcctgacctggtgatccgcccccctcggcctcccaaagtgctgggattacaggcatgagccaccgcacctggccgccggcatctttaattcagactgccagcttccagaaccctgagaaatacacttctgttgtacatgccagtccatggtgttctgttacatcagcccaaagagaataagaccgcgtggtaacaggccatgatgaccccctagtgattgcttttgcctgatcaaggcaaggcacccccgccctgagccagatgctgagagggtgtggtagaggctgcacggcaaggggctgagccaggtggctgctggtgctcctgcctctgaccgccaccatgtatccaggatccctgctggccagggcgcccacctgcctgctccggtttggttcagggccggtgtgtgtgtgtgtgtgtgtgtgtgtgtgtgtgtgtgtggttcccaggggacccagtgtagccacagatgccccccacctgcctcgagagggaaataaacataaatataccaagacagctatggggtgctggggtgagcggtttattggatgtttaaaggacagagatctgaactcctagtgactgcagagtgagcaagcaccctgggctgtcctgcagggctgtccgtgctggatgtggtgccagcaggcagggcttgcggataggcatttgctgcaggtggctggggcggtggggggctggtctccagatgcctggaagggaggccttgaaagtcattcttcttggatgcatgggcccatggcatttcttggtagaaggtcaaagagaagtgttcatgcttggcaaggcaggagggtgggagatagggtagtgggtggggaaggagagtctggctcactgggtgccaggaaaaggaggtaaaggctgggcaggaatgcctggccatggtaagagtcctgcaaagccagaaatcagatcttgcactggcagcacacggggacacagcaactggactgggagcagcagggcttgcagcagctggattggcaacaggatgacccacagcctgaggaacagcagcagggcttacagcaactgcactgggagcaggatgacccgcagcctcccttagaccccgcgcaagagccacaactggaacaggaacagcaacacacgggcacaccgcagccggagccacagcccccacagccggagccacaaccccccttggatcccccacaagaaccgcagccccccttgcagcctccacaggagccacagccccccttggagcccccacaagaaccacaggcccccttggagcacccacaggagccacagccccctttgccacagctggagcaggaacaagctggcacacagcagcacatgggcttgcagcagcagacaggcacacagcagctggagccacatcccccacagccggaaccacagccacccttggatcccccacaagagccacagccccccttggagcccccacaggagccacaaccccccttggatcccccacaagagccacagccccccttgcagcctccacaggagccacagccccccttggagcccccagaagagccacagccccctttgccacagctggagcaggaacaggttggcacacggcagcacacgggcttgcagcagcagacgggcacacagcagctggagccagaacctccacagccagagccacagcccccacagccggagccacagcccccacagccggagccacagcccccacagctggagccacagcctccggagcagccgcaacagcccatggttctggtggattgagggtggagcaggtagaggagcaggtgagagggaggtgcaggtgtggagctccctgagcctggaccctttatatccctgcccagggtcatgtgtgaggctgggcacacatttcctggttcctgtttgtgccatttttagggcccctttttcttgtttcctctagaaatccgccccttggtgtatgggctgctcagtgggctgctgctctcttgctgaatctgtgtccagacttaatggaggcccccaagggtctagcctctccctgttgactccagagtcacactggatttacaaaagcatctattttaggctgggcatggtggctcacacctgtaatctcagcactttgggaggcctaggcaggtggatcacttgaggtgaggggttggagaccagcctggccaaaatggtgaaatctcgtgtctactaaaaacacaaaaattaactgggtgtggtggctcacatctgtaatcccagcactttgggaggccgaggcaggtggatcatttgaggtcaggagttggagaccagcctgcccaacatggcaaaaccccatctctactaaaaatacaaaaattagccaggcatggtggtgcatgcttgtaactccagctacttgggaggctgaggcaggagaatggcttgaacccagaggtgaaggttgcagtgagcagagatcacaccactgcactctagtgtgggcaacagagcgggactctgtctcaaaaaaaaaaaaaaagtgatctattttagttgaacgatggtataaagagtaatatatttaaaaaatgtaaaaaaaaaccctactcaacttgggaaaaaatggcataaataaatgaagtctctgttcctccatctctccatattgtttctgtcccaccctaataatttcttgaatttggaattcaccactctcatgaaggtcctcacactcctacttaatatgtatgttcctttaaaaatgttttgtggccaggcgcggtggctcacacctgtaatttcagcactttgggaggctgaggtgggcggatcatttgagtccaggagtttgagaccagcctcactaacatggtgaaacctcgtctttactaaaaatacaaaaattaaccaggtatggtggcatgtgcctgtaatcccagctattcgggaggctgaggcaggagaatcgcttgaacctgggaggcagtggttgcagtgagctgaaatcacgccattgcactccagcctgggcaacagagtgagactctatctcaaaaaaaaaaaaaaaaaaagaaaagaaaaaagaaaaaaaaattttacatgctgaaaactttatgtaatgggtattacactgtatttctctttctgtaaattgcttttgaaaaaaataggtgttaggctaaagagattttctctagggatacatatggttttaatttatttgttttctctgatttctaaatatacattgacttatccatttacttgttgatggaccttttgtttcctttttgttgctatttcaagcaagctgcaactttcttgcccaaaacccctcctgcaggtgtgggtgcctgaaagtcaggaggttcttgttaccaagctgtcttcccaagggatccccccagccagctgctgtccaaccagcattgccagagagctcctgtttcctggcacccccaccaaaacttgcaactgtcaacttacacccttcatgtgggtgtgtaacacagtgttacacactgtggtttaatattccctcttcctggttactagccatgctgtgcctctttccatatggtcacctgtcattagagtctcgttaatttcacgtccttggcccactttacaaaattgagatagttattattattaatttttgagatggagagtcttgctctgtctcccaggctgtagcgcaatggtgcgatttcggctcactgcaacctccgctttccatgctcgagcaattctcctgcctcagcctcccgagtatctgggattacgggcatgtgctaccacacctggctaatttttgtatttttagtagagtcaaggtttcaccatgttggtcaggctggtcttgaactcctgacctcaagtgatccacccacctcggcctcccagagtgctgggattacaggtgtgagccaccacacctggccaagatcattattatttttattggtgtctgaagttctttgaattttctggattcttttattttgagatggagtcttgctctgttgccaggctggagtgcagtggcatggtctcggctcactgcagcctctgactccctggtttgagcaattctcctgcttcagtctcccctgggattacaggcacgtgccaccacacccagctaatttttgtatttttagtagagacagggtttcaccgtgttggccaggctggtctcctgacctcatgatccacctgcctcagcctcccaaagtgctgggattacaggcgagagccacagcgcccagccttttgtttcttcttcttcttcttcttcttttttttttttttttttttgagacagagtctcgctctgttgcgcaggctggagtgcagtggtgtgatctcggctcactgcaacctctgcctccgagttcaagcaattctcctgcctcatcctcctgtgtttcttcttaacatagatgtcatttattctaagtttttcaaatttattgggatgtacttttcatagttgcctctgtttttgaagatgggatcttgctatgttgtccaggctggggtgcagtggccgttcacaggcaccatcatagctcactgcagtctcgaactcacgcctggcctcaagtggtcctcagcctctgaagtagctgggactactacagactaccacatttgactactacaaatccctaccgtgtgccaccacgcctggcttagtagcctgttatttttaatagctgctaaatttgtcattatttgctttcttttctttcttttttttttatggcagggtctcactctgtcacccaggctggagtacagtggtgtgatctcggctcaccacaacctctgcctcccgggttcaagtaattctcctgccttagcctcccgagtagctgggattataggcacctgctatcatgcctggctaatttttgtatttttagtagagatagggttttgccatgttggccagcctggtctcgaactcctggcttcaggtgatccacctgccttggcctcccacggtgctgggattacaggcgtgagccaccgtgcccagcctatttgccgtttttcatccctgcttcaggttatacatgctctttctcctgcccgaccctttttttcctcattggttttgctaaatattgttgattttctttgtcttttgaaagaccagcttttgattttgttgattctgtttgttgtatgtgttaaacatttttatttagttctgctcatatctttattttctccattgttctttttgcactttctaaacatgcgggtgctggggtgcgtgactgtctgctggacgtggactgtcaggccaggaggcgtgcgatagagagtcactgccatctgggctttctatctgtccctccttccttccctccctccctccctcccttttctgcagtcattttcattcagcttctttcagcctttctgcaagcttctgggtgaggtaactactgtggggctgctttaaaagctcccatattttggggtctctgttctttacccgatgagctaagcctgtggggtttgctgtgatttctgacatacgtgggctgcttcccaccaccctttgcatttcaccatcctgtggtagtgcttccttcccctcttcttttagatggagtttttaaggttctgtttttgtttttattttgttttgctttgactgacttagaagttatatacactattcctgtttttagcagcaaccttatgcatttcatgtgtatttttaaacaaatgttgtctacacgtgatggccctctattcctcccctgctgagagttgtgcagggagctggggacagcttcttcccctgcccagcccctccggtgtcagctgtgggagtttctccagcgtcttagctcctctcacattgctcatcattgtttatttatagtcagtatttgcttaaacttgccacacatccaccaacaactctaggcgtggttcttgcttacaccatacttcttccttccgggctcagcttccttcttcctgaaaacatcctccggaagttccctcacaagcattcatcagtagacagtctgcatttttacatggaggtggcttgtttcctgctcctcctgagcattcatcagtagacagcctgcattttcacatggaggtggcttgtttcctgctcctcccgagcattcatcagtagacagcctgcattttcacatggaggtggcttgtttcctgctcctcccgagcattcatcagtagacagcctgcattttcacatggaggtggcttgtttcctgctcctcccgagcattcatcagtagacagcctgcattttcacatggaggtggcttgtttcctgctcctcccgagcattcatcagtagacagcctgcattttcacatggaggtggcttgtttcctgctcctgggctcaagccatcctttctcctcagcctccccagcagctgggatgacaaaggcacaccatcacactcagctaattttaatttctgtgtagagatggggtctctctaagttgcccaagctggtctagagttccttggctcaagcaaccctcccaccttggcctcccaaagtgctgggattacagacgtgagccactatgcctggcctgccctcacttttgaataatgctttggttggcacaaaattcctcagtgcttgaaaggtgtcactggcggctgtttcgtctgttgctgctgtcactttctctgcccctccgctggagtccccagccttctgagtctgctgtggaagctggagtctctggccttctgtgtccgctgtgaaagctggagtcctggtcttccgtgtctactgtggaagctggagctgcctggccttctgtgtctgctgtgcaggctggagtccctggccttccatgtctgctgtggaagctggcttgcacatttggttctcccacctgcttcatgccatgtccttcctggaccgagggttccagtttcaaccttgggagactctccctgtctcacctctcccgagtctctctcatctctagttggacaaatgtcaaatctactacatgtccccatatgtctttttttttttttttttttttaagacagagccctgttctgttgcctaggctggagtgcagtggcaagatcttggttcactgcaacctccaactcccggagtcaagtgattcttctacctcaacctcccaagtagctgggattacaggcgcctgtcaccatgcccagctattttattttattttattttttgtatttttagtagagaaggggtttcaccatgctggccaggctggtctcaaactcctgacctcatgatccgcctgccttggctgcccaaagtgctgggattacaggcgtgaaccactgcgcctggcccccatgtgtcttttttaaaaaaagaaaaccgttttattgagataaatgtgcatatacagtttgtctatttaaaagtccacaatctggccaggcgtggtggctcacacctgtaatccctgcactttgggtggctaaggtgggtggatcacctgaggccaggagttcaagaccagcctggccaacatgatgaaactctgtctctactaaaaatacaaaaattagctgggtgtggtggtgcatgcctgtaatcccagctacttgggaggctgaggcaggagaatggcttgaacccaggagcggaggttgcagtgagctgagatcttgccactacactccaacttgggcaacagagtgagactccatctcaaaaaaataaataaataaaagaagaccgtcataagtggagaaatatatcatgttcatgggtggaaagtcttaacattataaaaagttcagtttcttatattcatacattcaatggattttattcaattaaaattccagaaggatttaattctgaaaattattccatagatctaaaatttatgtgcaaacttgtgaataactgagacactcctgaataatattcagaaggggtagtctctgcctgatattaaggcataataaagtcttcgttgttaaaacagtttgctactagcacatgaatggataaatagttagaagtacagaacaggaacccagaaaagacccatctattgcagagctttaattttttttttttttttttttgagatagagtttcactcttattgcccaggctggagtgcaatggcacgatcttggctcaccacaacctccacctcccgggtacaagcaattctcctgctttagcctcccgagtagctgggattacaggcatgcaccaccacactggctaattttgtattttagtagagacggggtgtctccgtgttggtcaagctggtctcgaactcctgacctcaggtggtccacctgcctcagcctcccaaagtgctgggattacaggcgtgagccaccgtgcccagccagaggagctttaatctttaacaaattgaatggggaagatggctcactctatgcagagaattaaaattagatgcctacctcacaccctctataatccacatggattgaagacctaaaaggatatgtaaaagtgaaaggaaaatataaaaagagtggaagataatataggagattgtgtttattatcttggggtcaggaaatgaattcttaaatatgatccccagaacataaacagtaattaggaaaatgctgtatttaaccacatcaaaattactgatatatgtctggatatcaccccacaaaaaaaccattaaaagatgattggggccaagtgtggtgggtcacccctgtaatcccagcactttgggaggccgaggtgggcagatcacctgatgtcaggcgttcgagaccagcctgaccaacgtggtaaaaccccatctatactaaaaatacaaaattagccaggtgtggtagtgcatgcctgtaatcccagctactcgggatgctgaggcaggagaattgcttaaacctgggaggtggaggttgcagtgagccgagattgcaccattgcactcccgcctgggcagcaaggtgaaactccgtctcaaaaaaaaagaagattgatcaactgggagaagatatttgccatttgccatatttataacccctagaagctaatgtctagacaggaaccctgaaaatcaacagaagagggcaggagacctagtggagaagtgggcaaagcataggaatagaccacccacagatggctagtgaggacgcgaaaagaccttcaaccttatttttaatcagagttaagcaatgaaaacaaaacgcccctggtttttgaagagaatggaaacacctgcagtcttactgatatgttacatttagcgcgtggtatttagtgagaggcgtgagcagctatgtgcttacctgcagcatacagcgggagtcgttacgtgacttctgcctttcaagcacatacagtgtaatgggatccatccatcacacaaatatactagctctgtacacagccttgaggaggagcaatatttttggttgttataaactgcattttttttttttggtatggccttttgattctgggaagcacattcattctatggctattgcctttttagatcatgaaagcatcattccatattgatgaagaagatgtagatatggcactgatcaacacctcagtcgccttccttccaaaacagatacttctcaagaaatctggggccgggtgtagtggctcacgcctgtaattccagcactttgggaggccaaggtgggcagatcacaaggtcaggagatggagaccatcctggttaacacagtgaaaacccatctctactaaaaatacaaaaaattatccgggcgtggtggcgggtgcctgtagtcccagctactcaggaggctgaggcaggagaatggcgtgaactcaggaggcagagcttgcagtgagctgagatcgtgccactgcactccaacctgggcgacagaatgagactgtatctcaaaaaaaaaaggaaaagaaatctgttctcccaggctccccatttcagcatcccactcattgatcattgaaaactcattcactaggttcaccactcctgggtgttatgctgagcaatgaggatattcatcatggtggattatatggcagcaaagagctcaaaaaagggtgatggatgtgggaaatggggggcaggaatctagtggaacacacttcagtggccagaaataatgcattgtattttcatgtagcaatacatgccaaaagcaccagatttgcttaaaacgcaagaaacagaacagaatttataaccatcatgaatttaaataacatacacaaggctggacacagtggctcacgtctgtaatcccagcactttgggagggccaggcaggtggattacttgagtccaggagttcgagaccagcctgggcaacgtggtgaaaccctatctctacaaaaaatacaaaaattagccaggtgtggaggtgcgactgtagtcccagctacttgggaggctgaggcaggaggatcgtttgagcccgggatgtggaggttgcagtgagctgagattgcaccgttgcactctatctccagcttgggtgacagagcaagacctgtctcaaaaacaaaaccaaaaccaaatacatacacattgaaaaatgctacatatttgtcatgattatatgcaaatgtttgtaaataacttatggaagatgaattggaaagatacctgcaaggatggatgcctatgggtggagaggatgatgggacttgggataatgaaggagaaaaaagttaaataaaaacaatgtctatataggattcattagctgaggattgtgatctataaaattctcagcacatatatgatgcatgcatatatatatatatgtatatatatattttttgagatggagtctcactctggttgcccaggctggagtgcagtggcgtgatcttggctcactgcaacctctgcctcctgggttcaagcgattcttctccctcagcctcctgagtagctgggattacaggcgtgccccaccatgcccagctattttttttgttagttttagtagagattgggtttcaccacgttggtcaggctggtctcaaacttccgacctcaggtgatctgtgcgcctcagactcccaaagtgctgggattacaggtgtgagccactgcacccagccaggcctttgtttttattttgcctactattagtatagcttgctttgcatgttatgtctttttctacccccccttctttttttttttttacatttttgaatccttatgttttagatgcaacttttgactttacatctagttatacattttttaagaaaacttgtctagcaatctttatatgtaaactagagcattttgtccatttacttgtgaaataattactgaaatatttgggtttaaaacctatgttcttagtctgaattttctattgcatcacctgatctatatttctttttctcttctgttctttttgattagtgcttttttattctagttttttatgtaattgtttgactgtcatacatgactttggttaggagtcttggatcttctttgcttcttttcaatttttgtcattgtctcttgaatcctttttagttcttcatttctttttggtttttaaaatttattgtacttttttactcatacgtttgtcccactttagactttatttctagagtgatttcttttaactctaattttctcttaagtgatgtcccctcatttagcaattcttctatttatgacttttgttgttcatttatgtctctttttttgagatggggtttcactctgttgcccaggctggagtgcagtggcaggatcatagctcactgcagcctcaacctcctaggctcaagcaatcctcccgcctcaacttccctagcagctgggattaaagacacacaccaccatacccacttagtttttaaaatgttttgtagaggtgggggtctcactatgttgcccaggctggttttgaactcctggcctcaagtgatcctcctgcctcacctcccaaagtgctgggattacaggtgtgagccaccgcgcccggccttatttatgtctggtatcatttcctttcattgttcattagctcctttggaaacagtaggctaccactgtgatctgtttcacggcaggcttcctagctttcttccattgcctctagggacttaccgagggcccttgcacccactcaccactagagggaggaaaaccttccccatttcaggagccaaatccaaaattcatgctgcgcttttccagcacacacctgttggctcttttgaggttcccctgttttcgtctctgttagatgtttcttcgctttctcctgcacagacactgaaaccctgggggactgtggctcttggaaatttatccccaccttcttgtacttttaggttcacctgctttttcttaagacaccatctcactttatattgcccaggctggagttcagtggtgcgatcacagctcactgcagcctcagactcctaggctcaagccatcctcctgcctcagtctcccaagtagctggggctgcaggtttgcgctaccatgcctggcttacctggttttgttataagtctccagcatgcatttttggttttgttaccgagttgctcggtgtcctgtgggctgtgggaatgtacagggcccaaatgtaatgaactctgcgttcatgtctgctgccaccttctggagtttcccagtttggatttttgagtaaactgtcttaagcagcatttccttttaacgtcgtgaaactaacgatagccatgtcccctagcaagatgcacctttgacacacttttattccctctcctaaaagtggctgaattaatctaagcctttatttctagattatttcatttttccttacattgcatctcttttctctcagaaatttgtcctggaaattcccactctgctcttccctggcattatcagcagtcgcttagatctgtgggtgttctgtgggagctcatttctcaccagcgctccctgtgtgctctcttccctccaccttttccctccaggttcgcttgtctggagatcatcctcagatcactctcgtcccctcctccccagtgcgtgatttctaaagccttgcctgtgacactggtcagagaacaggctcagcgtggtggcacgtcaccatgaaacagatggacttggctcagggtccccaaatgtgtcatttcccaggaactcccctttcctgccgggagactgagctccgaggacaccttgggccattctgtaacttcctggttacctttagttatggaaagccgttgacctcatgattgtaaaaggctaattgagtgtttgaatcagaccgcgctggagctcagcggtgcttcactcctccctcctccgaccttgccctgcctggggtccttccgaggccccagaggagagcgggaagctggaagccatgggtcttgtgcaaggccctgcttggctggtcgtcaggactcagggcccgcctgcccctctgcgcctctagggcgggcattgaatgccgaatcctccccgggctgagccctcttctcctgcaagcagagactgtgaagatatttgaggccgagaggaggacagaagggaatggcaggcttttttgtgaatgtaccaggcctgctggcaggcgtttcccagcttagctgacagatcagaacacagaatcggtcaccgcacaggaaaggggttggacagaattgcaccaagtatacagttgatttacagacatgagaggctttattgcaaggaaattcattcattattttgttatttttttttaaacagatggagacaacaggaaggaaagagaccttcctggtcacacttgggccacaggagaacaggcagcggcccaggaggatccagggtcctgatggtggttgagaagctggttcttagtgatcactcagaaacgtcggcctggccttgtggggtcagaccttgcatctcagtcagcccagggagaagaagaagatggtccacacccaagtgcagggaacatcgtggcagtcggctgggtgcctgcgtccaggcgaggacacctcccgcatcagggaaacacacgtttctggagtgaggaggctgaaggcagggcccagaggagagctgagccatggaaggaggtgtgtgcatggatggtgagctagagcaggtgcaggtgcctcagggaggatgtgtgggacgaactgactcagggaaccataagaaatgctttcaccaaacaggagaaacctgaaggtctgggtccagagcctcagatcttacactggcagcacacagggacacaacagttggactggcagcaacagggcttgcagcagctggactggcagcacacggggacacagcagctggactggcagcagcagggcttgcagcagctggactggcagcaggatgatccacagcctgaggagcagcaacagggcttacaacagctggactgggagcagccacaagaaccacagccccccttggaacccccacaggagccacagccccccttggagcccccacaggagccacagccccccttggagcccccacaggagccacagctggtgcaggaacaggctggcacccaggagcacacgggcttgcagcagcagacaggcacataacatctggagccacatcccccacagctggagctgcagcccccacagccagagccacagcccccacggccggagccacagcccccacagccagagccacaacccccacagctggagccacagcccccacagccggagccacagcctctggagcagccacagcagcccatggttctggtggattgagggtggagcaggtagaggagcaggtgagagggaggtgcaggtgtggagctccctgagcctgggctctttatatacctgtccagatgtcaggcatgacacagggtccctttcttgtgactgtttacactatttttccagagctctatttttttcctctttgctagtgacttccttctggctcagttgagcatctactttctttgttttctaaatttgtctttttccccatttgttttggcccctacaattaaaacctcagctccaggctgtctggttcttcctgcaaagctccagggtgctggtcacctgctctctgctgaccacatgtgaccaatgggcaacagcctctgcccacgtgctctcatctttcctgtgttgactccctcaataatattaattttacatttttagatttcaaaattatccacgatctttatactcatgccagtctcagctttccgggtgtgttagaccattctttgcattgctctaaagaaatacttgaggctgggtaatttataaaggaaagaggttagaatggctcatggttctgcaggctgcacaagcatggcacccacctctgctcagcttctggggaggccctcagggagttttcctcacggtggaaggcgaagcaggaacaggcacaccacatggtgagagtgggagcaaggggtgaggaggagccacacacttgtgaacaaccagatctgagtgaacacactcatcgccaagggggtggcactaagtcactcatgagggatccacccccatgacccagacacctccctgcaggcccctccttcaacactggccaacaactatatgaaaaaatgctccacatcactaactattcggggaatgtaaatcgaaaccaccacgagataccatctcatatcagtcagaatggcttttgataaaaagtaaaaaacaaaacaaaacaaaaaaacctaaaatcagatgctggcaaagcttgagagagaagggaacacttgtacactgtcggtgggaatgtaaatgaattcagccaccacggagagcagtttggagatttctcaaagagctaagaattgaactactatttgacccagcaatctcatgattgggtatatacccaaaggaaaataaatcaatctaccaaaaagacacatgcatccatatgttaattgcagtgctattcacaaaagcaaagatgtggaatcaacccaggtgcccatcaatggtggattggataaagaaaatgtggtacatatacaccatggaatactacacagctgcaaaaaagaacgaagtcatatcttttgcagcagtatggatgaagctggaggccgttatcctaagggaactaatgcagaagcagaaaaccaaataccacatattctcacttataagtgagagctaaactttgagtccacatggacataaagatgaaaaccatagacactggggaacaagaggagggaggaagggagggagggggcaaaggctgaatactggggaacaagaggagagagcaagggggcaaggactgaaaaactactgggtaccacagtcactattttggtgatggattcattcatactccaaacctcagcatcacacaatatacccatgtgaaaaacctgcacatgtactgcctgattctaaaataaaagttgaagaaaaagttctttatatactctagatactagatgcttatcagatatctgatttgtaaatcttttcttcctttattatgtagactgttctttcactttgttgatagcgtcctttggtgcaaaaatatttaacttttgatggcatccaatgtatttgtatttctcttttgttgctggtgcttttggtgtcctatctatgaatccacaccgaatccaaggtcatgttttcttttaatagttttatagatttgactcttaaatgtaggccttttgacccattttaaattaattagtgtatgtggtgtgaagtaggggtccagctcattcctgtgcatgtggatgtctagtttcccagcatcatttgttgaagtactgctcttcctccattgaatgatctggcaccctgtcaaaaatcagttggtcatctacatgagggtttatttctggctctcaattctattccactggtttatacatttattctaacaacagtgctaaactgccctgatgactgcagctttgtagtaagttttcaaattggcaagtgtgagccctccaacattgttcttctttttaaccttgttttagctattccgggtcccttgagattccacatgaactttaaaatcagcctgtgaatttctacaaagaagccagctgctttcctgatagagattgcatagactctgtagatcaattttgggggtattgccatctgaaaaatgttaagtctcctgatacatgaacatcagtctgcttttgggctgccataacaaaataccacggatttggtggcccaacaacaggcatttattttctcacaattcagaagtccaagatcgggtgcaagcaacttttgtttctggtgagggctctctcctttggttgcagatggccgctttcccactctttgctcacatggcctttcctttgtgtgtggagagagaaagagttggagggaggaagagagagagagagagagagagagaaagagagagcgagacagaggcaaatgctccctggtgtctcttcttatgaagatgcaaatcctgtggaagcccttatgaccttacgtaaccttaatttcttccttggagaactcgtctccatatacaaccacaatgggagtgatggattcaacatatgaatttgaaagaacatgaatattcagtccacaacaaatctgggatgttttagatcttctttagtttctttcaacagtgttttgtcactttcagagttgcaagtgagtagaaatacaattgatttttatatattggtcctgtattctgaaaacttgctggattcatttattagttctataatctataaaacactggccgagcacgatggctcatgcctataatcccagcaatttgggagcccaaggcaggtggatcacatgaggccaagagttcaagaccagccaggccaacatggtgaaacctcatctctactaaaaatataaaaactagctgggcacggtggtgcatgcctgtaatcacagctacttgggaggctgaggtggaagaattgcttgaaccaaggaggcagaggttgtagtaagctgacattgtgccactgcactccaacaaccgagcgagaccctgtctcaaaaaaaaaatctataaaacattagtagctcttacaaattgacaagtagaatacaaacaaccaagtttttaaaaagatgattctctgataaacaaatggaagtgtgcaattaaaaatataaaaagtaaatcagactcactggtagtcagatacacgggatcttttctgtggagtcctaatgatggaaaaggagccaggttggttggaccaagggaaagcaaaaagagaaggcagatgaactacaagtctgcctttcttcctggtgcaggacttagccctcctatgcaaataactcacataactcacaatcttcctgcactcaacttatgacctcagttgatagaaaaatgcaaattagctcactgaaaccttggcattatcagcactgcatgtaaccctctccggcacaagcaccatcctataaaatccccagcaagcctttgtctcctggcagccagctcctcccttgctgacctgccctttccattcttgcaacgtattttcctacattctctaataaatctgcctttccttacctacaactgtcttggtaaattccttttctgcccacgctagtggactcagttagtggctacctgcaacattttatatctactagactgaccaaaattaacaagaataataacacctattgctagtgaaattgggggaaaaggtactcatacattgttctggggatacaatttattacagtttttttgaaaacaatatctaataaaattaggtcatatcaatacaattagtcttgaaattactgaaaaaagattaaacgtaaacatattcgtgtatacatatatgtgtatgatctattatttacagtgtcagaaaaagaatcctagcaaattgaaaattaatactaaaagtcatacccactaaaaaataagattacacctgtaccagtggacttggagaaatttcctcaaggctctggctagtgtgaaatgtagatgcagagaaatgagccctgtaggatcctattttagtagcaagcaataaaaatatcttttacacatatgttgagtgtgtgcctggggtacgtaggacagtggctgggtggagtggggaaggtgtgtaggaatcaacaaaaagcaaatgacagtgaaaagtgagtccagtatgtgtgatcctacttgtggaaaaactccacatatatgaatacgcatgcgcgtaaagaaacatagacttatacccagatctacttcctaggagaggcaaccatgatacaagttctagtgaaaagaattaagttgcaaagaaatgtggataataaaatccgaattggtagcaatacccaattgtgtatgcgcatctattttttatacattgtatgtgcaagtaggagggttgggtgggggtgcctgtggggcctggcactgggggtggcttttattgttttttaattgtgtatatttaagacatacaattcgatgatctcatatatgtctacattgtgaaataatcaccacagtcaagataattaagacatctgccacttcacatagctctctctctctctctctcttttcttggtggtgagaacatgtaggatctaccctctcagtacgttttaagtacataataaacaccgtgttgttacctgtggtcactttgctatgcattgggtctccaagccttatttatcttgaagaactgaagctttggacccctgggccagcacctcctcatttcccctttccctgcctctggttcccatgcttgcactctgtgcttctgtgagtttcactcctgtagactccatgtgtgagggagagcgtgtgatgtctgtctttctgtgtctgcctcttttcaccctgtgtaatgtcctccagatttgtacatgttgttgtaagtaaccagatctccttcttttgaaagctgaagaatattccatatatacacgtatagatgtatgcatatattccacattttgaaaaagtcaaatacatagaaacatagaatagaacagtagttaccagggtctggaggaagaaggaaagggggaggaggaggtcaagggcttgcggttgtgtaggagagggagccgagcagtccagtgcacagtgcaaggactacaggtgacagtcaggtgttgtgtgtggcaggtgtgctgagagaagactccaggtgctcctaccacacacacatacacacacactaacatcgtacacacatacttaccctcatacacacacatacacacacacactcaccctcatacacatacatacatacacacagtctcacacacaattaaaaacacaccttacacacactcatacacacataatcatacaaacacacacactcatacacatgcatacacactcatacacacacttatccaaacacacccatgcacacacacttatacacacacatacaaaaaggaaccatggaaggtgttggagatattaattgcagccatcatttcagtagtgtacatgtttaccacagcaccatgttgtccaccatgaatatgtacaataaaaataaatgtaaaaaaagatgtgtcttgggagagtccttcataataacacctgagaggtgtcacctttcttgactttttctgaccatgaaatgcacctgccaaggatggcagacgtagggaactgacctcctgggccctcacgtgcccaattatctttggccctccggactggagcagtttgtagaccttggaagcagggccccagcactgactgcttggcctcaggcctctgccccatcggtggtcaggtggcggccacgagggcgtgggagcttggccatccctgcctcctggagtggacgaggttggcggctggtcagcctgctcctgccccacccttgcctcatggaccctggtagcatcactggctcagccttgctgggcatgcacaggcagcagcacccgctctgatccaggaggcttgccctgcttttggctaagttctgggtccggccactgccacagaaggctcagtcccctgtgtgatcctcctggctgctgctgggtgcccatggcgcccctgatgcccttcccttgacagggcttgggttagcatcaggccaggaccctctgggactgggacttgtgccctgtctggggtccctgtcccacaggttgggccagaggccacagggcatgctgctggctggccatggctgcaggaacgtgacactcacccttccctctggcagcctccaagtgatgagttttccagtggatattaatttcctgaggccaggagccatctggggctacagggcagcctgccgtgtgccatcctggccccttccacaccatgctggccactgcctgtcatgggggtcggaagcaggcgatcccgtgcaggaggtgtctctggacctgcctcttctcttgctcatcacaaggccaggccaagcctggtgtcaggaccctggtggggttgcagggccaggcctgtcccctgtgcctggggtgtccagggcacacatagaggaaataggggccctgcatcccggctcctcaatgtactgtagaaatcatgggccctcaacattcaggtccgtgggaggcatccacagagacttccaatgaaggaactgttagacaactcctggtctctcctgagctggggacaggccagccacaccctgagcccctggggacccccagagagtggcctactgtcttgggctctgaggaagtgctctcattgtagagcacgggggatgttgtggcccactcctctcaattttgctgtgaacctaaaactgctctgaaaaaaaagtccattaaaggaactagcatgggctgatggggaggggctcattcacccctgagttggacaccgtgtggctacgaatccaccctcagaccacagagtggatttcggcagcaacaccacaccctagcctcatcctgagctcaaatttaactcagatagaccaggccctttttctatcgttcttagccaccattaaaccaggtcactcgttctgtgtttttgcaattggcttttaaacaaaagagctgggtttggtgtatgtttccttgtcaaatatttttttccaataacacaggtggaagaaaacagacagggcctctttctggtccagccatggggtggaggccgtttttgactttcaccttcctctgtgggtccagctctctcttgcttgttggctctgaggattatttagtttttcaacagctcagtgacttaaaaaaaatatatatgctttaaacatagcactttaaagctttatttatttacttacttatgtatttatttatttatttatttagagaaagagtctagctctgtcgcccaggctggaatgcagtggtgcgatctaggctcgctgcaacctccgcctcctgggttcaagcaattctctttcgtcagcctcccaagtagctgggatacaggcgcccaccaccatgcctggctaatttttgtatttttagtggagacggggtttcaccatgtccttttagaagtttcagggttgtgaatagtgtctagtcaaccttactaccgaaacagaaactcagaagcaatttctgaaacttccgtgttgttgagttttcactttcttgtcgcagttccgccaggcactcactgcctaccatcctgtgagacggtggcttcccgagcagcctccagcgctctgctgttacagacgcctgggtctgggggctccagccttgcagcccacctcctcctccgccagctcctgccttccctccccatgagtcgaacatgctggactttggtctaggccctccagcctccggaactgggagaaatggtgtctgttgttccgtcttccaggcttactctgtgggttttgttctggcagccccagctgacagaggcagcagggaagggacaggtgggcacctgaatcagaagtctgtgtagggaggtgtcacaaggaggcaggaaatagatgtctgtaggaagccttccaggagatgctgagggatttggcgacttgtgggggagagaagcccaaggggcctcccaattctgtatcctggaagatgggaaagacggagacgccccaagccaagtggatgccacggctgagttgtgccccctggttcatatgttggagtcctcaacgcagtatctcagaatggcaccttatttgaagataggtctttacaggggtgattagttcaaacatggacctaatggagtagggtgggccctagtctaatctgtgtccttatgcaaagagatgaggacgcagacacacacagagggatgagtacgtgaggatatagggatggcggcatcagtaagccacggagggaggcctcaggaggacccggccctgaggcacctcgatggcggattccggactccagactgtgagacaatccactcctgttgcttaagccacacggtttgtggagcagccctagcaaactcacacagcagggtacggggggttcccaaatgcctgggagtgcaactctgtggaaagtgtacatttctctaatcacacagaagttgaaacaaaagaatcacaatgcaaactcgtgggaggtgcagatcgtatttatttagaagatctagcctaggcacttacaaggcgaagccctggggaaagaaacagggccaggtcggaggtagaagaggagactgggcgcccctcctcctcaggagaggatcctggggtctccaataattccgagtcctctaggtcaactccaaaagcaatcggagcggtggcagctcaggcaggatgaagacgaagcggggaggagccaggaggttgcggggaccggggagaggcggcagcaggtcggaggattccagtgtcagcgtgtttccagcaggctcacaggaggggcccagggatgtgggatcttgaagccctgagaaggttgaagtggtggggtcaggaaaggaagacgggattccgggagggttgatgggcaggacccagcatgccagaagccctcatgacctcagaggctgagcggctgagtactgagccctggacgctaggctgccttagtccagaggaggacagattcagagacgtgcttcaggaattcaggacacagctgcaatcattcctggagagcccggatctgtaggacccactgaggtttgtgggcagagcctcagatcttgcactggcagcaaattgggacacagcagctggactgggaggagcagggcttgcagcagctggactggcagcaggatgacccacagcctgaggagcagcagcagggcttacagcagctggactgggaacagcagggtttgcagcagctggactggcagcaggatgacccacagcctgaggagcagcagcagggcttacagcagctggactgggaacagcagggcttacagcagctggactgggagcagctgggcttgcagcagctggactggcagcaggatgacccacagcctgaggagcagcagcagggcttatagcagctgcactgggagcagccacaagaaccgcagccccccttggagcccccacgaaatccacagacccccttggaacccccacaggagccacagctggaggagcagcagacgggcacacagcagctggagccacagccccccttggagcctccacaggagccacagccccccttgcagcccccacaagagccacagacccccttggagcccccacaggagccacagctggagcaggaacaggctggcacacagcagcacacgggcttgcagcagcagacaggtacacagcagccggagccacagcccccatagccggagccacagcccccacagctggagccacagcccccacagctggagccacagcctccagagcagccagagcagcccatggttctggtgggttgagggtggagcaggtagaggagcaggtgagagggaggtgtgcaggtgtggagttctctgagcccgggctctttatattcctgcccaggtgtttatactgaacacgtgaatacttctgttgttgtttctgctatttcacatgcacaagtgttatttttaatctctccacaatcccatgagccaccatcagctcaagccaagctgtcctttccttggtttctaaatttggcctcttcctcataggtgtttccctttgttagaagacactgggctccctctccagtgggtgtcccaggagcctgggaggcggtggttgcttggccgaagggtggaccattgtccttggtgctcagggctctcctcagcgatgcagaccctccaccccctggcattggtgtttatatcaaggatggtcatttggtaaaaaataaaataaaataaaaattaaaaaaataagctgaaagaaaggctgtctataggttccaccgcttaaaaacttcaagtataaatattttgtcaaatctgtaaaacaaagttttgaagagcatggatttgagtgtggccctggttctcctttgtctttcttacctcttcctcctgcggtttggctcactcctccagacacggattagacccacgttcccttcaggcaagctgggctcacagagggaacagaggaacaggaccctttctaatgcttttgagttttcctctattaattctttgtaaaaattctacaaatcaatggatattcttcaagtttattcttcttgaaggctacaaaaattttgattagccaacctctctaacacacttttattttctaaaagattaattttaatattttttttttgagaaggagtatcgctcttgtcaccagggctaaagtgcagtgacgcaatctcggctcactgcaatctctgcctcctgggttcaagcaattttcctgcctcagcctccccagtagctggaattacaggcgcccaccaccaggcctggctaatttttttgtatttttagtgaagacagagtttcaccatgttgggcaggctggtttcgaactcctgacctcaggtgaaccacccgcctcagtctcccaaagtgctgggattacaggtgtgagccactgcacccagccaaattttaattttttattaaggtaaaatttacatgcagtgaaaaaaaattttttttctgagtctccctctgtcacccaggctggagtgcagtgatgcaatttcagctcactacaacctctgcctcccgagttcaagcaattctcctgcctcagcctcccaagtagctgggattacaggcacccaccaccacacccagctaattttgtatttttagtagagacggggtttcactatgttcgccaggctggtctcgaacccctgacctcaggtgatccacctgccttggcctcccaaagtgttgggattacaggcatgagccaccaggcttgggctgcatttttttttttttttttttgagacggggtcgcattctgtcgcccgggctggagggcagtggtgtgatcctagctcactgcagccttggtctcctgggctctgcacatattttgagtgtacaattccatgagttccgctaaacatgtactcgtgtgcccatcactccaaccatgaccaactgcttcacccccagaagtttccctttcgccgccttcccttcctgcccatcgctccaggcacagctctgctgaccagttgtgcctgttgttgaatgttgcaaaaatgaaatcattaaaaatgtactctggtttctttccctcacgatgttattctgtgtgtcaatgatttgctcttcttctttttttttttttttttttttttttgagacagggtcttgctctgtcacccaggctggagtgcagagtggtgcgctcatggctcactgcagcctcgacctcctgggctcaagcgatccacctgccccagcctcccaatgtgctgggattacaggcatgagccaccacgcctggccttcttcttcttttgtaatcaccgcatagtgtttctgtagcagggcgagccgcagacaagaacccctcagacactgaattgtagaaggaaagggctttattcagctgggagcattggcagactcaggtctccaaaaaccaagctccccaagtgagcaattcctgtcccttttaagggcttacaactctaagggggtctgtgtgagagggtcgtgatcgattgagcaagcagggggtacgtgactgggggctgcatgcaccggcaatcagaacggaacaggacaggacagggattttcacaatgcttttccatacaatgtctggaatctatagataatataaccgattaggtcaggggtcaatctttaactaccaggcccagggtgtggcaccgggctgtctgcctgtggatttagtttttacttcttttttctttggagacagaaattgggcataagaaaatatgaggggtggggccccccttattccatgtaaaaatattctccactgcgttcccccgttctcacgttcatacatatttgaatcgttcacagtttggggcgatgatgaataacacataatcatgccttccagtccttccgtattcatgtttttagttttaattttttggtcaaatattgaggactggccttgctagaccatagagtagtgtatgcttaacttgctaagaaacagacagctttccaaatgctcatgctgctttccccctccccagcaatgcctgagagtgtccgctgccccaggcctgtcagtaccagccagcggcttttcaaatgtgaggcatcggatgggtgtaaaatcgcatctcgtgtgcattttgacctgtgtttctctgatgactaatgttcgcaaggattctttcttgcacttattggacatttgcacatctttcttgttaaaaagttttgctaaaattgtttgcccattttattgtgatttttttttgtctttttgttattgagttgttggaactcttcataaattctatatcaagaatgaatatgtgaagtgctttgccatatgtacgtatatatatttacatatatatttcatatacatgtgtatatgtgtgtatataatatatatatgtagaatatatatattgtatataattttctagtatttgacttgccttattgttatctgaactttttatatggaaatgtttttgattttgaagtccacgttaacatttgttttgacagctagtgctttcttgtgacctctttgaaaaccctttttcctagcatttcctttagaagcattagagttttagtttctatatttagttctatgatggatctcaagctaatttttgcgtgtaatgtgaggtaggagttgagatccattttttcacattttcatccaattgtttcagcagcatttgataaaaagaccttcctggccaggcgcagtggctcacgcctggaatcccagcactttgggaggccaaggagggcagatcacctgaggtcaggagtgcaagaccagcctggccaacatggcaaaaccctgtctctaccaaaaatacaaaaattagccagacatggtggggggcgcctgtaatcccagctactcaggggactgaggcaggagaatcgctttaacccgggaggtagaggctgcggtgagccgagactgcagcactgcgctccagcctgggtgacagagtgagactctgtctcgatataaacaaacaaacaaacaaacaaaccgtgcttatcccactgaaatcactggtgtttttaatgagaatcagccgacacgatggcgagtttcttcctgtgtcccgctccgcaggtctgtatgccgcttcctaatgcaaacacagcgtcactgtgacattatgggaggttttgaagttaagtattgtgagactccaacttcattcttctttttaaagattgttttgtttgtttccaattcctttacttctccagctaaattttagaaccaacttgatcatctcaaataccaaaaaacccgttgctgttgcaatagacagctgaggcacgggaaagaccctggagagagcccctgtgccatgtgggcaattggagaaggctgaaggctgaagctggagttctaagactgggaaatgcctgctcactccagcccccacccccatcaccagactatggagcccgtgggaacaaaggtaactgcacccaccaagtctttgtctttcctcttttcttttctttctttcttttttttttttttttgagacggagtctcgctctgtcacccaggctggatgcagtggcccgatctcggctcactgcaagctccgcctcccgggttcacgccattctcctgcctcagcctctctgagtagctgggactataggcgcccgccaccacgccctgctaatttttttttttttttttttgtatttttagtagagacggggtttcaccgtggtctcgatctcctgacctcgtgatctgcccgcctcggcctcccaaagtgctgggattacaagtgtgagccactgcgcccgacctgtctttcctcttttataaaatgcctgctgatgtctatgagttggttcctctgtttagttgttttctttgcttgctaattggtgtgagctctttgggttttcaaatgctgagccacggtcagctttattttattttattttattttattttattttattattattatactttaagttttagggtacatgtgcacaacgggcaggtttgttacatatgtatccatgtgccatgttggtgtgctgctcccattactcgtcatttactcagcaaactatcgtgtggtcagcttttatgttgcaagatcctccttggttcatcttttcattctcgcgaggccttcccttgttaaatgagaatccttgagtgtttaattttaacttatcaattcacccacctcttcctttagaattagagtatttggggccttatttaggaaatacttctctgagatcatgatatatttttctgtaaaagttgaaaacttttgtcatctgttttaaaatcttgaatcaggtatatgtgatggttaattttatgtgtcaatttggctggatcccagggtgcccggatatttggctgaatgttatttcttggtggtcggtgagggcagtttctggatgagaccagcattgggatcagtggactcaggaaagcagacgccctccccaatgtgggtggcttcctctgatccactgagggcccgaatagatcaaaacgtggaggaagtccctttctgcctgaccgctccagctggcacatcggtctcctgccctcggacttacactcacaccgtcagctccctggttctcgggcctttggacttgaacagaatgaccccgccggctttcctaggtcttcagcttacagacagcagatcatggagctgctcagcctccagaatcgcatgggccaattcttcataatcatctgtgtatctgtgtatctctctctgtgtgtatgtatgtatgtatgtatctatctatctatctatctatgtaactatgtagctatgtatctatttatctatgcatgtatctatcatctatgtatctatatatgtatctatccatctatgtatctatctttgtatctatgtatccatgtatctatctgtgtatctatgtaagtatgtatctatctatgtagctatctaactatgtatctgtctatgtagctatctatctacctatcatctatttatttatgtatgtatctacctatgtatgtatctatgtgtctatgtatctatctatcatctatgtatctctatatatatccatctatgtatctatatgtctattatctatctttgtatctatctatccatttatgtatctattatctatgtatgtatgcatctatctatctatctaatctacctatgtacctaatctcccactggttctgtgtctctggagaaccctgattaatgcagtatagatttttgtgtattcgtgtggaaactgcctttctcggcatgttttcttttccagcccctcggtcacccagtgtcagtcaggatggcctgggttgtgctgcagcaacaaaccacaccaagatctcagtagctgagtcaacccacacctcccaccaccacaagacacctggggctctgcctcttattccataacccaggcagccagttgctgtgacagaggaaaagaaaaatatactattcataatagaattcagcagtatattaaaaagaattttggcttacaggcatggtggctcatgcctgtaatctcaacactgtaagaggccaaggcgggaggatcacttgagtccaggattttgagaccagtctaggcaacttagggagaccccatctctacaaaaaaaaaaaaaaaaaaggcatactgatgtgcacctgtggtcccagctacttgggaggctgagttgggaggatcacttgagcctggaagatcaaggggacggtgagccattattgcaccactgcactccagcctgggcaacaaagtgagaacctgtctaaaaataatagtaaataaataataaataaaataactttgcaccctaaccaaaatatttacaaaccacatatctgacaaaggactggaatatacaaatctagaccatgtaaagaactctcaaaacacaacagcaaatcatacataaacacaaaaacaatccgatccaaaaatgggcaaaagacttgaagagacaattctctgaagaggacgtacagtggcaaataaggatgtgagaggaagtttgacatcctcagactttaggaaagacaaactaaccagtaatgcgatatcatgatgcccctatgagaatggcttaacaaaaaaatagcagcgacaccaaatgctggcaaaaggcagagaagctgggccactcgtatgttgatggtgggaatgcaaaatggtacagccactctggaagataggttggcagcttatgaaaaaaactaaccacacaaccgccattcaacacagcaatctcactcctgggcatttatcccagagacatgtgcacacggaaaacctgtccacaaatgttaataggaggcttattcatgatcaccaaatgctggagacacccacatgtcccttgatgggtgaaggggaaacacactggttcacctctgccaggggacacgtctcagccatgaaatggcaggaatgacagacgctcgatgacccagatgaatctccagagaatcatgctgggtaggaaaagccagtcttaaaaggttacacactgtgtgtttccattcatggagcattctcgaaatgacaaaattacagaaatggagaacaggagggaaatgtgggggctgcatcagggcaacgcgtggggtccttgctagagaaatgatctgtattgtgaccgtgccaaggtcaatatcactgtgttgttatgttacctgcattccagatgctgtcaccggggacatgggaaagggtacatgagatcccctttgtgtcttcttacgagtaacttcttacgagtaacttcttatgagtaactgcaggtgaatctacaatcacccgaatataaaaagttaaattgaaaaaagagtgcatacctcacagatactcagggagtcatgtttataaagtgtgtgggagagtagctggaatgcacgaggtgctgtcaatatcgggtggtggcagtgaaggcggtcattggataaatcaccaattaggcaattggcgaatcagattccaaatacttttccaaggtagaaccttggagatttgctgttggattggatgtggagggtggaagaggagtcaagaggatgcccaggcttctatcctgagccctgggaaggatggagctgctgtgaactacaatggggaaggctgggaaggcgttggttccaggggaaggaggaggagttcagtctgggatgtgcttagtttgaaaggccagatgtccatgagaagcaggcacctgggcctgtgagtgtggaacctagaggggaaggtgttgtgagagacatggaggaggtcgcaggtgagatagagaccccccggctgaacctggcaccgcccagtgctcagggcctggaggaggagaattaagcaatggagactgaggtggagtggctggtggcacagaaaggaagccagggctctgcactgggctggctctgtccctacatagatagatagatagatagatagataggtacatagatacatagatacacacatggatacatacatggatacatagatacgtagctagctagctagatacagacatacatacatacacacatacatacatagatggatacatagatacatagatagatacatacatacatagatggatacatagataggtacttacatacatacatagatggatatagagatacgtagatgatcgatagatacgtaaatagatacatagatacatacgtacatgcatacatagatggatacatagatacatagataggtacttacatacttacatagatggatacagagatacctagatgatcgatagatacatagataaatagatacatagatagatacatagatgattctgaagaattggaccctgcaattatggaagttgagcaactccacaatctgctgtctgtaagctgaaggtgtcccctgcttgtttccagactgagtctggttccccgatcactctgaccagagattcatgctaagatgctccctcggtgaccactccacaaccagccaacatctctaggctccatacagggtctccctgtgctcattgtaaatcatcaggccttcaaaatattcactagtggcagtggtgcatgcctgtagtaccagctactcgagagactgaggcaggaggatcccttgagcccaggagttcgagaccagcctgggcaacacagtgagactctatctctattaaaaacaagaagaggaaggtaaaaaagaaaataatcacaaacaagtaaacaagctgacaatgtcatttatttatttattttttatttatttgagacagggtctcactctgtcacccaggctggagtgtagcagtgcaatcataactcactgtagcctcaacctcccaggctcaagagattcttccaccttagcctccccattagctgggactgcaggtgtgcaccaccatgcccagctaattctttcatttttctgcagagacggggtcttgctatgtcacccaggttggtcttgaactcctgagctaaagtgttccttcttccttaacctcccaaagtactgggattacaggagtgagccaagcccaagctgactacttcttttttttttgagacagagtcttgctctgtcacccaggctggagtgcagtggcaccatctcggctcactgcaagctccgcctcctgggttaacaccattctcctgcctcagcctcccgagtagctgggactacaggcgcccaccaccacatctggctaattttttctttttttgtatttttagcacagatggggccaagctgaccacttccaaaagtgttctccactcaagcagctcgtttacttaacaatatcacttattcccacacaccccctcccaaatgtctttcatgtctttgcagaaccagctctcttaaatacattttccacagtcatatttacgatgcagattttaagtaaaattgcaatgcttgcaagaaaagaaacgtaggattctgtgatgtcactgaaagtgacattggagaacatctgctgggagccaggcaaggccaccacggtgaagatcaggcggttcaccctgaaagagaagctggtcaaggaggcaagatagaggcttcccaatggggtgagttgacctcaaagagaggcgtccgtgaaggatgagaaggagctcagttgtttttgctacgcgactcccttcagcgtcattctgtcacggccaactgtgaaatgaaggatgttgcagcaggcaatcctatgattttatcaaaaaattatgcataaaatgtccaacacgtgattttctctttgttgatttcatggagagttacaactatgtcttaaatcttgctaacaatcatgtgacatctgttcattattaaggaaggttttgggtttctttctctttctcttctacccccacaccacaagcacagacagcattggttctgttgggcctgtttccaacgaatggctggcggcaggctcttctctggtgcccattaccgtggtagtgaggccatctttgatctgcaggtcactgggtcctgcctgggccaaacacctccccctcttccctgcagaaacctcttcatcacacagcaggacatgaatttacccacaggagccacaggccaagcaaagagaacgccaagtgagccatggggggagaagtttccggcgtcttcttccggacccactgaccccacagcagcccctcctgccccactggccaggctggaggcagctaccaactccctacctcagtgtggtctgttctcatggaacctcatcaaagtgtacccttaaaaagggttccttttagccgagcacggtggctcatgcctgtaatcccaggactttgggaggctgaggcaggcggatcatgaggtcagaagatcgagaccatcctggctaacacggtgaaacctcatctctactaaaaatacagaaaaaaaaaattagccagtcgtggtggtgggcgcctgtagtcccagctacttgggaggctgaggtaggagaatggtgtgaacctgggaggcagagcttgcagtgagccgagatcgtgccactacactccagcctgggcaacagagtgagactccgtctcaaataaaaaaaagaaaaaaaaaaaattcctttcatttgagcttcaattgttctttgctgctcaaaagccttctaagtcttaccatttaccaggcagaactgagaactctgtagctccccaggtttctccaggctttctagaactttcctcctggctggcaaatcagccggttctttcgagctcaccctgttcttgtaatgctttgataaatgcagccacaacgacccacgtgggagtggcattgtgttttctgaactcttccctcagggatacacgatctgggacagtcttaccaaacacataataactacctttctcacctctaataactttcctttccacccaccctctgaccaataaaccaggcccacaatgctatgtttttgttctggtaggtttctgggtcaaccaggatagaccaattacgctgctcacacgcgccacccccacgtttcagtgacttcacacgacacaggcttacttcctgttcatatcccaggccactgcacgtcagctggtgactctgctctgtgcttcgtcactctgggactcagtcggaagcagcagccactgcttggaatgttggtggtcatggtaggagaagaaacggagaatgcagaagactgcagcaggtgcttcaaacttcttcccactgacgcaagcaaatcacatggccacacctgacttagagagggctcatggaagggccaccctaccacctgccatccaacctgttcccagaaggagaggagaaccaggatgcctacaaatagccctaattaccaccccattctgggctctgtgtggcaatgctgccagtcctatagataggtttttgcctaaatgagcttaagctttttttttttttttactccaacatatgcatttaaggctataaatttttctctaagcactgatttggctgcatgcagtaaatttgatagccccattatttcattaggggttacaaaatggttagcttctaattctacgatttcttctttatttataaactggaatacttcctctaattttttggttaccgtaagatagagtttctctatcagagatagaataagtgcctgattattttcctttatatagtcatcttcgaaataatgacttgattcctagaatcctctaaaggcaactaaattttacagtttgcatagtatctctattattatttgtgtatgtatgtgtgtgcgtatgattactcactcctagtttaaacatatttgatgtgtatcagtccagttaagaaattggtgttcagattgtttcaagtctgtctatacagagtttctccaggtttgactcttacctttttttttttctttttttgagacggacgagaggcagcggagacagccagccccatcctagcaccttccagcaacatcaccatcagactcacggagtccgaaatataacaagaataagaaaacaatagccatagccatagtaatgacaccgaacaacagagaaatcagcaagatatgtgtttcagtttgtcggcatggtatttttattagtttgcaactttctgtttaagataaagcagtgtgatcctggttaacatggtgaaaccctgtctctactaataataataaaaaaaaaattagccgggcgtggtggcgggcacctgtagtcccagctactggggaggctgaggcaggagaatggagtgaacccgggaggcggagcttgcagtgagccgagatggtgccactgcactccagcctgggtgacagtgcgagactccatctcaaaaaaaaaaaaaaaaaaaaaaagatacagcagagtgttggacatgcaaagccactccaaggaagcctcttaaacgcccaccttgttgcaggtgggacgcttatgcccagctgctccagctggaaaagacaggactgcaagtgggttcaggagctcaggcctctgaaaagatgagcaaaggcgaggctagtgggtgaggggtgattcagctgcaattgcagttgacttggggagagaatttgttaggagagacaatggacattaattagggtggactcttcttaggaaaaggcagccagatatggcatcgttctacagcagggaatggaccctgagcaatgatttggggctcaacaatgaaggacaggtcacagctttggaagacaggattagcaggactcacatgaggcctgagtccagagcctcagatcttacactggcagcacacagggacacagcaactagactgggagcagcagggattgcagcaactggactggcagcaggatgacccacaacctgaggaggagcagcagggcttacagcagctggactggcagcagtagggcttgcagcagctggactggcagcaggatgacccacaacctgaggaggagcagcagggcttacagcagctggactggcagcaggatgacccacagcctgaagagaagcagcagggcttacagcagctgcactgggagcagccacaagagccacagcctcctttggagcccccacaggagccacagccccccttggaacccccacaggagccacagccccccttggagcccccacaggagccacagccccccttggaacccccacaggagacacagccccccttggaacccccacaagagccatagccccccttggagcccccacaggagccacagctggagcaggaacaggctggcacacagcagcacacaggtttgcagcagcagatgggcacacagcagctggagccacagcccccacagccggagccacagcccccacagccggagccacagcccccacagccagagccacagcccccacagccggagccacagcccccacagccggagccacagcctccagagcagccacagcagcccatggttctggtggattgagggtggagcaggtagaggagcagatgagatggaggtgcaggtgtggagccccctgagcctggacccccttatatccctgggtagggttgctctgagaccttggtcactccatcattcccagcacttcctgggtatgtgattatttgtttgctggacttcgggttctcattggcctgatccaacacccacctgcttatgtttctaaatgtagtcacttcctccttggaactggaccttgtactgaactgatcacctgccttctgttttcctcatgtgatgggcagaggatgggttttctacaaagatcattttggttgttttcttcccatcttttcttcccacctatggcattatatttttctttgaaactgtgaactttgtgtgaagataattttttaaaaactaagctttcatccatataattaaagaggctaattgaggaaccaacgttgtatcttggttctgtcttaacacattggtgcactgcagtgaatctctcctccgccagcctcaggtcgtggggtgctcaggactcctggctgctgcatacacagcctcacgtggtgagtattgtttatgttaaaaatctcaggaatttcatgggtggatgggggatctcatttatcatcctgttgttaatctcttcaattaactattagtgagggtgattcttttactccaatataaattatatacttttttattggccaggcacagtggctcacacctataatcccagcactttgggagaccaaggtgggcgaatcacgaggtcaggagatcgagaacatcctggctaacatggtgaaaccccgtctctactaaaagtacaaaaagttagccgggcgtggtggcgggcgcctgtagttccagctactcaggaggctgaggcaggagaatggtgtgaacctgggaggtggagcttgcagtgagccgagatcatgccactgcactccagcctgggcgacagagcaagactccgtctcaaaaaaaaaaaaaaaaaatttatacctttttgacttctcattactgctttaaaagttatttggatattgagagaacaaatcccttgtgttcaaacagtgtactttgtttttccacaggcatgtacttgagtttaatttctgacgtttttaaaagccattctcactttgtcttaattgtcatttttagcctcgccaacattattagatggtataaaaatgaatgtctttcagccgggcgcgctggctcacgcctgtcatcccagcactttgggaggcccaggcgggcggatcacgaggtcaggagatcgagaccatcctggctaacatggtgaaaccccgtctctactaaaaatacaaaaaaaaattagccgggcgtggtggcagacgcctgtagtcccagctccttgggaggctgaggcaggagaatggcgtgaacccggcaggcggagcttgcagtgagccgagatcgtgccactgcactccagcctgggcgacagagcaagactccatctcaaaaaaaaaaaaaagaaaaaaaaaaaaaagaatgtctttcaagcttgggataaaggccttgtcttatctggaagaggcgagagaggggttataggttccgtcgttcccattgctaatgggagctgtggggcaggggactgagagaaacccacagagagggaagtgcctgctgtgctgaaaatggcttcttcctagggaacacactgggtcagaggatgcagccctgtgtggcaacagttcacgcctcccgactaggcgcggtgaggctgggatggggacacttcataagacctggattgtgagcacagagcccaggcatcctaacaaagctgtcccccaccagccctgcgcgaggccgcactggacatgagcagaccatcacgcaccccaggtgctcaccagagcttggcagctccgccctcaggtgctgggtaaagggaaccaggagcatcccattttgtttcaacataggtagaagatctagacaggattggccaaacccaagagaggtaacatgagattctgtaacagctatgaaaacaaaccttaaaaaacaaaaggaggaggaaaggaaggagacaaacctttctaagcaaacttgtcatccgggagacaaaagtagatttcctgcaaatggttgagttatgcaacaaataataacaaatatggcagcaaattacaaatatggcatactaactttaatagggctctcagttgagatggtaaaattatagagtaagttttattttgtttatttgtttattttttgagacggagttttgctctttcacccaggctggagtgcaatgatgtgatctcagctcactgcaaactctgcctcccaggttcaactgattctcctgcctcagcctctgaagtagctgagattacaggcacgtgccaccacaccccactaatttttgttttttttagtagagacagggtttcaccatgttggccaggctgttctcaaactcctgagctcaagtgatccgcccaccttggcctcccaaagtgctgggattacaggcgtgagcctctgcgtctggcctatagagtaagttttaaaaggaagagcggaggcctcagggaataaatgagcaccagaagtcattacagttcgagtcggtgattaggaagagtgaggggcagaacggaggtggctgggacttgggtcgctggcatccgagaagggcgcgagatgctcacagtgtggctaaagcacaaagccgtggaatcagccagagagaggctggcgaacggggaggacaggaaagctgcagcatcggtgtaagcagtggaggctttaacaaatggagcagaaagcagattcaaaggccagaaaaatgcaccatgacccgcaggaagatctgaaagtttagccccaaagagcgtaacatgctccaggaaagaatgaaggcggaatgctgagtactgagcccgtggtggtttggtgacagaactccaaaggctgaatcaacattgccgcttctgcaaatccctggccagtctgccgtggctgtcagggctgaggagggtgctcatagctagctgctcctagatgctcctcggagaggtcataaacccaaagataggggatcaatttctccaaaaaggacaaaaccaaaacatgacccaagaacatggtgacaaaacgtccttcaaatagaagaaaacaggaacacagcctccaaaatggcagaaatctaagacgacagcacctgggactcgggaaaatcatatggaccctacacaattgggattcattccaattaaaggagtgaggcagggataggcaaggcaggaagggctgaggacagtagaatgaagaccaacattgagtaattaactacacgggcgatggtgagttacggagcccacctgcattcccagagagaaaaattaacctgatgacatctctgctctccacctcctcaggccccttccacaacctccaggtgggtgggggttagagccatggaaggacccggtgacctagggcaggggtccccaaccctcaggccacagtccatggcctgttaggaaccaggccacacagcaggaggtgagtggaaggcgtgcaagcatgacctcctgagctgcacctcccgtcccttcagccgccacattcgattctcataggagccagaaccctactgtcaagtgcgcacgcgagggatctagggtgcgtgctccttacgagaatctaactaatccctaatgatctgagatggaagagtttcatcctgaaaccagcccccacccaccccctgggtccgtggaaaaattttcctctacaaaaccggttcctcgtgccaaaagaaggtggtggttgctgccctcgggtgctcttgaaaatggccctgcattgtggctgggctgctgtctccctggtgggcggcgatcctggcccctcaccacacccgtgggccagcactgtctctaccatctcgtgggtgctactgtttccatacttttcttatttttatattttccttttcgtaggcttttagattctcttttcttgcttctatggacttgctgaagcttctttcttcctttctcctctttttctgctggtttgcactgatgtttttgtttctacttttccccagtggtgactgtgaacattttaacatgcatgtttaacgcagtctgagatcagccactatcttcccctggcccctcacagaggcaggtgctcccctcagactagcatctcctgtgtcaacctgagtgccgtccagtgtttcagatccgcctccttcctgtacccccagcgagtcatgagcatcctacccttcatttcttctttatatacagcacatttaccttcacgagaacctcatacttccttccggaaattatcaatttgaagaagacacttctgtccctcagctcatggtcaggcacgccatagctaattgttacacctgctgaggtggacgtgtgaattctctccctcaaggcacttttgtaatgagttacaatgatacatttcctgacggtgagccatcttaacattcttggaacaaaccctacttatgacttgctatttttaaataatcatattggagtctttaatatttgattcagaaattgtgtgtatttgttaataacgaaatgaagttaaaattttcttgtgttttactggccttacctttttcttttttcttttttttcttttttgagacagagtcaagctctgtcacccaggctggagtgcagtggtgcaatcatagctccctgcagcctcgacctcctgggctcaagaaatcctcccacctcagcctcccgagtagctgggactacaggtgtgcgctcacaggcccagctaatttttgtacatttttgtagagatgagatatcactatgttacccagactggtctcaaactcctgggctcaagtgatcctcccacctcagcctcccaaaatgctgggattgcagatgtgagcacccacacacagcccttttcattcttctctgtcaggccccaaatgttcctgggtggttctggctgggggtctgaggctgcatcccctgaaggctcggctggtattggacccacttccaggatggtacatgccttggcttgtgggtgggaggcctcagcttctcacctgcaggcctctccacagggctgctattggcacaggatctggcttcacccagaaggagtagtactgagagagagagagagagagagacagagagacagagagagacagagagagaggcaagtgttgtaccacccttcatgtcctagcctccaagccccgtgccatcatgctgtctgccgtcttcgtcgcgagaaacatactgtgctgctggccttctccttgttgcttcttctgcaagtccttctgctggagccttctctgctgtgcggcatcagccagcactttactatcccaggaaaaaccgcccctgagccttcctctcatctgagtgtggtttcaggtggtggaggagtgaaaatctgtggggtcagcctagctcgttttaggaggagaaatccttccagctctctcttacctggtgcccccttttctgttgggttcttgatctggagcctacagatacaggtggacatcagatcctgtctggatactgcacagttttatgtaaagttgtgtgtttttgtgcatgtttgtagacttgtttaaagagaggctctgtaaaattccacagaggaatctacgaacccacagtagttaagaatgggtctgcagaggtagttcctaatgtggagcacaggagcaaagtctacaacatactcatgtctgctttacgctgaaaaggtgaaaaaaattaaaattaactaaaattaaaatagcaaatgactagacaggagcatatgcaccttatataatacacacatttcagggggcatttgctcaaaagctacataatcgtggggtgccccacgggacagggtgagaccactgccatgttgattgttccatcagagcattgtaagaggccctctgatgatcctctttgcccaattcagcgaacccgaaggtcatcaatggaccacgaagaacaaaggcccatgaaagggaagatgttcccaaagtacaaaaggaaaagtcctcttgtacccgagggaaggagctgatccaagggtgtcactaggagtcagcgcgggtgttgatacattacttcaggggctggaggcaaatatacgaggtactggaagcaaatgtatcaagcactgggacaaatgtatcaggcgctggatgcaaatgtatcaggcactggatgcgaatgtatcaggcgctggatgcgaatgtatcaggcgctggatgcgaatgtatcaggcgctggatgcgaacgtatcaggcgctggatgcgaatgtatcaggcgctggatgcgaatgtatcaggaagcaaatgtatctgttgcctctgttccagagctggaggatgccgcctctggtggggacagccaacacaaggcggctctctcctaatgggttttctgttcctccctgagatacagtcccctgccccagaacagagtggggctccagcatacacggcaagagtcaccgagtgccagctggtgtttacaccgtggcctgaggcctgttgactgggctcggggcactcacaggtattgtggtcacgggggcaaatggccatccggttccctgctctccaccggctttctttagcatccagtgggcctgcacccgaatgtagttgctgcttcccaggctgagcccgggacccggagcaggcgggcacccagacagggcatcctcttccgctcactggccctgaaagggcctctgccatcagcctgtgccgctgtccgggagcccctgggccggccacgcagtgggggaacccgcttcacagcgacaccgtgcggcggcaggaggaaccgctgcaggagacaatgcgatctgggtcctgacccagcgcagaggcagtgtctgccccttgcaatgcttggatttccttcctcaaaaggcagccttcgatgatctgaaattcaagttccagcaggcatcctgtactgtatctgtcagccctgccacccgagtggtctgaaagccctggaagagaccgcggttatcacaggagaacactttccatggggagcacgcagcaagctccagaataagcgcttaaaatccccgtctcagtcaacactgcaaaccttccaacaaagtcttacaccgaaaacgaccctgctgagctgagggctgaagccccaggtcctgggacccttggaaacagcccgcgggccaggagctgctgtggaccgtgaaggtgtagggcctaggcacgtcccaagcaagacacgatgctcccgcagaggaatcttcccgggagcaagccaggagtcctgggctcaaaatcaccctcggcaagaccaaggcctctgagcgagccactgcctgcccatcgcttccttcttgtcacatggaaagggaaactcaccgcggggccagtgtttactgaggggccgcttccatcacagacctgacagcacattcgagaaaagtgcgaggaaaacaggagttatttataaaaatgtaaagcagaagagaatactgggaccagtggcacaagcaggaaccaggaagtgacagtgtgcccagcctctcacctgaccctggacagggatataaagagcccgggctcagggggctccacacctgcacctccctctcacctgctcctctacctgctccaccctcaatccaccagaaccatgggctgctgtggctgctccggaggctgtggctccggctgtggaggccgtggctccggctgtgggggctgtggctccggctgtggaggctgtggctctggctgtgggggctgtggctccggctgtggaggctgtgggggctgtggctccggctgtgcgggctgtgggggatgtggctccggctgctgtgtgcctgtctgctgctgcaagcccatgtgctgctgtgtgccagcttgttcctgctccagctgtggcaaagggggctgtggctcttgcgggggctccaagagaggctgtgtctcctgtggggtgtccaagggggcctgtggctcctgtggggggtccaaggggggctgtggctcctgtggggggtccaaggggggctgtggctcctgtggggggtccaaggggggctgtggctcctgtggggggtccaaggggggctgtggttcttatggctgctcccagtccagctgctgcaagccctgctgctgctcctcaggctgtgggtcatcctgctgccagtccagctgctgtaagccttactgctgccagtccagctgctgtaagccctactgctgccagtccagctgctgtaagccctgtagctgcttctcaggctgtggatcatcctgctgccaatccagctgctacaagccctgctgctgccagtccagctgctgtgtccccgtgtgctgccagtgtaagatctgaggctctgactgcagactgcaggtggcctgactggtgaagggcccggctgcccagcttccttgccctgggttctctggtgctccactgtctccactgtgtcctcactggcttcatccactccacaccagtgctcccgaaactgactgaggaccccttctggctcattgcctactacttctcctgaacttcctctccctgctcctcactcatttaagatccaaagcggcccactgaggccccagaggcagatcagaccccttagaccctgacagctgctccttctttcaggagtgtgatcgaccctcaatctctctggctgtctgtatatcaagactgaatcctgaccctctaaataaacaaagtctctaagcacaaagctcactgtcttgtggttctctccttcccacctctctctcattcccagaagcaccatcttcttgcctccacccctgggcctgttcccatttctctcccctcagcatctttcatgtcatggtccatgtcttcatgcacagaactaacgtctatagctttctgctctgggccccttgttgtgttgggctccagagatgacagagcagagtaaatccaagctcacagtctggtatgtggggagaggtggggagagggaaaggtggtgagggcggtggtgtcagccgtggaggcactgccgtcccgtgggagggagggaagctcagggccaggccacttcagcggaaggatgaggaagggtctgtatgctgagctgtgcggtacatcaggccctaagaagcccctagtgcatgcaggagccagacgtggagatgcggaggagcttgggcttatctgcaatctcacagggccttgaaaaaccagacaggagaaggcaggactgcacacaacgccagctgcgggacacaagctcgaaggcagccgggagttgaatagatccccacctccaaaaaaaaattccagagctgggggagcccaaatgcccagtgccttctaaggcaacctagcctggagacaagctttctttcagcttttattttgggttcagggctgcatgtgcaggcttgccatatagatgaattgcatgtcatgggggtttggtgtatagattatttcatcaaccaggtaatgagcatagtacccaataggtgactttttgatcctcaccctcctcctgcccccgccacccccgccaaatgcaccacagtgctgttgttcccttgtgttcctatgtactcagtgctcaggtctgactcataagtgggaacacgcgatatttggttttctgttcctgcattagtttgtgaaggatattgacctccagctccattcatgtccctgcaaaggacatgatctcattctttttgatggctgcacagtattccatggtgtataagtaccacattttctttatccagtctgtcattgatggacattaggacgttacgtgaagatgaaggtagaggttggggtgatgcttctataagtcacagaggaccaagggttgccagcaagacccagaagctagaagagaccagaacagaggctctgttgcagccccagaaggaaccagccctgcccacccctgcatctcagacttctggcccccaggattgggagagggatgtttctgtcatttgtggtcctttgttagggctgccccaggaagcgagtacaagcggtggctcagtcagagcaggaaaagcagtcattcagggtattttctgtcggggggatctagagtggaaatcagaagcttatgttctcgatggcagctctgggacctggacttcctggaaggactccagctgtccacagcaggggcccctggagacctcaggtttccaagctgtcctggaaccctgagctccagtgcacctgccatgtggtccagggacagggagccacctcaccgccacctctgccacagccacctcagggcgtccacaggctggtgacagcactggggtgtgcgtctacccaagcctttctctggggaagcaggtgaccagctgcagcggaagccacaggtgcacagctcgccctcatgcgcagcagcacttgagccctggcatgggcctctgcctgccttcccttccagacctggggaaaggcattcgattggcaggacctcattctcaccctggccttggaattgacatttttatcttctagctcatgcagtgtagacaggaccggaggagggggtggagactctgtgggtggggctcgcctacttcctgccttttcccccctcaattatccccccactaaggcttctgtagccctgttactgtacccagggagggtgtccaggatcttggcttctcaaacaaagaattggacaaaacgcacaaataaagcgaggagagcaaaagctgggatttattgagaaggaaagtgcactccacagtgtgggagcagccgagcggaattcattgcaaaggagaaagaatgttgtggaagtgaggtgcagaacagacaggatgccctgggcgagacagggtgcagggcgggctgctcacaaggatgagaagcagagaccggcctgagggaggctccctttatgggactcttccatgattattcctaaggagctgggaagaggtgttgctaggaagcatgttctgggtggtcctctgggtgcatgtgtgcagtagctgtacacgcttgttcataccattcatgtctcattagcatcttaaatctccacccagagatgtgctttatactattataagggccccgttaaagagtttttgtgagtttaaataccctgtactggaggtccgccctatgtaaatgaagagaatgaagttacaaagtcatttgttcgctgtgtgcccatggggaggacatgtcctgtcatagctgaagtgcgaatccgccttatgttccctgcctccagaccgtattttcctgcctcagtcccagagcctgctgcatgggcatgcagctcccacaaacacacaagttcccacacttagaaggcttcatgccttgctgtcactgtcttgaaattctctgctgggcgtggtggctcatgcctgtaatcccagcactttgggaggccgaggtgggtgaatcgcctgaggtcaggagtctgaaaccagtctgggcaacatggtgaaaccccatctctactaaaatacaaaaaaattagctgggcgaggtggcgggcgcctgtggtcccagctactcaggaggctgaggcaggagaattgcttgaacccgggaggcagaggttgcagtgagcagagatggtgccactgcgcgccagcctgggcgacagagtgagactccgtctccaaaaaaaaaaagaaaaaaaagagaaattctaaataactttgtttatcagcttgggctttgggggcaaatctggtgggacaggggagtgtgcacacgacaggggttgcaccaggggcagtgtgcacgcgtgtgcatgcagggccctgggcacggtgggcagcacagacctggctgcgtggtgtgtatctgagggcagtccagggcaccagggggaggctgggctggaaccggggcccaggaaggagttggcagcggtagaagggcagtcatggcagctgcggctcacggggaggagagaccctgcgcatgtcagcagcagcccagggtgggcagctggctggtctgtctgtccccagagcttggttccccagcacctgctaaatatgtgcttcccagtccagggctaggaaaggagctgccaagctcaggcggtacacagtaaattgttacagaatgaaactgtgtatatggacgttagcatagagcaaaccagggggttattagaattcctcaaacacttttgaacctttagatttggaaaacggctgcaacattgcaaagcaaacatccacaagacaaacttagaaattaaatgtaaaggaaatggctgggcacagtggctcttgcctgtaaccccagcactttgggaggctgaggcaggaggatcacttgagcccaggagttggagaccagcctgggcaacatagtgagacctggtctccatgaaaaataaaaataaattagccgggcccggtggtgtgcacctgtagtcccagctacttgggaggctgaggagggaagattgcttgagcccaggaagctgaggctgcagtgagccatgattgtacccctgcactctagcctgggcaaccaagtaagaccctgcctcaaaaaccaaaaagtaaagaacattgtagttgatggaaaagaatactattttcaaataaagcttcaggtgaactgatgattaaagggtaagacagggcaggcacagtggctcatgcctgtaatcccagcactttgggaggccaaggcaagcggatcatctgaggtcaggagtttgagaccagcctggctaacatggcgaaaccccatctctactaaaaatacaaaaattagctgagtgtggtggcgcacgcctgtagtcctagctactcaggaggctgaggcaggagaattgcttgaatcagggagggtgaggttgcaatgatgcccacggtgatggattagaggtggagatctcattaggaactcacgctcagcttcgtacagacacagatggtcacacacaaacacctgcagatgtgtgcagacgtggttaggatgcacacgtatgtcctgttgctctgtcagtggagagtgttgacagctgttgtgagacctcggttcttgtcttcttagtttaaaataatttaaacaagacacacaggagatgcagcacagaggaattcattgcaaaggagaaagaatgttgtggaagtgaggtgcagaacagacaggatgccctgggcgagacagggtgcagggcgggctgctcacaaggatgagaagcagagaccggcctgagggaggctccctttatgggactcttccatgattattcctaaggagctgggaagaggtgttgctaggaagcatgttctgggtggtcctctgggtgcatgtgtgcagtagctgtacacgcttgttcataccattcatgtctcattagcatcttaaatctccacccagggatgtgctttatactattataaggagcaaagggtcagagtgaggacaggtaaaatcaaaatgtgcatgctctctacgggggaaattccctcctgagatagctttgttcgaatgagctcaatgacaacatgaatggggaggcttgttgccttggcccagtggtcactacggttgctgcgaggagatggccacttccttgacaacctctcctgcctcaagagggccccaaacctatggcaccccacagcagcaggaggttgaataccaggctccaacccaaggaccagggacccttggagacatggcaacttctaggactgaggcaaaaaagataaaggtgagtctggagcatcttgtagctccagaaaaaaaaaatctaaaagaaaacaaagcaaagccccgatacatgcagtgatggaaagtatcagaagcacgttgtagggacacgtgagccaaaagaaagcgctcctgggggttacaaatagaacaattcgatcaacacaataaatagagagagtagcattgactctaacccgaactgtaaaatagatatccatgaacatgactgatagaaataagtgatttagtaaataaataaaggaggatcacttgaactcgggaggcagaggttacagtgagccgagatcgcaccactgcactctagcctgggcaatagagcgagactccgtctccaaaagaagtaaataaataaaagtaaataaataaatgggagtggataggcaagtcccccatgcagaagagttcccactaattctgtgtagccctcaccccttaagtgcaggcagcactgggacctccttctgagaatgcagcacgggacaggggaattcaggagcatctttccgtggggaatcctgaaagacacaaacacagccaggagacgggggcagcatagcccgcgaggcacgacgagccatgccaacaggacaggccctcagcatggggtgacgagaagggcatctccctctgtgctcttccttcccacatccacagccccgtctaatcgtgaaaacaccagacagatcctaataagggacaccctacaaacacctgagcagtcctctgaaccctccaggtcaccaccaacaaggagagcctgggaaacggtcaccgcccagaggagcccagggagacggacaagggaatgtcacgtgggaccctgggtggggccctgggacagaaacggaccagcacgtaaatgctaatgagagaagaacaaagtgtggactttagttaataataatgtatcaatattggttctctattttattttattttaattttttttttgagatggagtctcgctctgtcacccaggctagagtacagtggcgtgatctcggctcactgcaacatctgtctctcaggttcaagcagttctcctccttcagcctgctgcatagttgggattacaggggtccaccaccacgcctggctaatttttgtatttttagtagagacggggttttgccatgttggccaggctggtctcgaactcttgacctcaagtgatccgcctgcttcagcctcccaaagtgctgggataacaggcgtgagccaccgtacttggtcattatttagtttttagtttagtttagtttagttttttcttcagacagagtcttgttctgtggcccaggcaggagtgcagtggtatgatctcagttcactgcaacctccacctcttgggttcaagcgattctcctgccttagcctcctgagtagctgggattacaggcgccagccacgacgtccagctaatttttgtattttagtagagacagggtttcaccatgttggccaggctggtctccaactcctgacctcaagtgatccttccgcctcaggctcccaaagtgctgggattacaggtgtgagctaccacgcctggcccaatattggttctctaattgtaagaaacataccatactgaagtaagatactaataatgggggaagctgggtgtaaggtgtatggaaacttgctttgcaatttttctgtaaatctaaaacaattccaaaaataaagcttattaaaaaataatttagactcccatgaaactgatttctttgaagaattaatttttttaaaaaaaatttctccacaagaatcaccaggtctacatgcgctgacatttatcatttaaaacaatttatcagaaactaatcctaatgttgtcacagcctgtaagatacctttactgctccaataacagctgtatcagcacaaagattcttctcaaaggtcatcaaaaattatttgagatcttgcatttgccaaaaaagactgaaataactttcagttatgtcaaaaccgaaaatgaaatttctgaagtatccattttgatgatctaataaatgaatttgcagaaaaaattggaaaaatcataaacatcctattaataaaatattatttattatataaaattctgaatccaaaaattattgttttgtagtttgtaaattggtgttgttacttggcaccactatcacccctatttattgtgtaagtgataaaatcattcctaaaggggaaagctttcactgtggttttttgctgctttttttttgtcccaagacagagtcttgctatttcccccaggctggagtgcactggcacaatcttggctcacggcaacttccacctcctaggttcaagcaattctcctgcctcagtgtccggaatagctgggattacaggcacacgccaccacccctgattaatttttgtatttttggtagagacagggtttcaccattttggctaggctggtctcgaactcctgacctcgtgatctgcccacctcagcctcctaaagtgctggggttacaggtgtgagccaccacacccagccttttgctaccttttgaaccaggagtcccaccatttctgtgtctggcctatctctctccctctccagggcccagctcctcggacccctcccgggtcctcacctgaccctgccacactctcgcccccgaccctgggctgggctccaccacaggctgctgacaaataaacaagagattggcaaatcagacccagcatcagatttgcacaatgatgcatcgtggcaacgaagggttgacatcaagaaagcaaatgtgcctgatattgtaaataataccagacataaatgaggctgcatgtggtggctcatgcttgtaatcccagcactttgggaggctgaggcaggtggatcacctgaagtcaagagttcaagacaagcctggccaacattgcaaaaccctgtctctactaaaaatacaaaaattagccaggcgtggtggcaggtgcttgtaatcccagctattcggcaggctgaggcaggagaactgcttgaacccaggaggcagaggttgcagtgagcccagatcacgccatagcactctagcttgggcgtctcaagaaaaacaacaacaaaaaaccaaaccaacaataaaacactcaccgtagtaatgacagacacgggggaaaacatcatctgttttctccatgttgcggaaaaggtattaataaaccatcaatgcctgatacagtaacaatagaacggcgacagatggagaagcccttcatacagtataaacacaggcacgcccataattaggttttcctgcaaatgtgcacgttcatatctaaagcgaaatcacatctctattcggcaccatgccaggggcggaaggcgcctgctctctaagacaatggttttatagtaacgattgcagcctccacccagagagcttcaggggcctgagctaggggctgtgctgaggagggggctccggtcacctgcggtgtctcccccacccctcccaacgcccaatctcctccagctaggcctccctctcggaccccgggccttgcttgaaccaaatggttcgacctctgcctcttcctaaggctcattcctgagctgggaagagaaagtgaggaaattccttgcagaaaaggagaaatcagtcatcaccttgtgtgttgtgtgtgaggctctcccagcccgtggaggcgggaccttttattccctcgatttgaaaggcaccaaacgcagattctctgcatgtccaaacttttttacaaatggaagaagaatgcataagagcgtaaagcatagcttgcaccccaatacacttttggcttcttgggtttgggccgtctcgatctgagcttgcaccctgctcttcatttccttcttttccccaagctggggggcaccaggctgcagccgtggtcatcgtcccagtgtgaacccccgaggcctgcacagctgcaaccattttctttgtacttaaacacaaacgtttatgttcgccagcgcccgtgtaaactagcagctccctctttccgtctccttgcttgcgttccttcgacgtgtcacctcacagacgccccttcactgtgtcacctcacagacacccctttgctgtgtccatccctccccagaaggttggagccctgagaacaggtgtacctggttttggtcattgttctaccctctggttcaatgacagtgccaggcacatagtgcacacacagtaaatatttgccaaatacgtgcagggctccaagccatcctgagcagctctgggcagaggggctgaaagtctcacctttccctcccgggtttcagggaagagcccagtctgggaagacaggaagccggcttgactcagcagggccgccagggggcactgtggcaagacggcgggagagccgtgtgcccagggttgcaggttctggagcccagaggtggcccaaggcgccaggtgtctggcaaactccaaccgcggatgcaggcgacagccccagtctccaaagattgagtggctgccactggctttaggataaaaatgaagcgggacccttaaaaacacccaaacatggtagaaatacgtgaactggacgggatgcacgttgcgttttgcattttgctttatagcctgcagcagagcaatgcagagggctccaggctcaaacaggctccgtcctggtgtgtttggaactcggggagcagaggagggctgcagggggaagagggcatcgggagaaactcttaaagggagggtcttcccgtgctgtgcacagcccttagtcctgtgccagcggtgggcagctttcatctcgcatggagccccccccggccctagctcccctgcagtgcccagtgcagccctggcatcccgccgggctcccccaccggcccgggccacttccatcttcccacaggagtgggagcctcagggaaggggcttctcggaacttcgcccactgtcgtccctctcgctggacctgcagcttgggccctgcgtgtcttcttatccagagctatttcttagttcctcagccctctgcttgtggttaataatgtttctatttcctgaaacttttctttaatggattgattgaggcctgtagccatctcattttcctggggagttggtcacgcgtgggggagtcccagacacgtggaaagtggctgtagtaactcctgccggtacctggggaagtggggaagaactgccatgctcagaaccgtccctggccactcccgagcaccctcagccttcacctgcctcttgaccctggcgtctctgtccagccagagccccaggagctgcctgtggttgaaaggttgggctacgactcaccacgtggccacacacaccacgggcaccgcggggtcgcaggaggagcgtcaggaagaccctctgtaggactgggctgtggctgggtggttgggggtcaccccgggttggaggctgtcagaaagctggagcccgcatgaccagctggcaaaagtctgaccccaggcaaggcccagctcctgttagcagagagaaggggaggtttggcatttcatggctggcaccgggatcttgatttgtccgtgtttagatgaaattatgaaagggcctcgttctgtctcatctcatcccagccttgaagttgtctgaacttgttttcagctggaatgcaggcaaacaaaccacttccagcccagaccacctccactcccagaccacctccacccgagaccaccccaccccataccacctccaacaccagaccacctccacttgagaccacctccaacctcagaccatcacaccccagaccacctccaccccagaccacctccaccccagaccaccctaccccagaccacctccaccccagactaccttcaccccagacaacctcacccccaggccaccgcaccccagaccacttgcacccgagaccaccccacctcaggccacctccaccgcagatgtcctccacccctagatcacccatccccagaccacccccaccctcagaccatcccaccccagaccacttccaccccagaccactccaccccagaccatctccaccccagaccacctccacccgagaccacctccaccccataccatctccaacaccagaccacctccaaccaaaccacctccaccccagcccatcccaccccagaccactccaccccaaaccacctccacccgagaccaccccaccccataccatctccaacaccagaccacctccaacctcagaccatcccaccccagaccacctccaaccaaaccacctccaccccagcccatcccacccaagaccactccaccccagaccaccccaccccaaaccacctccaccccagaccacctccaaccaaaccacctccaccccagcccatcccaccccagaccacctccaccccagaccacctccaccccagaccacccttacctgatggaggttttggggctctggaaagctgccttcaaagttctctccagcctgggccccctggcccgccccctccactggcgtttacccactgctgcctctcgctccccaccgggaccgaggacctggcctccgctccgcagctggggaggggtcttccttagggcactggcaggaggcccggggtctgtcctggctcttccctggttgttcctcatggatcagataattctctcctgcttcttccccgacacgaagcaataggctcatatccagcagctcagaggcacggtggggggtagggggttgaggggtgtctcgcacccctgggcccaggtttcagagaggcagaatctgccactgcggctgtgcccacgtccaccctgaccccgaccctgaccctgggcatgaaccggcagcaactcgctctcaggagggtggggaccgccgggacggacctgttccctccttccctccctcccaggggagctgaggcagcaccctggacccccgagctgggggtcggcagcgccgtgaccccatctgccccatttaccatgggctgcaagatggggctcctcctggggtcctccacgtgtgtttctggggcagcacatcaccggagtccaggacaggctggggaggcaccagtagccccagcacccttgctgcaggcagggcaaccgctgagactccaggggctgcaccactgccctgtggccgggcccctcccctccttctccaggtccctccaaaagtgctggggatgggcacgggggaagtgacaggactcctggctctcccttcagtggctgaggacccccagtgcccacaggttcagagagggaggtctggcgggcgctgcggggcagccccgacctggcacccaggagaggagccccttccgcgtttcgacgctcccacccacagcacagagagacccgccccagcgctggacattggggtggtcagtgtgtccggccgcaggcacagctgcactggtggctgctcctctgtcctgttttcctgcccatgtgacctggagccgctgtgccaggccttccaccaccaggttggggaaacagcagcagaaagaacccccgagatgcccgacaagcagaggggactcctgaggatcagggaactgccagggctgcgagctctcccagttgggggggatcctcacccacaattcagctcctgtctcccggcacccccaaccaccttcacattgtcaccagcaggggcctgatacccaggtgggaggttcaccccagaggctgcagtctctggcaagacggggtggggtgcatgtgggcggcaagccgcccaggtgccgaggcaagagaccgagggcacgagctcttccagtgtaatgaagaaaatatatacaataagaatagttatactagatatagatcatagatatgattatatacgaacattattaatcattagtttgtagcaattactctttattccaatattataataatcctcactgtataatcataacctaggaaaaaccaggccatacagagataggagctgaggggacatagtgaggggtgaccagaagacaagagtgcgagccttctgttatgcccagacagggccacccgagggctctttggtctagaggtaacgccagcgcctgggaagacgcctgttacctagcggactgtggtctggcggtaacttcagtgcctagaaaaggcacccgttacttagcagaccgggaaagggagtctcccttgccccgggggagtttggagaagactctgctcctccacctcttgtggagggcctgacatgagtcaggctcgcccgcagttatccggaggcctaaccgtctccctgtgatgctgtgcttcagcggtcacgctcctagtcctccttcaggttccatcctgtacacctggctctgccttctagatagcagtagcaaatcagtgaaagtactaaaagtctctgatatgcagaaataatggcgtaagctgtctcctctctctccgcctcggctgccaggcagggaagggccgcctgtccagcggatgcgtgacccacgtgaccttacctatcattgcagacggctcacactccttaccctgcccgcttgtcttgtatccaataaataacagcacagcctggcatttggggccactacctgtccctgcgtcttggtggtagtggtcccccgggctcagctgtcttttcttttatctctttgtcttgtgtctttatttctatgatctctcgtctccacacatggggagaaaaacccacagaccctctagggctggtccctacaggtgcaaaaggtgtaggactctccccttccccagagtcacagggaaccccggggcgctgctttgttgcatgagcattgtccagaggggtgtgggggtaggagtgagacatgacggagcccggcccagctcggcgacagggtggtgaggtccagggtgccaaggttttaaggcacccaccctgaaaccgaggctctgggacccattcaccatgatgtgagtgaccctcagggatagcagagtgtggggtggacccgggcggaatgaggcaggtgctccagggacccccataggacacctggacacctgtgtctccccacatgcgccagcttcagtgcctgggaggggacacccctggctgccacggggaatccactaggaggctgtggtgtagagaaaatgatacccctccctgctccatctctctggccagcgcttctgcagagcagcagaggggctggggtctctgggcacggccatgcagagtgggctccaccaacacctccggcttctgctggaggcttcctccccttggcccgtcgctcacccctttcctgagtgacacagcaggacagggggtggtgggccagtagggaaggctgcaggcaggaacgcccacggagcagtccccgggctctctgttacctccaccacccaccctggcctagggcctgaggactgctgggcttcctcctgcctgggggtttccggtggtcaagtccactgtgcccagccgtccagaaaacaggagccacctgcccgtgtaacacggtggggcttttaatccacaggagcctcaacacctgtgctcctgggacttcctcttttagggggaacatgtggaaccttggtcccttcaggaggggcagtccccacccgccagtcgcccagggcatcaccctctgagcccctctcagtccccagtgtctgagggtgccaagggcctgcggttcctgtctcaggcagttcagcactgctgactcctctggaaagagctcccctgaccgtgggcttccataaccagccgaggtctgcatcgtcagtgcgggcacctggtccaaacccgttattctaaatttgacaagagaacaggggccactggcctgcttttcactggtgagctgtgtttcctggacccattattgatgctggggtctaatgacattttctaaactcttacagcttgtattaaaatatcgaaacctgagtcccttgatattgaggaaagtggtcagttagtcaagccatagagttggacagtagatgcttgcccgtcatcaccaagattgttcattgattttgaagcaatacttcaggattgacaaatgatagcagcctgaaatactgtgtgcgcctgtgagtataatgaacattcggtgagtgtgtcaatggtaacatctcctccctacaaaagatcatagtttctcaggtgaggtggctcacgcctgtaatcccagcactttgggaggccgaggcaggcagatcacctgaggtcaggagtttcagaccagcaccaacatggtgaaaccccatctctaataaaaatacaaaaattagctgggcatggtggcaggcacccgtaatcccagctactcgggaggctgaggcaggagaatcccttgaacctggaaggtggaggttgcagtgagccaagatcacaccactgcactccaggctgggagacaagagtgagacttggtctcaaaaaaaaaaaaaaaaaagaaagatcctaatttcttatcactttctaaaaggtgggcgatggatttcaagatgagctgttctcaacactccttctccttctggaaatccttcagtcagcccaccttggcctctgagctgcctggctgcggaaggaggctgagagatgtcaccagaggatgcatttcagcaccgtttgcactaagatgtaaagaccaaaacacttttcactaaagtgacttttggaactttagatgacattatatttaaactttgtatcttagaggtatttgttttaagcagaaatatttacaatctagctcatcctgagaaccagcctctccacagcaccgctttccaatgcgaccacctttccagagaggggcccacctgtgggttgtggaaagttctttgcattttcttttttcttttcttttcttttttttttgagacggagtctcgctctgtggcccaggctggagtgcagcggtgtgatctcggctcactgcaacctccgcctcccgggttcaagcgattctcctgcctcagcctcctgagtagctgggattacaggcgagcgccaccacacgtgaataatttttgtatttttagtagagacagggtttcaccatgttggccaggatggtctcagtctcctgacctcatgatccgcctgcctcggcctcccaaagtgctgggattacaggtgtgacccactgcacccagccggttctttgcattttctaggacgcagagcagacctgtgtgctgagacctggcacggatgggagccctcttggcacaagaagattgacagctgtggtagaaggtgctgtttcttgccaggagggcgtaacatagagccatttctgattatcttttaccaactctcactcctaatgagaactatttctcatacctaaaagcaagttttactgcctctatggtgaaaatagtctagtttaataatgttttctcttgggacaatgatgctttgtaaatggaaataacacagattctgtactttgccccatcttgtttttctttctttctttctttctttttaggcagtgagacagactttattcagggggactacagcaatgaggttttgcggcagggaaagaggttgcagcttttgggtttgcttcatgccttggacacacagtaacttggaattcttgcacttacaattttttgaattatgaaagtaatacatgttagtggctaaacaagaaaggaaggcacggccgggcgcggtggctcacgcctgtcatcccagcactttgggaggccgaggcgggcggatcacgaggtcaggagattgagaccacggcgaaaccccgtctctactaaaaatacaaaaaaattaggtgggcgtggtggcgggcgcctgcaatcccagctactctggaggctgaggcaggagaatcgcgtgaacccaggaggcggagcttgcagtgagccgagatggccccactgcacaccagcctgggcgacagagcaagactccgtctcaaaaaaaaaaaaaaaaaaaaaaaaaaaaagaaaagaaaagaaaagaaagaaaagaaaagaaaagaaaagaaaagaaaagaaaagaaaggaaagcacgaaggaaaatagcaaagggtcccggtgttgcacacacacaaagcagcagcagccgctggaggtcttccgtgtttggtaaaggtggctacggactcccgcatggagacgcggcctggagggtgtcactgctctaggctgtctgcagggcctctccgcagacctggacggatttcagtgggagactagagcgtcacttaagatgtttgaatgtaaaagcatcctgaatgatcatcttttagcttgagattttggctacctttcaaacagacatagtttgacctttgcagtcctaggtaatgcaggaatggcaaatgctcctgaaggcggggaggcggcccggcccgcactgagcttctcaccggccagagggcgcagccacccggccttcccgaagcaggacagcggcctttccaagaccgcggagtccccgtgagggatggtgcctccggagcctggcatctcgggcggatgagaagctgagcgcggtcagatggcccgcagggtcccactgcgggccgagccctggctgggggacagtttggggggaagcagcagctgcctcagtttacagtggcagccggaggaggacctgggcagtggcgagtgtggctgtttgcatggcggggagaaagaggtggtccctcctgcctgctgctgatgcccacggcctcctgtccccaggaaaggggtctgcgcccctcccccaccggaacagcgacagaagaggcgaccctctcaaaggcccttctgctgctcaccgcggggtgagtgatggtgtggagcaggatctgggtccaaggtcttcttccacgttcagggttcccgtggtaactgaagaattatccatccagagaggcaggggagggcctgggacagggatatatcttattattgataagtacaattttaaattttaaattatcagcaggaccgtaggagatgacataaagaggaaaaataacctgtgtggcgctctcagcataaagcgcccaggttcagggatgcgtgtgcgtcctgctgtctgctcattcgaagagcaaaggaagcagggatgatttagggcctccgaggtgacacggaatcgggaggaatggcgccacgagaaagacgtctttctcattttgtgagcagagagcccatcgttcaggaagagcatctgagccacaaagctaatcacagatcaccgagccagcgccggctcctgatttgtctgtgtggctccaggtggcaggtgctccacggcactcagtaaaaggtgcatatggtgaggggtgcaggcagtggccaaacaagggcttccctggatcctggagtggctccttccagccacagccaaggctgctggagggaagaccaggccgagggcacgtcttgcgtgctctcactcacaagcacacacctgtatttaccatgttatgtacacccacagaatcatctttaagatcttgttaatattaatatataaattgaaggtcggaggcagtggctcaagtctgtaatcccagcagtctgggaggccaaggctggtggatcacttgaggtcaggagttcaagaccagcctggccaacatggtgaaaccctgtctgtactaaaaacacaaaaattagccgggtgcactggcacatgcctgtaatcccagcttctcaggaggctgaggcaggagaatcgcttgaacctgggagtggaggttgcagtgagccaagattgcaccactgcactctagcctgagtgacagagcgagactccatctcaaaaaaaaattaatatataaattaatatgagtaacatatacacatacattaataaaaatatacaaaataatacatatagtatataataatatatgctaagtataggaaatatgaataatataaataaaaagattatgaattatgcattaaatattaaataatattaatatgaatataaatatttattatatctatctatctgtatgtacctatatagacacagacagatatctatctctatagctagatatttctatctctgtacacactcatctatatccacatgcatgtatatgtaaaaagagagagagagcagagacatagagagatttatttcaaaggattatcccgtgctattgtagaggttggcaactccaaaactcacagggcaggcaggaggctggtcattcccacaggaactgctgttgcagtctacagcctgaagggagaattccttccttcttgtgggaactcagtcttttccttttaagaccttcacctgattgggtgaggcccacctgccttcctctgactggatgaggcccacccacattgtcagagggacatctgtttcactcaaagcctactgatctaaaatgactttgattaaatgaccttcacagcaacattcagactggcgtttggccaaacagcctggcactgtggcccaacctaggtgacgtgaagctcatgacctccctgtgcctgcagggcgctgtggcactccatccctcttctgtgtcaaagagctgtctgaactgctccagcaactctgacacatggggacgtcctgtcctgaagggatgggggcatgctaggactggtttgcgaatctctccataaatggccttgctgtctccagcatgagagaaggttggagcgtaaagagcagatttctgcggtgtcccttgtgcttcctgaaaggagtcccacactcaagctcacccccacggtggatgtgctggaccaggaccctggggtgctcggggcccgagggtgccaggattagaacctccacacccagaggttcctgcctggggcctgcatcacccgtggcgtctcctgcctgccccggattcctcctctttcttccctttgccgttttttctggctcctttagctgcaggtccacagctggcttttctccagctctcctgcatactggctgagaagggcacctatgtcattgttgctggctgtttgcgctgctgtaatgcaatccctgagactgggggatgtatacaggacaacactgatttctcatagtcgtggaggctgggaagtccaagatcgaggcactggtaggttcgtgtctggtgagggccccagtctgcttcatagctggtgcccttggctgtgaccttcagaggaggtgaacgctgtgtcctcaagtgggaggcagcagaagggcacatccagcagtgaggctgttgctataacaaatacctacaactgtggaagcagctttggaactgggtaatgtagaggctggaggatttggaaggtgcatgctagaagcagcctagattctcatgaccacagagaatcaccactaagggtgattctggcaggtcctcggaagagggtgctgcggaaaagcccagttctcctcacacttaaatggttgtgaacagaaagttagtagaaatatggagagtgaagactattctgatggggtcttagaagtgaggatttttttttctttgagacagggtctggctctgtcacccaggctggagtgcagtggcgagatctcagctcactgcagcctcagcctcctgggctcaaatgattctttcacctcagcctcctaaatagctgggactgcaggctgccctaccccgccctgccacctcacatggcagctgttctttattcataatccccactgtctgtctctgcttctcttctccctttctcttctctctctgtcttttggggtttcgtcatgttgcccacactggtctgaaatcctgggctcaagtgatcctcccacctcagcctcccaaagtcctgggattacaggcgtgagccaccccacccagccagaagtgaggaatatcttactggacgctagaggaaagaccgaccttgttgcaaaatggcaaagatcttggctgaattatgtccatgttcaagtgctctgtgtaaggagaagtttaggagccagaagctgggacattgctaatgctgcatggagcctttttcagaggagtcttaatcccattcgcatgagaggaggccttcctcaccgcctactcccctcccaaaggcccggcctgttacatttcattgcaggaatttcggatgggatgcattcacaccaaagcgtcaccctcctgagtacctctctgaagccaccttggagcctgggctcccccaggcatgggacagcacaccccgtccactggagccgaccctgatgaatgcaggctcactggctttgccaccgcatgcccccggaggcatcagacgctgcttgtctctgctgcctttgaaaggtgtgcgtggagtcgcaggcctgaactacatgagatcgagacggaaaccccgccaggcaccaactaacggatgcccaggctggagtgaccctcctcctcaccctggcagcagagacccacgttggccatcgagaaagaaccgacgcctagcgagaagtgacagggaacattcaggatcccccgcctgcccccgtctggaccttgagatgaggaaggactttgtcgtttttgtcactttaaccgaatcttggacaatcaccgcccaaagcgtgcactctgtgggctgtttaaaaaattatatgcgcacagactctaaaggaaaaaccagagacaaaccgctcatattccatgaaccttccttctgcataaaccgccacgtgtcgcttggcaaagccgtgggcctggcagtggggttagcctttcccactcaggaaccgcgctggccacgtttctgccggcatcagcgcccctgagctgctttccaaagcgcggcgtcaggaacgtcactcttcactgttgaattcaacgtgggcacctttaatggctcagtcatttttttaaaaaaaatcaaaattccacgcaggggccttggttccagagctccctttccaggaggctgttgcgcgggctggccaccaggtggcactgttgcatagcaaaaggaacgcggctccgcgctggagaaccgggccgggctgcgcggaagccctggagggccagccgggtggagggagctgcaggagggggcggcgtgctttccgggggtgcaacttggttttccctggagggataaagctctcctttggcaggtgcctgggggtgccctttaaagcagggagcccagggaagacccagctctcttcctgtgagctcatccctggcattcagggtgaaggacctgcagcctggtctcggaaacggccctccaaggcctccttgtcccctgaagcacacaggcagaccgcgggtcggggtgcaccgtggctgtcccttccctccaatgctgggcgacccgggcgggtggccaccgcctgacctgggcctcctggctgccagcctgcacgccctgggtgcagaggcaggcgagcctggcctggtctgaacagtcttatgaggattctctgggcccgtgtgctcccgcctgcccctgaagggcgtagtggaagcatccgaacatgcactgggtaccctcgtggcctgggacagcccttccctgctgggctccttgctttgtgttaaccctgaggcctgggagcctgagttggggaaacgggggactccagacaacacccagcttggatgccggcgtccacttctgctcagagaatccagtcaactcagggctttgggctttcccatgaccaaagaaaagaagtcagtgaatgagaatcaaataaaggaaatgattttctgccaccaccggggcgcagacttgctgtccataccactgtccctggctgtagcacccatgtgtgcctgtgtgtccagaggcccacggagcccagatgggcctggggatgatttcagcctccaaggaggccgcccatctcttccggtggcccctgcttctcacccagtgtgggccaggcccacctgaatgctgagggcaaggacgagtggtcgttacctaaacgagccagagatggcctctggggactggcccttgggtcacttatttcttccctgcaggctgagctcattagttcaagagcccactggcaccaaactcagatttttatacattcaattgttttaaaaatagccccaaacaagcagactttcagccatttagagcctgcctgttgcatgtattctgcaaaacctcacctggcagctgttcgctattcatcatcctcactctctgtctatctctctgagtccatctctgtctctgtctccatctccatctctgtctctgcctctgtttccgtctctgtctccatctctgtctctgcttctcttccccctctctcttgctctctctcccttctctctccgtctttctctgtctcttgctctctctcttccttctttcccccgctctctccctttctctcccctttctctcccccacccctaccaccctgtctctcttatctgtatgatggggaatgaaggatgcagcaatggccgcccatgtgtcggtgggagctcacttccccaagcctttacttgaggggactctgaagggcttcatgtcgcgtcagcttgtgatacgcacaagccgactgcagcagacacagctgggccctgtgtgcacatcttcgcccacctcgaggtcacctgtggacaccagcatggagtccagcctgtggggaaggctggagtcagggaggctaatgcccttctaggggcaatctgtactaatgaaagagaaataactcagaggacaccatggcgtcccctgcagccttgcagagggtccccagcagctgttcctgcactgaggcctccttggcctcctcctccctcttccctgcgcttccccgaatccgcccccaacccgtgagctttgccctccagcctttggctcagtgtctgtttttgaggaaacataaactaagataacagccttgtgatttcagggctccctgtgaccgcagcagggcctgggttatccgggcggatgcagctgtccacagacaggcctgaggctgggcagggggtagggggctgtggcctgcgtgtgcctctgttcccattcccgtccccttcttccttgaggagcacacgccttctccactgtcacattcctcctgcatcaggagccccctggaacccgcggcttcgggtctggtgcaccctgtggggcctcatgccacttggtgtcacgtactcaagagtttattttcccacagaaatttaggagaaagtagggattgtttgtagtcaaaggaagaagtgttcctcagtggatggagaaggcctggctgtgctccaaggccctgggccctgcatactcatctcctggggcttcctgaagctccctgtggagcgtgagcctgccgggccacctggagcacagggggcctccagggacagtgggggcactgcgggccgggcccacgagtgggctccttcacctgggcctcccccagggctgacagccccttggatcccagggaaatgcgtcccaaccacagaatgaggtgctgctggggtacctccttcctcgagcaggacagccagtcatggtgcccctctctgagtggcatgggcatccaggtagaagagtgccaggacatgcctgggcagcaccctctgggatgccacgggctctatccccagctgcccgctgtgcctcattctggggttgatgggtgccagggctcccgcatgctggaccagcagggcaccctgcaaggtggtgccgccttgaggcagtgccaggaggtgacggctcgcccacacaggctcccgaacatcagggatacgcagtaaagacaacctcattctaatgttctgtctgtttggatagggacaaacacagcccagatctcagccccccggcagacaccagacaccgcaatgatttgctccagcaagccaactgtcccggagcggtagctgctggagtcctgatccaactccactattgtcattcctatacccaggtgtgggcgatctgtgctgttagacctggggggctgcaatgggtgggacggaagcctctggacccccagtccctggtgtagaatggttcctgggagtctggaagaggtgccatttctcacgcgcctgtcggggatggactgacagctgcaggacccacctcgccgcttctagctgtgggtccatgcagccaacacagaggtttgtggtcactgaggacattcgtgcagacactttgtccagtgcccgaggggacagctgcaggccagctgtagagtccatgcaagttctgccctgagcggtttgcattgaaatccaggcagtcgtctgctctccacacacttccactctgactgggagggggccgcagtgtccttcaaccccatgggtcagcgtccacaggccctggatgatttaggcagagttataccagtaaaagaccacagctgtctggggaagccaggagcatgcctggcacccactcagatgctgccctggcagcagccttgttcagggtcccagtctcctgcacatccgggacgctgagcagggctggctgtcaagtggggctggctgccgtgctcacctgccttctgctgctgggggccgggggactgtgcttcttcgcctttagtggtggaaggaaaatactcatgtaacaaaaactatacacatgaagtgttttcccccaaagaaacaagggtgctagccggaaagatgatcagctgccagaaaaccaaataaaatagcaaaccttctctataggtgcccaagatgcccttgacaaaactccaaagccactcatggcaaaacccaaagccaaagagagatgggaggaaactgctcaaacatgaggaatcgtgcttctcaggagccagtggtgaacacgaccttaacatatgaaatgcaaaccactgtcattcgaatgagaactaacgtggtccccgtcacccccatcatttattttggttctagccaccgcaggaggatcacagaataacacaggccatgtagggaaattgcagcctggccgggcatggtggctcacatatggaatcccagcactttgggaggttgaggtgggcagatcacctgaagtcaggagttagagaccagcctggccaacatggtgaaaccccatctctatcagaaacacaaaattatctggccatggtggcaattgtctgtagtcccaactgcttgggaggctgaggcaggagaatcacttgaacccgggaggaggaggttgcagtgagccgagatggtgccactgcactccagcctgggtgacagagcgagactccatctcaaaaaaaaaaaaaaaaagaaaagaaggaaagaaagaaagaaagaaaaaagaaaggaaagaaaggaagaaaattgcagcctgcctgagtggggtgtcctgctggtgaggtgagtgctgctggggtctgggcttgttgctgacatatgccttgagaaaggtttgaatagggccgggaacagtggctcacacctgtaatcccagcgcttgagaggctgaggcaggcaaatcacttgagatcaggagttcaagaccagcctggccaatatagtgaaactccgtttctactaaagaccccccccaaaaaaaacaaaaaaaaaacaaaaacaaaattagccgggtgtgatggctcatgcctgtactcccagcttcttgggaggctgaggcaggagaatcgcttgaacccaggagatggaggttgcagtgagccgagattgcaccactgtaatccagcctgggcgacagagcgagactccatctcaaaacaaaacagaaaggtttgaatgttcctcagccacttgagtggcccggtctgcccaagtatgagagatttccagggatgcagggctttcaatgctaagaatcattttaaaaaggcagtctccgggagtgagtgggtcgccctagcggctgtgactggtggcgcccttccccgcccctcaccagccctgaagaaactgcccctcatttttgtttttctttgcatttgtgtgatggctgctaactttcttgcatgcacattggccatgagtgtttcctgtaagatataagtttcctgtgtgtattatttgcccatatttcttttcttttttttgagacggagtctcactgtgttgcccaggctagagtgcggtggtgccatctcggctcactgcagcctccacctcccgggttcaagcaattctcctgtcccagcctccgaagtagctgggattacaggcgcccgccaccatgcctggctaatttttgcatttttagtggagacaagagttcatcatgttggccaggctggtctcgaactcccgacctcgtgatccacccacctcggcctcccaaagtgctgggattccaggcatcagtcacggcacccagcccatatttctacaaagattttgtcttcatcttttaagttcagaatgtaaataccctgtggctcttccatcttgttttgggccttagtctgaattgcgccctgtcaccacaaggtgcatgaacaagggcactggcactgccttcagtgtcacagaaacaacaaaacgatgccaaacacacgacgtgaaatgctgagatctccatcaacaggtgaccgccgaattcacgacgatccaacgtaaccgtggaagctgatggaaaaaaggaggtgcatatacatattgatgttacaaccgtcccatgttaggctgggcgcggtggctcaagcctgtaatcccagcactttgggaggccgaggtgggcggatcacgaggtcaggagatcgagaccatcctggctaatacggtgaaaccccgtctctactaaaaatccaaaaaattagccaggtgtggtggcgggcacctgtagtcccagctactcgggaggctgaggcaggagaatggcgtgaacccgggaggcggaggttgcagtgagctgagatcgtgccactgcactccagcctgggtgacagagcaagactccgcctcaaaaaaaaaagaaaaaaaaataagaaagaaatctgcaggtttatgagcatgagcacagacagtgggtgaaacagacactaagaggtgttcacactgacagcggaaggatcaggacgagaaggggttgggggaagtttttcgcttttaatttttgtaccccctattgtttacccagtaagaatggtcgggtattccttttataattaaaggaagtaatccattgaagaaaataaaataaataaagttgaaaaagatgcatgcctattgtgggcctttcttttaggtaaaaataatgtctagaaaaatgaaaaccaaaatttctaaccatactttttttaaagaaagaagttggtaaagataaaaacataaattaggccagactcggtggctcacacctgtaatcccagcactttgggaggccgaggtgtgtggatcacaaggttgggagattgagaccatcctggagaacacagtgaaacgctgtctctactaaaaatacaaaaaattagccgggcgtggtggcgggcgcctgtattcccagcaactcaggaggctgaagcaggaggatggtgtgaacccgggaggtggagcttgcagtgagccgagatcgcgccactgcactccagcctgggcgacagagcgagactccgtctcaaaaacaacaacaaccacaaaaacccaaaaaacataaattaaagaaatagaaaagaagagctgagcatttcacaaacggagagcaggtgtctggtgtttggtgtgttccggtcgagtgtagtcaggaaaaggaagccgcgttgtctgcggggcgggggcctgtgcttgtggctgcagcagccccttcccatcagataaggacattgttcatgcgcggactggcacccaggacaaaaacaacacccacaaaacctggtagccccacttaatgttcccctgccgcggcggctggaggatggaattaccagaagcaattagacaaaggaggttcagaaccacaggcatggaattaactaactttatttaagatgacatgtggagagactggaaggacaccttcgctctgtctgggaagccgtgaggctgagggggctgtcccccgcccgggtcccgtggggagcccatcttctaccaacccatcccaggttcagcagggtctcttgcttttgttcggagcgcagcaggaggccactgaggtgcccacaaaggggagagatgggaggcagaccatgttctcagtgaccactgtctctgctgtgtgatgaggggttgtcttggggaggaaagaatgcatgtgaccggcaaagctgcagaaactcagcttagaacaggtcacaatcatggtagcaaacactggggtggggaagtcggccctgactgagaggccaggatggatcccaggtacgtctctgaggggaaaggaacagggcccgtcacgagcaggaggtgccgctgaggaaaagcaagtttctgatgtgactcctgacttctcacaatggggcgtggcaccagcaatcagaagggtaaaggctgtgggtcgaatcagaaggtgcatcatacgtatgccgagatcagacgcctgtgacacggccaggaggtgtgcagaacacagcccatgatgagactgccccttgggcacagttagggactgcaggatcatatttaaaatttctggtgcacagatgttgtgtaaagagactgggagagcgggagattgggagaggggaaggagaggaggagggggagaaggagaagagagaaggcctccaggagcctcagagctgatggacgcggagaagctgcgaagcctacacaggggacagccgggagggtaggggcagcaggtgagaggagagagggcgttaagctggacggggtgagctgtgcgggtcaccacaggcgcagagggatgatgagcacagaacactgccttcgggggcttgggtgaccacgaagacgtgtgtcaggctggagaccctaccctgcttagaagctgaatgtcagtctatgactgtctcatgggtaccaataaacatactccccatggccctgtcccactctccacggccctgtcccactccccacggccctgtcatactccccacggccctgtcaaactccccacggccctgtcatactccccacggccctgtcaaactctccactgccctgttgcactccccacagccctgtcgcactccccacggccctgtcccactccccacggccctgtcacactccccacggccctgtcccactccccacggccctgtcccactccccacggccctgtcacactccccacggccctgtcccactccccacggccctgtcacactccccacggccctgtcccactccccacggccctgtcccactccccacggccctgtcccactccccacggccctgtcccactccccacggccctgtcatactccccacggccctgtcccactctccacggccctgtcccactccccacggccctgtcacactccccacggccctgtcacactccccacggccctgtcccactccccacggccctgtcaaactccccaaggccctgtcacactccccacggccctgtcacactccccacggccctgtcccactccctacagccctgtcgcactccccacatcccgtggcatctggctgtacatggaagtgaggaagctgctgtctcccccaaagaacattgctcccagccagggctcagccctgtggggcaggactcagaggctcctggttcagagaccagggcccttgtcacttgcagcgtgaacagcagggaactttgcccccgagtcccacaacagaggtggggaccttgtcacggtgggcccaggtgtgacaacacagggccagcgattcttcacccggcagcaaacactgcagcagacgacaaacattgcagcccttggcaaacaaaaagcacgcagcaaacagcgtggtcagcgaaaagaccctcccctccccggggatcagacagtgcaaggccatccccgggatgacctgcacccacccggctgcctgtgtgaccagccacagaacccactctgcattagcacccacggccaggacaggcagggtgctgcgcccgtggcttcctgcatctgccgacaccacccgaggctgccaggccacaacatgaagtcagctgtgccaggaaatcccaagcctcgcccacacctggccccgggctgttgctgcatgccaaggggttgcccacctggctgtggctgccttaccccatggaatccaggctccaactgacctcaccattctgtgggttaattttcattcttaaaaccttcatctaaagacctttgcttcctggaacacaggcctgggttttcccaacagtcgtgggcacccggcctggcacgtgctgctcagtggagggacctcacagcccgttctatgtgagctgtgcaggaaaagctccacggacaaactcactctccgtgacaatcaggaggtttcttctccaaccacaagaaggagctgggggagctcgtgaggccaggaagagaacagtcctaatcccatccttcccctcctcagcagtgaccccagggtctgctgtcctgccccaacccacacttcaaagaaggaaggacacctgccttcccctgctacctcacaccccgaagcatggggagcatggggacccttggcagagtccttttgtagtgaagaataacagactagtgtaaaatagcagaaaagaagctaatggccaaacacatccaagctggggaaaacacctgttaaatataatgacagaatatgctctcatcaaaacccaggaaactttaagaatacactaaacctcacaaaatgggggcgaaatacaatgatgaccacacgtatgagaaatggtcaatggtagaattgaaagaaatgcaagggaaatgaaagataaggggtcctttccaagcaaagtggcaacgccacaacagctcgcagtcagtcttggcgggacaagaatgctgggcagtgctggtttgcagggaggggtcaacttttctggaagcagcccagcaaagtgccccacgagccatcaattattcctgtgcttcgcagccacagcccacgaatgcaggtgcagccacagaagcgctggcagaggggaggctgagagtggcgctggttgaagatttctcacaggaaacaaaaggcacagcctccacgtggctcatggccatgaaaacccttgactcaaaactttccacgtcgtgaggaagacgcgggtcagctgccctagttgggtgatgatgatgctgtcagggaaagcgtctgtgcctatgtggggagagtaggggagtgagaaacaaagcaaagcgtggtggctctgtggctccagtgccccggaggccacggctcactttttcacaatgaacatgggctattttcattttttaaagtctactaatgtttctaaggagaccatacagaaccgaaaattctgaataaccttgtcttccataaggcagacttttcatttctgtcacctttccggaagggctggacacagagtctgtgggtctgtgatggaggcgccaccatctcaccccgagtccacggccctcagtctctgtgctccccgagccgaaggtgaggaatccatgccttatggttggcgagggctgctggggcacctgccatctcatctgcatcctgggaagcaggaaggagcacagaggaaaacacaagcctgctctggccagctcagtgtgctccttccagaaacaggtaaacacaaaattaccctgcgaagccgccattccattcctaggtctatccccaaaagaaatcaaagcagggactcaaatacttgcacagcccttgccacgacctggatgtagtcagtgcatctgttcccagcaaaactcttgttgaaacgggacccccagtgtggcagcgtagggaggtggggcctgaggggagggagacgtgtgggtcgtgggagtgactccctggggagtccgtggtgctgggagtgattctcctcttgtgatacagggtgagttcccatgggaatggatttgttcccatgagtggggcttgttctgaagccaagacatccctgagctttatctctcttcccgtgtctgcttcccctttgacctcctccagcagaagccagggccatgccattgaacttctcagccagcagaactgtgagcttgatgaattaccccatcacagaggttcttttatggctacacagaatggactcagacacccatgctcacagccgtgcagtcacaatagcccaaaggtggaaacaacccagcaggtgaggggatctgaaatggggtagacaaacacatcggggtcttacggagcctggaaaaggagtgtgctctgacgcctgcagcaacgccaccaaccttcacagcctcgtgccgagtgaagccagccagtcacaataggaccaatgctgtgaccccacagatggaaggcccccagaggagtcagattcaagaggaagatggcagaatggcagtcagcagggccagtgacagaggccgatgggagtgagtgattagtcaggacggagctccagtttcgcgcgatgaaaaggtgctggagctgcatggtggcgacagtggcacagccacgtgcaggttcccaatgccacggaactgtgcacttaccatggggatggtgggaactctcatgtacccgcatttgaccagagaggaaggaaggaagggaggggggagggaggagggagggaggtagcagagaaggaaggaaggaagggaagggggagggaggagggaggaggcagggagggaagaaggaaggaagtgagggagggaggaagggagagagggatggagggagggaagaaggaaggaaggacggaccagcctgttaggctgactgacagagtaccccctgtcctccaatgctgcccacggcaggcatgtggcagtggctgacagggagtgagtctggaagcgacccttgtcggggcagcctccttggtcctgtgattcaagacagggtgaaagtcagtggcggccattggtgcctctggccggggttcctcacaggggcccgcaaggggacagcgaatggagcgtggagggtggagggctccttctccagaccggagcgatgggttcgggagccattctgtgcctgtctttgctgctgggctgaggagctggatggcatgctgggagtagtgggagctgctgaggagtttggtcctggagcgaagaggctgaatccgcatgtctggagtcaccgtggagggcacagctagagggagcagcagggtgtcccagggagaagacaccagggctggaattagagggacatcaaggctgatacttagaggcatccaatatatggggcctgcctgatgggctgctctcaggtgggatttggggggtgtgagaggggtcagtgcccaaatgaccatggggtccgtggcctgtatgcccagtcaggtgacgacgccattcagaaagtagatctcatggggtgcccggctgctgagtctcaggccagatctgcagtgagtgtgctgccccaggcgtggaacactctggtgccatcgggacccaaggctgagtgcacccaagagctgtgggtctgaaacagcggtcagaggtcactgacatgtggaggaggcccctggagtgtgggagacagaatccccaggtgtcaggcttggcaggaggctttgcaggtggggaggaagggcaggtagcgtggctgccggaggagggagggcactggtaggaggagggtggcctgtcccgggcagaccagcctctttgggctgtgtggccccagctccctgagcccagagggaggtgagggtgagaaggcctggaccaggcaggacgcagcccccagggcccctgctgggaagaggtcagaacctcccaaggacccagaaggccaggtaactgagaacggggctgctctctgaatctccagggaggacaaaggcggccatggcagcaaggggacagggcagagggaaaggccggcaggtggatgttggaagccgcagattcccatccagtatcctagaggaggagacccagggctgtgtcctaggaggcccaggaagcctggtcagcctggaggctgagggcgggcccgggagatctggtaaggacatcagtgtctccacgaagagcagcagggtctcagcccatggcagccgcaggccccatgactggggccgcagcctccagagccgccacagcagcccgttgttctggggggtcaaaggtggaggctgtcagaggggcagtgcagggggctgctggggtgaagccccctgtagcagcagcacccagcctgctgtggctctgccctcctggaccccctgccctcctggaccccctgtcctcctggaccctctgccctcctagaccccctgccctccaggaccccctgccctcctggaccccctgtctgtggcccctgctcctctcctccttccccgacacatgactggaccccccgatctgcagccggggtctgggcactgggggtcctgtggacctctcggtgtctggggacaatcacaggttcccgtgcccacacccagcctctgcttccagaacacactagagggtcccggcatcctgatgagtccactgtccccgcgatggttttcagggatggagaaggctccctgtcctccgctggaaccctgcagccgggctgacggtacccccaccacccacccaggggccccagaccctccccatctccaccgccaacccaggccccggctgcgcacgcggggccaggccgtgagctgctgtccccggatggggccgccccgggctggcctggctcactccgtgtcacagatattcccacagagaccccagcgagacctgcagaacattacagcagaatgaaggagagccagaggaagaggcagatgtgctggcctgtaaacagtctgatttccaatgtaaaccagattcaggcccacgacatcaggtaaacatctgcatcagagcccccggccccccaccgcccgggaggccccggggtccacacggccgactctgggacccgtcacagtgaccgccgagacatttcgtaattaggcaaaattgatccttgcattccttccctaaatcccaaatctctgcaattttacttcttctcaaaaatgaaaacatttggcaattagctgatccaagtgaaaaaggtagagaatgtgctctcaactggaaaatgccaattaaggaagcagctctgacttcccacccgccctggctaagctgggagcttatcttccccgagaagaatctgctgggataagggggcttgggaaacaccgagggcagggctgcctcctcagcttcctctgagagcagattagccgtggccttgtgccagcagggcctgggtgccacacagggtggcaggggtggcagagccgggcccggctctggtactgggatttggggtggcgggacccagtggggcacccgcttgtgggcggcactgagggcggtgacgtaggcagcgggtgccggtgtctgcccctccatctggccgggctccccaccctgctcctgcagccctggacctcagggcccatttgcggtgcaaggcggctcttggccattttgcccgcagggccctaccttgggtcttgggagcttctgtcccttgccctctcttgtccaggtcagcatctcccactgtgggaatcctatgtggccccatcgtctggacagtgtgggtcaggtcactgtggctgttttgtgatgcgtgtgtgggctcatccctcagtgctcagaagctgcagacactatggaaccgcttttcaggccccgtggccgtcacccccgctctagagacttgattgcagggaccatgcccggccggcctaactgcacccctcactccaggtgggtggggggacccaggcctgctggcccctgtggtggtgcagcccagaaggtgtgaatcagtttacactgttcagtgcctgaataaaagtcacaggacaaagaggacttggttgcacaaactactgacatgaaattcacattttgtcctgaaggaaacgcaagatgaattgaactcatgttcagtttttatttctcatttctcccgcctcagtctcttctcacgtgcacgacctcacagcgctgtcacaaggcctgctgggcacacgcagctcatagagaagtgatggcttcctccttgccccctcacctccctccttcccctctccccctcacttcggagcacgcaggctgattgtggagacatctcccagccaggatgtgtcaacagggaatgtgctggggacagcgggagttcacagccacccccgcaggcgccttcctggagcacgtccacaggccatgtgcagctgcatcccccacgacggcagggacaagttccttccatagggcccgggtggcccccagagctgcaccatttatgatccggtcctttgcagaacgcaagggacagacacatgaaccctgacctaggttcttgtgcagaaatgttctctcatcggaatagaaaggtatgagtctcaggactggttctctgcaaagcagccatcggcctttcaagcagaaaccatggagcccccagaggctgagtcttccaaggcgctgggagacttggcgtttgcctcttttttaaatgcaatgaccgttgcagtgcatggaatcagagacatgtatctatgcgtagaaatgagtctgtaaacacgatcaaggtgtgatttctgtatgacaatgcagttggatcagaaattggagagtgctggccgggcgcggcggctcacgcctgtaatcccagcactttgggaggccgaggcggatggatcacttgaggtcaggagttcgagaccagcctgggcaacatggtgaaaccccatctctactgaaaacacagaaattagccgggtgtggtggcgtgtgcctgtagtcccagctactcgggaggctgacgtgggaggatcacttgagcccaggaggcagaggctgcagtgagtagagatagcaccactgaactccagcctgggcaacagactgagactccatctcaaaaaaataaataaataaataaataaataagaaagaaaagaagaaatagtggagtgctgtggtcactctggaaaaagaggagggaccccacccaaatgtggttcctccgtcaaccctgaagacgcccccacacaccgggacgagatgaaagggtctggtacttacctagctgggctttcacggggtgcacggtggcttcaggaagggagctggcgtggggctcttcttatgcctcgggggtggggtgatggcctcacatgggcaggagcctgcagggcttgagcctctcactggcaccaaagacacctgccctgctgtggggcacacgggaagagggatgggtgaggtgtcaaagcagtgagccgtcaaacatcataaaaacggagtcaggctctttattgcaggaaacaatttgcggctttctgtgcagagagcaggggggatttgaggtgggctttgtagagtgagggagttcaccagattgacagtgtgggctgggtcaccctgtgcaaagcagcgatttccatgttgcccctgagagaatgttttcctgtgatctccagcatcgagatttaaaaattatcatgttcatagtctgatgataaaacattaatttttaggaaggcagaggacctgcctgcttttcctgataagacctcgttccattgccctaggtcaggcatggattattaactctcagggttttgggggaccagcagccacagatgtggagtcctggggaaagggtgacagcctcctctgcctccggggatttgtccttcagtgacttgacgcccgcaagagtggatgctaattctcaccgtccccatgaaatccctgctgacgcatgctgcccaggagacatctccacaatcagcctgcctgctggagagaggaaggagggaagcgagggtgcaaggaggaagccagcccttctctgtgagctgcatgtgcccagcatgcctcatgacagccctgtgaggtgagaggagactaaggcgggagaaatgagaagcttgcccgagtcacgcaaccgaagcacagagccagggtctggcgccctgagaggtcctgggtgcattggatgctgtgcacgtacttcagcaaagaggcaggatgttgtcatcttccttcggagccagtaacattttctgctgccagcaaggaaagaacattggatcacgcgcctccatgcaggcagggtccttcagtggcgctgatcctgagcccagccctctcgtggtctgtgctgacgccagggcctctcgttggaaggcctcgtgctccacagttcccccacaaaggggaggatgctgaactctttacctgtaattctggcctcgaagcagctgttttctgcctggcttctcaccccagccatgcacagtggaggtgtcagcaaatccctggagagaaagcccggtggacacagggttcctttctctgaggctccctttccctgggatcacagtagctgagtcggggtctccagagaaacagaactgggggtaggggggtgcataaagtgagaaggagatttattataaggcggggactcatggggtaatggaggctgcaagtccagcatctgcagtgtgggcagtgtgggtagtgtgggcagtgtgggtagtgtgggcagtgtgggtagtgtgggcagtgtgggtagtgtgggtaatgtggatagtgtgggtagtgtgggcagtgtgggtagtgtgggcagtgtgggtagtgtggatagtgtggatagtgtgggtagtgtgggtagtgtgggtagtgtggatagtgtgggtagtgtgggtagtgtggatagtgtgggtagtgtgggcagtgtgggtagtgtggatagtgtgggcagtgtgggtagtgtgggtggtgtgggcagtgtggatggtgtgggtagtgtgggtaacatgggcagtgtgggtagtgtgggtagtgtggatagtgtgggtagtgtgggtagtgtggatagtgtgggtggtgtgggtactgtgggtagcgtggatagtgtgggcagtgtgggtaacgtgggcagtgcgggcagtgtgggtagtgtggatagtgtgggtagtgtggatagtgtgggcagtgtgggtaatgtgggcagtgtgggtagtgtgggtagtgtggatagagtgggtggtgtgggtagtgtggatagtgtaggtagtgtgggtagtgtgggcagtgtgggcagtgcaggcagtgtgggttggccagctgcagacccagcagagtccgtggagcggatgaagtcccaaggccgtccgctggagaatctctcttgctcaggaaggctggctttctgctgtattcaagactttaactgatcggaagaggccacccacattacagaaggcaacatgcttcacccaaagttcatccatttaaaagttaacctcaggctgggcgcagtggctcatgcctgtaatcccaacactttgggaggccgaggcaggcgggtcacctgaggtcaggagtttgagaccagcctggccaacatggggaaatcccgtctctactaaaaatacaaaaaattagccgggcatggtggcacacacctgtgataccagctactcgggaggctgaggcaggagaatcggttgaacccagaaggtagaggtggaggctgcagtgagccgagatcacaccactgcactccagcctggggaacagagccagactccgtctcaaaaaaaataaataaatgaagttaatgtcctctaaatacactttccaaattgacacataaaattaatcatcataagagagctgacattcattttttaatattcaaaataggatcttgcaacaagacagtcagctggaaagctaggcttgtcgagagaggcagacagagagaaagagagaaacagagagaaagacagagaggacttgctaagttccttcatcctatccagaagcaaacccgggagacttcgcccatagctgctgtgagcgttcgtgggcaaatgctttcatttctcttgctaaatacctaggtgtagaattggtcatatggaaagcgtggacctcaccgtttaagaacccaccaaactgtttttcaaagcggttgcgtcgtttaaaatcccctcctcatactgtatattttgttctgctgacccgtttgtctctcttgacaccaatccccttctgtctccatgactgtagcctcacggcgagtcttgaaatcacagatctttggtcctccaactgttttctctttttcaagattcttttggttattctaggtcctctgcatgtccttatattttttataatcaacatgggaatttctcttaagagaaaagaagcgcttctgggattctgattgcaatggtactgaattcattaacccatttgggaagacgtggcatcccgtcaatatcaagagtttgacccgtgaacgtggtgcgcacctccatttatttcattcaccttgactttctcccagccgtgctcttagcatatctcgtacatcttttgtgagatttattcgtaaggattcatgttctctctgtaattttaaatggcatttgagttcaatttctgctgtaatacagaaatgcaattgatttttagtggcctcatgaagataaaactcatatcacacacttcacccacttcaagtacacaattcggtggtttttcatatattcgcagagttgtccagccgtcaccatgctctaaccaccatcacaatgtaattctagaacatttttatcacctcaaagaagccatacccatcagcagtcactccctactcctcccgctgagcttctccgctggccttggccaccactgatctctcctccctctctgcggctttgcctctgctgaatacaaatcgggttctgctatgttcatccttctgtgtctggcctctttcacttagcgcaaggtttcaaggttcatgcacgtcatggtgaccagaacttcatttctttttatagctgagaaataccccattgtgtggctagtctgcgttttgtgaaaccatttattggtgctgggacacatgggctgctccctccatgtggctattagaacaatgccatggtggacatttgtgcacatgtttttgtgtggacacgttttcatttttcttgggtggagtagaattgctaaatcataggatacatctatgtttaacattttgaggaactgccaaactgttctccaaggcgattaaatcatgttgtgttcccgccaacaacataggagtgttcgaacttatccacgtcctcactaacacggattatcggcctcactgacgctgttccagagacagtgtggaatgatgcctcactgtgagtgtgttttgtgcttccctaatgagtagtgacatgccacaccttttcctgtgctatttgccatttgtatctcttctttggagacatgtctatcattttttaaatggggttaattatccctttattactgactactgattttgtatactgatcttatagcctactattttgcttaagtcactcattagttctagtagctttctagaagattctgttagattttctacagggatggccatgaccctgtcttacttcttcctctgcaatctatgttttgttttgttttgttttcctttccgtgcctcattgcaccaactagaatagagacgctttgagtaggcactgctgctggttccttctcttgggggaaagcgggcaatcttctgctaggaagcaagatgcctgctgcatctgcttcggagacgcccctttatcagactgggaacattcccttgtgctctcatttggcttgagtttttattataaatgcataacggatatcagatttttttctgtgtctatggagatgatcatatggcttttcttttttagcttgtgaatgtggtgaaatgcactgatctttcaaatattcagttgatcttgcgttactgggataaactccacgttgtcatcatgtattattattgtacatattactgtatccagtttgctaaatgtttgcctctatgttcatgaggggtattggcctgtagttctcttgtgatatctttgtttggttttggtatcaggataagcctcgtagaatgtgttaggaaatgttctctggtcttcggtttcctggaaaaagttgtacagagtcaggattctctatttgttgactgctgggtgaaatttaccagtgaaacaatttgacctgtcatttcctttgtcggaaggtttttgaactacaagtttaattttcttaacaaatacagggctctttggtttatctatttttttagtgactttaataattcgtgtctttcaaaaaaatgtatccatcacatctgagttgtcagatttattgacctgaatgttctgaatagtccctttcatccttttacatatttatagaatctccttctttcccaatcttgctaatttgtgcagtctctctctttagtgattagacaggggaaagattaatcaattttatggattttctgaaatcatgtgtgcagagcagccacgggatagcacggcctctgcacgctgtggggtgttcatcagctggacaggcagctgccacctggacagagtgaaacccaccgcctgagttctggagtaattgtcccaaggaggacctttccactctgggttgtcctggaaagaggctgctcctcgtctaggaagtgaggtcctgggcaaagacctcagtgggagggaggagacatgatcttcctgagtctcagccccaaggcaccagcctggatccctcggtgtgctgcccagagctcgtcaggcactgatgaggattgagaggagggcaggggggagcacccacgtacgacaggacacacacacacacacacacattcccctcctgagacatttgcatccagggaacatgcaggcaattccttgtttgtgcaactaaaactccagagtcccccaaagtgaaaacagcaggcggctccgaagtgaactgcaactaccacctcttccgagacagaaaacgctcagtactgggaggacagggtttccagatttttcttccccaagtaggttccaaaaataccaaggcactgagtttcagccagggcacgcctcgcacctggcctggtcccggggatcaggatgcactctccgcacggagccctcttcttggtggcctctgcggcctctgcaacggagcttgtcctgggacaacaaaggtcttaatctggcagctcctcaaatgaccagccctgggaagggaacatggtcatgaaaataataagaaagaaaaaggactacagcaaaacagaaaacctgatttaagacagcaggacttttgaatcctgatacaacaggttatcagaagaacgaataaattaaacttaccaattaaaagacacaagagtatggatggagttaaacgatgttacccgcgagagacacagaatagttgacaataacaggaagggaaaatgcaagccaattgtatgtggactgaaagaaggctacaaaaggattaaaacattaagccacaatgcagctttctgacagtcaaatgatcaacatacagaaatatattttccaaccacagggcaaaaaaaaaattagaaattaagtcacaaaagggatagtgcaaatattgtatgtttggaaaccaaatagtctattaccataaatttggggttaaagagataatcataattattaaaaagtaataaaaacattgcacattagaaggacggggcagagtgaagcagctgttactgagaggtgtacggtactaaatacatttctcacaaattatgaaattggatgtctacgcagatgttttgcctgtttctaacggagctgtttttgtcattaattttttagttccttttccattctgggttcaatctttcatcagtgatatggtttgcaaatacatcctccagatctgcgacttatcttccgatttcttgttagtgtcttttgaagcacacatttgaaaaaaattcgatgaagttcaccctatcaatgttttattttacgatcttatttttgatgtcatggctaaggaattgcacctggcccacagcttccttgactttctcccatgttttctacaagttttagttcccggttttcatgtaaccctctttgtgttaattcttgtggaggacatgagatagggttccaaacttctttctcatgtggctatccagatgtcccagcactatttgtggaaaagactgtctgtcccccgactgagttctgtttgttgcctttgtcaaaaatcaattgacaatctacataaaacgttttttttttttcctggacttttgatcctgtttcattgatctgtgtggctacagtgaaaccaatacgagactgtctttgttactaaattttgttcttttaaaaaattgttttatccataccgggtcctttaagttatttttgtcatgaagtttttagctcttttttctattctggatacaatcttttatcagttatatgatttgtcaatattttatcctaatcggtggctttcctttcattttcatttgtaaatattaggatcaatttgtcaaattttgcacaaatgcctgctggattttgacagggattatattggatttacaaattgccatgttaacgtgattgtgcctctggcccatgaacacgggcggcctccccagttgctcatgttttctttaattcctctcagcaggatttgggggttttagcatttaactcttatacttctttggttacgtatatgcttctgtattttattctattattatttaaaattttcttaatttcattttcagattgtctattactaatgtatagaaattcagtggatttttgtgtattgatactacactctgcacctttgctggattttttattagttctaacaggagtgtttgtgtttattctgcttagggctctccaaaattctcaaatatgtgattttttttgtctttgactagctttgggagactctcagccaccatctctccaagtagcttttcttccacgatttcttctttcctcttaggatcataagtggacattcactagagtgtgttgaagtgttttaaaggtcttggatgcttgatttagttctctctctttgtcttttttctctttgtgttcattttggatgacttctactcacctgtctcccagtttatggattctttccttagttctttccagtgtgttaattagcctatgataagaatgttgatattgttggtgggggggcggtggtggagaggctatttccatttgacttttgttttttttgagacagggccacgctctgttgcccaggcaggagtgcagtggttcgatcacagctcactgcagcctctaactcctgggctcaagagatcctcctgcctcagcctccaaagtagctgggactataatcccagcactttgggaggccaaggtgggtggatcacctgaggtcaggagttcaagaccagcctgaccaacatggtgaaaccccgtctctactaaaaatacaaaacatagttgggcatggtggcacacgcctgtaatcccagtactggggagtctgaggcaggagaatcactcgaacatgggaggcagaggttgcagtgagccaagatcacaccactgcactccagcctgggcaacagtgtgggactccatctcaaaaataaataaataaaaacagtgttctagtttttttcagttttcatttatctgttgaaattcctcacctgttaatgcatattgactaaacatacccatcacagttatttttatttatttatttgtttttttgagatggagtctagctctgtcacccaggctggagtacagtgatgtaatctcagctcactgcaagctctgcctcccgggttcgagcgattctcctgcctcagcctcccgagtaactgggaccacaggcacctgccaccatgcccagctaatttttgtatttttagtagagatggggtttcaccttgttggccaggctggtctcgaactcctgacctcatgatccgctcacctcggcctcccagagtgctgggattgcaggagtgagtcaccgcacctggcctgtgagttattttaaagtccctgtgcaacagtgtcaacattggagtcatctcaaagttggattctattaattgttttatcacatggccatggttcattttaccttccttccttgctatctcataaattttaattgaatttcagacactgtgtccagagaataatagagacggaggcaggtagcctttatgccccagatggctttggatccccttcttctgggtatgaatgtgggatctgtgccagcctgggccatgggtgggccgggtcagggtgaggtgtggccgccattacctcagggcgtcagagactgcgaggcctcctaggcaagctcacccttacctggtgctgaagcctggggctggggaccagggaggattttcttttttctttttttgagacagagttttgttctgtcgcccaggatggagtgcagtggcgtgatctcagctcactgcaagctccacctcccgggttcatgccatcctcctgtctcagcctcccaagtaggtgggactacaggcgtgtatcaccacgctgggctaatttttttgtatttttattagagatggggttttgccacgttggccaggctggtttcgaactcctgacctcgtgatctgcccgccttggcctcccaaagtgctgggattacaggtgtgagccaccacgcccggccccagggagggtttcctcagtgcccctacagctccattgcagcaggcccttcatgcctgaaccacagaggtggttttctccatgttcttgccccttcgttcattttacgcaacagatatctattgagcaactgccatgtgccagacactgagctcaagtatggtttattctagcgaggcaggaagagcagtgggtctatttatgtgattctggaaattcacaaaggatgaaacctatgactactcaagtattagctgcaaaagctggtaaagttcaacaaagttcgaaagcttgctatggttcagcattcgtttatgttagaaaaaaagaaaaacttgaaaagctattaatatctaacttctgaagaatatccctcgggaagtgatattaaaagtcacatagaaacattaggagaagcagctactacctgtcttattaaacattgttttgaatgatagcattgggacacactaaaaactaaatacagttcaaaatatttaaaaggaagaaatgaaacaactagaacaaaagctgagtaaagatacaacattataaatcaacggattttctagacactatgtagagaaaataccacatgacaacatttcccatttataattttaaaattatagaattctatgggcagccgggcacagtggctcacacctgtaatcccagtactttgggaggctgaggaggccaggtcacttgaggtcaagagttcgaaaccaccctggccaacatggcgaaacccagtctctactaaaaatacaaaaacttagctcggcatggtggctcatgcctataatcccaactgcttgggaggctgaggcaggggaatcacttgaacccaggaggcggaggttgcaatgtgccaagattacaccattgcactccagcctgggcaatgagagtgaaaccccatctcaaaaaaaaaaaaaaaaaaagcctcctacccataagatgtaaataaatggagagatataacaggcttcttgattgagaacacttacaacttcaggtctctaaaaatcaacctatggatttaattatattccaattaaaataaataattacttttatcttgccaagttttctctaaaattctcatcaaaatgtataggcaagtgtagccattaaattttggggggatgtctttataatttttttaaatttttatagccattaaaaatttaaaagcaaaatataaaggaagaagaatgagtggtgatttcccagacagctatcagaacagactataaagctacagttattaaaacagcactgccttgcttctggattacataaattgaaggaggaagtggagccgggccctggcagccttctcagtgtaactcaggaccccgtggacggggtgtctgagccagcaggaagagacagggcctgctgcagaggacgtaacaacagaaccacgcacctgcagcaaggcagtcccatctccgtctcagctgagacacagagcaaccacccagctaggcagtcccatctcagctggagcacatccacgaggaatccaaatgcacacaaaaaaataaaagtacaaaattcctggaaggacatgtggggaatgtattcccgatattgggggggccttaaagcatggcgcgaaacacaagcattgttaacggagtgtctgggagatttcactgtttcaaaaggaaacacttctttattgaaaatcacagtaaaaaaatgacatagtacagattcagagaaaatgtttcttacaaatataacaataaaaattaatatctctgatatccaaattgattatacaaatcaatagcagctcagtagaaaaatggactaaacgtatgaatattaattctcacactttttatggaataatgtttagaaaaagaaaaactttaaaattcacagaggggctaagttttagggaatagttttgagtgtcatctatatagtttttctcaataaatatattaatgtagtaaattacattgagtgcttttatattttaatttagtttttcctaaattgatctagatagattttttatcaaaaataccaggaatacatattaatcaacacaccaaaatatcaaaaatattttttattagataaattgattctaaaatgtgtacaaaggggcaaaggaactagaatagctaaatgataaaagaagaagaaaggaagaatcgtgcccctcaatgttaagagttactcaaaagctcccgtaatcaagagtgtcaccgtgggtgtgggcacagcagctcatgcatgtaatcctagcactttgggagcctgaggaaggaggatctcttgaggctagagttctagacctgcctgggctacatagtgagacctcatctctaaaattaaaaaaaaaaaaattaattaaaattaaaaaaatagaaaattgaaaaagagagtgtcaccccagggaagagagagagtggaggtaaaggggcgtgcagacccccaggatcacggccacctggcctcccacaagggaccaagagccgtcaatgccagaagagccgctttcccaacaagccatgctagagcagactcatgggttcaaaaatggccgtagacctacacgttcatatgaaaattaactcaaactggggctgggcacagtggctcatgcctgtaatcccagcactttgggaggccgaggctggcagatcacttgagatcgggagttcgaaaccagcctggccaacatggtgaaaccctgtctctatgaaaaatacaaaaattagctgggcgtggtggcaggcacctgtaatcccagctacttgggaggctgaggcaggagaatcgcttgaacccaggaggcagaggttgcagtgagccaagatcatgccactgcactccagtctgggcaacagagagagactcgtctcgaaataaataaatacattaataaacaaaaattatccaggcgtggtggcaggcacctgtaatcccagctacttgggaggctgagacatgagaatcatttaaacctgggggttggaggtcgcagtgagccaagatcacgccactgaactccagcctgggagacagagtaagactccgtccccccccaaaaaaaaaaaaaaagtaaaaataaaggaaattaactcaaattggatcaaaaacaataacacttttagaatagaagaaagtgtccaggacctggggcttggcaaggacttcctagatataacatcaaaagcatgattcatatatattttaaatcaatgaattagatctcattgaaattaaaaacttttatgccgtgaaagatcctgttaggatggatgaaaagataagctgtgggctgggagaaaatgtttgcaaaacccatgtctgacaaaggactcgtatctagaatataagaagaactctcaaaactcaacggaacagggccaaataatccaatgaaagaaggatcatggagacaaggtggagatggcagatgaagtcacaaaacggccttcaacccgcgtggccccagggaaacacaggctgggaccatgacccaatatttctccgtacctattagaacagctaacgcaaaatataataacaagaccaaatgctggcagagattcggagaaacggtatgacattcactgcgtgtggaatgtaacatggcgcacccaccatggaaaagagtttgacagtttcttaaaaaagcgaaacagactctgaccatttgacccagcagtcacactcctgggcatttgtcccagagaaagaaagatttatgttcacacaaacacctatacgtgattgctcatggcagcgctatttgtaatagtcaaaagcttcagtaggtgaatggtaaacaaagaggtcctttcctaccaggggaggctacttatcagtaaaaaggaactaactgttgacacaggaagcagcttagatggtctcaagggcatgttcctgagtgaagagctcatctgaaagggtcccacgcattccatttacatcacatttgcaaaatgacaaatttatagccataggaaaaggccagagggtgtgaggaggaaggaacggggacatgggcagtgagtctctgggatgaggcagccccggagatggccgtggcagtgggacagctctgtgtcctgttcctggtggtgtgtacacaaattcccacatcctacaacatggcaaaaacccagatacacacactgtagcacggtcagcttcctggcttagacacgcactccagctaagggagacgaagccgttgggaaaactggttgaggggcatgtggaaatctctgtactagttttgagacttcctgtgaatctgtaatgatttcaaaataaaatctttaaaagaaatcacgagcttgataaagagaatatacattgtatgctgccttttgaataaaaaaaaaattagacatgcaggtattccgttattgttgcaaacagaaaccacgggaagaaggagacagaactcatggactcggtgagtggagaacagaaagtttgagcgtctgaggttacttaacgatttcacatttaaaaattatttaaattaagtaaaaaaggatacagaacacataaatggaacacaagaaaacaaacaaatgggcattttcaacgcataaatgtttaggagtggagaccgaccaagagccgccttgcaccgcaaatgggccctgaggtccagggctgcaggagcagggtggggagcccggccagatggaggggcagacaccggcacccgctgcctacgtcaccgccctcagtgctgcccacaagcgggtgccccactgggtcccgccaccccaaatcccagtgccggagcggggcccggctctgccacccgctgccacccggtgtggcacccaggccctgctggcacaaggccacggctaatctgctctcagaggaagctgaggaggtgaggaggcagccctgccctcggtgtttcccaagcccccttatcccagcagattcttctcggggaagataagctcccagcttagccagggcgggtgggaagtcagagctgcttccttaattggcattttccagttgagagcacattctctacctttttcacttggatcagctaattgccaaatgttttcatttttgagaagaagtaaaattgcagagatttgggatttagggaaggaatgcaaggatcaattttgcctaattacgaaatgtctcggcggtcactgtgacgggtcccagagtcggccgtgtggaccccggggcctcccgggcggtggggggccgggggctctgatgcagatgtttacctgatgtcgtgggcctgaatctggtttacattggaaatcagactgtttacaggccagcacatctgcctcttcctctggctctccttcattctgctgtaatgttctgcaggtctcgctggggtctctgtgggaatatctgtgacacggagtgagccaggccagcccggggcggccccatccggggacagcagctcacggcctggccccgcgtgcgcagccggggcctgggttggcggtggagatggggagggtctgggggcccctgggtgggtggtgggggtaccgtcagcccggctgcagggttccagcggaggacagggagccttctccatccctgaaaaccatcgcggggacagtggactcatcaggatgccgggaccctctagtgtgttctggaagcagaggctgggtgtgggcacgggaacctgtgattgtccccagacaccgagaggcccacaggacccccagtgcccagaccccggctgcagatcggggggtccagtcatgtgtcggggaaggaggaggggagcaggggccacagacagggggtccaggagggcagggggtccaggagggcagaggacccaggacagcaaagggtccgggagggcagaggatccaggaggacagggggtccaggagggcagggggtccaggagggcccaggagggcagggggtccaggaggacagggggtcctggagggcagggggtccaggagggcagggggtccaggagggcagagggtccaggagggcagagggtccaggagggcccaggagggcagggggtccaggaggacagggggtcctggagggcagggggtccaggagggcagggggtccaggagggcagagggtccaggagggcccaggagggcagggggtccaggaggacagggggtcctggagggcagggggtcccggagggcagagggtcctggagggcagggggtcccggagggcagagggtcctggagggcagggggtccaggagggcagggggtccaggagggcagagggtcctggagggcagggggtccaggagggcagggggtccaggagggcccaggagggaagggggtccaggaggacagggggtccaggagggcagagccacagcaggctgggtgctgctgctacagggggcttcaccccagcagccccctgcactgcccctctgacagcctccacctttgaccccccagaacaatgggctgctgtggcggctctggaggctgcggccccagtcatggggcctgcggctgccatgggctgagaccctgctgctcttcgtggagacactgatgtccttaccagatctcccgggcccgccctcagcctccaggctgaccaggcttcctgggcctcctaggacacagccctgggtctcctcctctaggatactggatgggaatctgcggcttccaacatccacctgcccgccttcccctctgccctgtccccttgctgccatggccgcctttgtcctccctggagattcagagagcagccccgttctcagttacctggccttctgggtccttgggaggttctgacctcttcccagcaggggccctgggggctgcgtcctgcctggtccaggccttctcaccctcacctccctctgggctcagggagctggggccacacagcccagagaggctggtctgcccaggacaggccaccctcctcctgctcccaggagtgcctgcagccctgtcagtttccaagagtgtctccttcaagcagcctcgtcaggtcgagccacccccagtgccctctctcctctggcagccgcgctccctgcccttcctccccacctgctcagtcctgcaaagcctcctgcctagctggacacctgggggttctgtatcccacactccaggggcctccttcacatgtcggtgacctctgacactccaggggcctccttcacatgtcggtgacctctgaccgctgtttcagacccacagctcctgggtgcactcagccttgggtcccgatggcaccagagtgttccacgcctggggcagcgcactcattgcagatctggcctgagactcagcagccgggcaccccatgagatctactttctgaatggcgtcgtcacctgactgggcatacaggccacggaccccatggtcatttgggcactgacccctctcacaccccccaaatcccacctgagagcagcccatcaggcaggccccatatattggatgcctctaagtatcagccttgatgtccctctaattccagccctggtgtcttctccctgggacaccctgctgctccctctagctgtgccctccacggtgactccagacatgcggattcagcctcttcgctccaggaccaaactcctcagcagctcccactactcccagcatgccatccagctcctcagcccagcagcaaagacaggcacagaatggctcccgaacccatcgctccggtccggagaaggagccctccaccctccacgctccattcgctgtccccttgcgggcccctgtgaggaaccccagccagaggcaccaatggccgccactgactttcaccctgtcctgaatcacaggaccaaggaggctgccccgacaagggtcgcttccagactcactccctgtcagccactgccacatgcctgccgtgggcagcattggaggacagggggtactctgtcagtcagcctaacaggctggtccgtccttccttccttccttccttcttccctccctcacttccttccttcttccctccctgcctccctcccttccttctctgctccctccctccctcctccctccccctccttccctgcctccctcctccctccttctctgcctccttcctcccccttcccttccttccttccttctctgctccccccctccctctttccctccctccctctttccctcccttcctcctccctcctcctccctccctcccttccttccttctttctttccttccttccttcctgcttctctcccttcctccctccctcacttccttccttccttcttccctccctgcctccctcccttccttctctgctccctccctccccccttccctgcctccctcttccctccttctttgcctcctccctcccccttcccttccttccttccttctctgctacctccctccctcctccctcccccctcccttccttccttcctctctggtcaaatgcgggtacatgagagttcccaccatccccatggtaagtgcacagttccgtggcattgggaacctgcacgtggctgtgccactgtcgccaccatgcagctccagcaccttttcatcgcgcgaaactggagctccgtcctgactaatcactcactcccatcggcctctgtcactggccctgctgactaccattctgccatcttcctcttgaatctgactcctctgggggccttccatctgtggggtcacagcattggtcctattgtgactggctggcttcactcggcacgaggctgtgaaggttggtggcgttgctgcaggcgtcagagcacactccttttccaggctccgtaagaccccgatgtgtttgtctaccccatttcagatcccctcacctgctgggttgtttccacctttgggctattgtgactgcacggctgtgagcatgggtgtctgagtccattctgtgtagccataaaagaacctctgtgatggggtaattcatcaagctcacagttctgctggctgagaagttcaatggcatggccctggcttctgctggaggaggtcaaaggggaagcagacacgggaagagagataaagctcagggatgtcttggcttcagaacaagccccactcatgggaacaaatccattcccatgggaactcaccctgtatcacaagaggagaatcactcccagcaccacggactccccagggagtcactcccacgacccacacgtctccctcccctcaggccccacctccctacgctgccacactgggggtcccgtttcaacaagagttttgctgggaacagatgcactgactacatccaggtcgtggtaagggctgtgcaagtatttgagtccctgctttgatttcttttggggatagacctaggaatggaatggcggcttcgcagggtaattttgtgtttacctgtttctggaaggagcacactgagctggccagagcaggcttgtgttttcctctgtgctccttcctgcttcccaggatgcagatgagatggcaggtgccccagcagccctcgccaaccataaggcatggattcctcaccttcggctcggggagcacagagactgagggccgtggactcggggtgagatggtggcacctccatcacagacccacagtctctgtgtccagcccttccggaaagatgacagaaatgaaaagtctgccttatggaagacaaggttattcagaattttcggttctgtatggtctccttagaaacattagcagactttaaaaaatgaaaatagcccatgttcattgtgaaaaagtgagccatggcctccggggcaccggagccacagagccaccacgctttgcttttgtttctcactcccctactctccccacataggcaccgacgctttccctgacagcatcatcatcacccaactagggcagctgacccgcgtcttcctcacgacgtggaatggtttgagtcaagggttttcatggccatgagccacgtggaggctgtgccttttgtttcctgtgagaaatcttcaaccagcgccactctcagcctcccctctgccagcgcttctgtggctgcacctgcattcgtgggctgtggctgcgaagcacaggaataattgatggctctggggcactttgctgggctgcttccagaaaagttgacccctccctgcaaaccagcactgcccagcattcttgtcccgccaagcctgactgtgagctgttgtgacgttgccactttgctcggaaaggaccccttaccttttatttcccttgcatttctttcaattctaccattgaccatttctcatacgtgtggtcatcattgtatttcgcccccattttgtgaggtttagtgtattcttaaagtttcctgggttttgatgagagcatattctgtcattatatttaacaggtgttttccccagcttggatgtgtttggccattagcttcttttctgctattttacactagtctgttattcttcactacaaaaggactctgccgagggtccccatgctccccatgcttcggggtgtgaggtagcaggggaaggcaggtgtccttccttctttgaagtgcgggttggggcaggacagcagaccctggggtcactgctgaggaggggaaggatgggattaggactgttctcttcctggcctcatgagctcccccagctccttctggtggttggagaagaaacctcctgattgtcacggagagtgagtttgtccgtggagcttttcctgcacggctcacatagaacgggctgtgaggtccctccactgagcagcacgtgccaggccgggtgcccacgactgttgggaaaacccaggcctgtattccaggaagcaaaggtctttagatgaaggttttaagaatgaaaattaacccacagaatggtgaggtcagttggagcctggattccatggggtaagacagccacagccaggtgggcatcctgctccttccctttcccctgtccctgcccaccggccatgccctagagtaggggcacactcggaccccagcccagcgcccacccatgctgcctgcaggcctgcgaggtcccacaaccccttggcatgcagcgacagcccggggccaggtgtgggtgaggcttgggatttcctggcacagctgacttcatgttgtggcctggcagcctcgggtggtgtcggcagatgcaggaagccacgggcgcagctccctgcctgtcccggccgtgggtgctaatgcagagtgggttctgtggctggtcacacaggcagccgggtgggtgcaggtcatcccggggatggccttgcactgtctgatccccggggaggggagggtcttttcgctgaccacgctgtttgctgcgtgctttttgtttgccaagggctgcaatgtttgtcgtctgccgcagtgtttgctgccgggtgaagaatcgctggccctgtgttgtcacctgggcccaccgtgacaaggtccccacctctgttgtgggactcgggggcaaagttccctgctgttcacgctgcaagtgacaagggccttggtctctgaaccaggagcctctgagtcctgccccacagggctgagccctggctgggagcaatgttctttgggggagacagcagcttcctcacttccatgtacagccagatgccacgggatgtggggagtgcgacagggccgtggggagtgtgacaaggccttggggagtgtgacagggctgtggggagtgtgacagggccttggggagtttgacagggccgtggggagtgtgacagagccgtggggagtgggacaaggccgtggggagtgggacagggccgtggggaatgggacagggccgtggggagtgtgacagggccatggggagtttgacagggccgtggggagtgggacagggctgtggggagtgcgacaggtctgtggcgagtgtgacagggctgtggggagtgcgacagggctgtggggagttttgaaagggccatggggagttttgacagggctgtgcggagtgtgacagggctgtgcggagtgtgacagggatgtggggagtgcgacagggctgtggggagtgtgacagggctgtggggagtgtgacagggctgtgggaagtgcgacaggtctgtggcgagtgtgacagagctgtggggagtgcaacaggtctgtggcgagtgtgacagagctgtggggagttttgacacgtctgtggggagtgcaacagggctgtggggagtgtgacagggctgtggggagtgcgacagggctgtggggaatgtgacggggctgtgtgggagcaggtggtcctgtggggcatcccggggtctgtgctcaggctgtgggaggtggggctggcaggggatcctggagaaacacctttgggggctcaggtttggtggagctcccacttccacagtggctctgagtggggcctgagcaggttttcctggcagtggctgagggtgggtgggcctggtaggtactgggctgctcagaagccagccagctccatgttgcccacctcagcctcccaggcttctcagggcccagctgtgctctgtccctggggcccttccctccccggacactgctcacccctggcaagggctctgccctgggacacaccctgctagaccctcagatctgatcccagcccttcccatgtgactccctgggtgctcccagatgactgggatgtggggaaggatcaaagagcactttggttgtctctgtaactcttctagtgattagataagggctggatttaaggattacttctgcaatgcaaatagatgaaaggaacaagctaaataacaaactcttcccattcccagaacaaagtcagctctggcctggttccacgtgccctgtccagcacgtcccccaagcgcaggcatgggcccccggaccagccgcggacccctcctcgcgctttgcaacgcctcacagctggccccgcacccctggggcaggaccactccctcttcttattcttctctgtgtcaccttcccagactctgcacatagtcggcgctacataaatggtggctgcaaaaaggagacgagcagcagagcaatgccccagggaacaagaggggcgctgttgccaaggccagggccagggtatctgccctgaggcctgagccccacacgacccagggctccagagccccatggcccatctcactgctggggctgaacccccagggcccctgcagccactgcctcaggaggtcaggttggggtgtggagtaggagggacgggtgtttccagggaatccctgtgtaggtgggatccagagggcttgaaaccctcaagctaccagccagctccacgcctaggacaggccttattagagttcaggatctgccagctcccaggggcagcctcaatgtccggggtggatgggggtttctgtgggttcacttctgcccccagctgggatgcctggaaggagagctcagggacagtgtggccagaccctgacccagacagaagattctgtctgagagaccggggaccttcacagagggacagaggcccaggaagcagcggctgctgctgtaagcctacggcgagagccatggtcacagaagacccacttgttgccaggcgttttgccttcacaatggcaaagtctcccagtggcccaggagaaaagggaatgctcattccattctgcctgccagaaaacagaggctgaggcccagaggctcaggcaacctccccaggttcacctcatttggaaacagccccttcccatccccggttgctgccgcaatcttctaaggggacttcctcagaggtcattaaatgcattgaaaactggttctggtcctcgaccctaagctgctggaggagggggtgtgggagcagattcggggtgcacctgtgtgttcaggtgaaggcggagggaaattagtcatggagctaagctgaaccacctgctgggccccaggcaggcaaggccctgtgggcaggtgggaagccagaggccgcctctcaccccggggaggggcaggggctggagtgacggtgcagggtgagattttggccaggcacaactccatccatccctgcatccccaggaagccacagacacccaggttctgagagcccggctctcgaatgtccctcctcccccgacctccttcggtgcccctggccatgccagccctgagcatgaagccttcaactttcccacgcacccacttccactctccagggctgaggagcaggaaggagatggcttggaggggtgagcccctgtcctgttctcagagggtcacagctactcactacctgctacgaagacagggaagggtgggagccgttctaaaccagcatcagtgcatgccacaaaatagaagccgtgcattacaaactagaaacgagggcttggttgcaggcaccttccctagagaccctggctgagcagaggctggggtctggctgcgctgctctgacggtgtgcacgggcgggctaggcactcgccctgagtcccagaaagaggagcccacagatacaaaacttaaaggatgtgttattttattttttaatttaatttttgttttttcaaaagcatcaaagtcattgtgattggaaggaatgcgcaagttggtctggggtgctgtccctgggcgccgaaccagccggggacatggcccctggagagctgccgaccccggggctaggggagtggtcttgcgaggagcctttgcttcccactcgccggccgccccgcggggccctcctgccaccaggtggcgcttctcggccagcccgggccgcaggacctgcagtctcgtttccccaggaatggcgacggccctgttattcccatcacaattttacaggtcagaaaaggagactcggagtgcatatatagcaacttggagaaagtcgcaagggacgaaggacccttccccggacacaggaaccttctgggggatggggacagggactcaggtgcagagaaaaccagagctgctaccgtggggacagaaagggagtctacccagagacagcagaggcaggagctgccccccctctttgcccccagtggccccgagcgaggggttgccaccacctagagcctggggaccaggggccagtgcctggggacggaggccgtggtcgagacaggcgagggatgtggcggagacagggaggcccaggtcggctggcacagggcaaggagcaggcgagccgaccccagggccttgcccttgtcacgccccctgccatgttcctgctggcccccttcctgttctgtgaggtcaacacgcaggagaaaggggcagaagggaaggtctccccacaccgagggctctgcccgcttgggccaggggttggggggtggtcatggcaccagggctgctctgagctacagccccgagggggggccgggcgatgcctcctcctccgtgccagcctgtgccggggcccctaggaacccccaagtccctgcctgtgacctctgcagagcccagcaggcgcctccccgccctcggccacaggctcggagctcacggcccccagggggcgctcaaggactgctcatctgcgcttctgccgcgggcagctctgacccctcccgctgcgctcctccagccgcatccctgcagccttgggccctactggcccgggggaggaggcactgcgctttggggaggaagagagactaaaggggagaccgagaaccccgggtcaggaagcggagagctaaaacgacaaccgtgggtcagcggaggccggcaacttcatttcatgacctctggcctccaaagcagctctgcaaagtggtcaatgctcctctcgttgtgtagatgaagatactgagggccagggaggctgtggactgcctgatgtcacacgactggtggggcggcgggcgggtctgtccccaggcgattgtcctcgaggcacacggcggggcagagcttggaagcggccgaggtgggggtccctgggtgtggatgtagtgaccccggagccacgtggagccaccttcagacccagagctgaagcaggagggtgaccggtagagcaaggccgtgcacacccccgttgcagaattgaaaacgcgcctcaaaataaaaccccgtgtttcacaagaatgcactaattcccgaagatatccgggcgcacgggatgcagtggggattggagatgcaggggccatgcaagtgagaaggaccctgctcagcgtgaggctctgatggtcttgaattcctttgccatgctcggacaaggggcctgcgctgtcacgttgctttggaccctgaaaattcgggagcccgtcctgagcccacgctgccatagttgccaggtatccagcatatgcacaaaacacctccacgccggtgctctgccctgccctgctctggagacccacatccaaggacaggtctctcctatggcagccctgctccctgcccttcttccccacctgctcagtcctgcaaagccttcggccaagactgacacctgggggttctgtctcccacactctaggggcctcctccacatgtcggtgacctctgaccactgtttcagacccacagctcctgggtgcactcagcattgggtccctatggtatcagagtgttccaggcctggggcactgcactcactgcagacctggcctgagattcagcagctgggcaccctatgagatctagtttctgaatggcgtcgtcacctgactgggcatacaagccacaggccccgtggtctgtgggcggccattgtcctgtgtgtggggtggggcactgggaccctcccacagctttggctttctcagagtttctatccctgtgtcctcctctgtcagcaaagcccaaaggtggggggctcctgagctgccacctcctttgtttctccaactctgccggttcattggactatgcccttggtgcctcacagtgtgctgactgacagcatctctaagccctaaaccactgagcctggagtcatccagctccagggaaatgactctgcagggtcacgattcctgggtctgcactcaggccccctctttccaaccaagacagcaggatcccaggtatcctgagacctgtcctgatcctgaatcctgtcctgatcctgagtcctgtcttgatcttgggtcctgacctgatcctgccctgagtcctgtcctgatcctgggtcctaccctgatcctgtgtcctgccctgatcctgagacctgccctgatcctgggtcctgtcctgatcctgattcctgccctgatcctgtggtcctgccctgatactgagacctgccctgatcctgggttctgccctgatcctgagtcctgtcctgatcctgggtcctgtcctgatcctgagacctgccccgatcctgagtcctgtcctgatcctgccctgatcctgagtcctattgtgattcaaagtgctgtcttgatcctgcgtcctgccctgatcctgagtcctgtcctgatcctgccctgatcctgggtcctgccctgattctgagtcctgtcctgatcctgggtcctgcctgatcctgagacctgccctaatgctgagtcctgttctgatcctgagtcctgttttgatcctgagtcctgtcttgatcctggttcctgccctgtttctgagtcctgtcctgagcctgccctgatcctgagtcctattctgatcctgagtatttcctgatcctggctcttatgagatcctgggtttcatcctgttctacccacgggtgatagcccaggatggggtcacctgctctagggtgtctccatgcgtggtctccctgtgccttctgtaaacttcccctgagactttcggagtcaagtcagcatcagcatcagcatagaagtgggttgaataggaccccctcattcctgtccacctggaaactctgaatgtgatcttatttggacactgggtctttgcagatgtaatcaagttaagatgaggttgtactggagtagggtgggccctgatccaatgtctggtgtccctgtaagagaaaggaggggaggaggtcagacacagacactcagtggagaagcccacttgaggatggaggcagagacgggggatgcagccacaagccaagaatgtctggccaccaccagaagctggaagacgcagaaaggatccttccctggagccttcagagagtgtgtggcccacggagaacttgatcttgaacttctgtctgcctgaaccgcgaggcaccaatgtccgctttaaggctcccgttgggggccatttgttatggcagccccaggaaatgaacactggtagcaaagatgagcgcagcatcaaagccaagtccctgctcccgttgcccttactaacacagaaggacaggggccttgtcatttttcagaggacatgtgagggaaatcatgaactaaagaaaaagtgcaaaactatgtacaccactgaggttattttaagattaagcaaacaaacacagtttccctaaggaaatggcacaaacaggaaccaggaaatgactgtgtgtccagcatcacacctgatcctgggcagggatataaagggcccaggctcagggagctccatacctgcacacctccctctcacctgctcctctacctgctccaccctcaatccaccagaaccatgggctgctgtggctgctctggaggctgtggctccggctgtgggggctgtggctctggctgtgggggctgtgggtccagctgctgtgtgcccatctgctgctgcaagcccgtgtgctgctgtgtgccagcctgttcctgcaccagctgtggctcttgtgggggctccaaggggtgctgtggctcttgtgggggctccaaagggggctgtggctcttgtgggggctccaagggaggctgtggctcttgtggctgctcccagtgcagttgctgcaagccctgctactgttcctcaggctgtgggtcatcctgctgccagtccagctgctgcaagccctgctgttcccaggccagctgctgtgtccccatttgctgccagtgcaaaatctgaggctctgactttggacctcaggtgagtccagcatatccacaccacccaagaagtgaccagtgctgcatttcagttctggctgtcccacagctccaggagttgtgtcccctgaattttgcagaaggtgatgactccaggttcttggcctttcctgactccctttctggtcattcttcatgagaactctcttcctctctcctggtgcccaacaccttcccagttcccagagccctgcaatctcctccaacaagctccctgccaggtcctgctgcgacagggccctccctgtccatcagtcctcctgtcctccttctctagagcagctgcaggtcggggaggcagtggagatctgcccccatccccaaaggctccaaaccttcctccccaggagacggccactctcgcggcttctctctcagttaaggttcagcaggacctgagaccctttaaataaacacatttcccacccatgaggcttgctctcactgtggctttaaaacaaacaaacaaacaaacaaaaaaaacttttatttgaggttcagggagcatgtgcagatttgttacacaggtaaactcgtgtcatgggggtttgttgtacaaattatttcatcactaaaccaagtacccattagttatttttcctgatcctctccctcctcccaccgtccaccctccgataggccccagtgtgttgctcccctctgtgtgtccatgtgctctcctcattccacccccacttgtaagtgagaatatccagtatttggttttctgttcctgagttagtttgctaaggataatagcctccagctccatccatgttcctgccaataacacgatctcattctttgttatggctgcatagtattccatggtgtatatgtgccacattttctttatccagtctacaattgatgggcattttggttgattccttgtttttactgttgtgaattgggctgtaataaacgtgtgcatgtgtgtttatgatagaatgatttatgagtccagcagcacatcaaaaagcttatccaccacgatcaagtaggccttacccctatgatgcaaggttggttcaacctacacaaatgaataaatgtgattcattacataaacggaactaaagacaaaagccacatgatcatctcaatacaggcagaaaaggcttttgttaaaattcaacatcccttcattttattttttatttttttgagatggagtctcgctctgttgcccaggctggagtgcagtggtgtgatcttggctcactgcaaactccatctcccaggttcaagtgattctcctgcctcagcctcccgagtagctgggattacaggtttctgccaccatgcccggctaatttttgtatttttagtacagacggggtttcttttttttttttttttgagacggagtctcactctgtcgcccaggctggagtacagtggtgcaatctcggctcactgcaagctccacctcccgggttcacaccattctcctgcctcagcctcctgagtagctgggactacaggcacctgccaccacgcccggctaatttttttttatatttttaatagagacggggtttcaccatgttagccaggatggtctcgatctcctgaccttgtgatccacccgtctctgcctcccaaagtgctgggattacaggcataagccaccgcgcccagcagagacggggtttcaccatgttggccaggctggtctcaaactcctgacctcaagtgatccgcccgccttgctctcccaaagtgctgggagtataggcgtgagccgctgtgcctggctgacatcccttcatgccagaaactctgaataaactaggtcctgaaggaacacacctcaaaataacaagcaccgcctaccactgcatctctttccctgcagctcttgcctgagtgaatctgcctgcagggtcagcccattcccggcccgtcactgaatgtgtgtttactgagctcctcctgcatcccacgtgctcacagctgacagggaatcagaaccctcccctgcagctcaggtcctgggtggagacagcctatccagtcctccagggaccacaaggtgggtgtcctttttcttgactcccatagcagctgtgactgagatgcagagctggcacacacctgggcatggccccacacgcaggtggcatgggtgcagttctaacctctcagtccgactgcaaatgctgctcataaccacaacagaacatttggccagagactgctctcctctcgggagccacactcagggacatcaccaggaagatacctcctatcccaggccccgtctcaccatggctctgacagcaaatgtgggggcagaggtagtgcagggcaggccctggggaggaccttggccagtcagtggcgccttttcctgaggccccagtatggctgccttgccagtccttcctgactgtctctgccctcagcccctgagccccaggccatcagtgacttggtggccctggggagcagcctctcatctttctgcctggccatccttggccaggaggtctccctgctgaccactccattcgggtctaatttggtgcttccagtgtgtccatggatgcattatgattcaaaaataatcatcgcactcatactcacggagtctgtatcatgttgccaggctctgagttcaatgctttgcatcctctatcccggttacggaagtgaaaaccacagagccagaatctcagcccatgtcacttggtccccaaggcctgatgctaccctgattttcttggatgccggctgcctcacccaaaaagtgtggattatgttagagtgaaagttccccaggaataaaaccacccaaaaaagaccagaaagggtagaagagacatcgatatcatggcatccagatccaggaaaatgacaaccagagagcccagcctttaatgtgagctccctagcagtcagagcaaaaagggaaagaggggacacataggcttcatcacctggaggagggagcagcacagtttacagcagaaatacgctctgtcacgtttcagagtgaagagtcagttggggtgacagctgtggaatagaggtgcccctcagggaagagggtccctcgctgctgttgccacattgtattaaaataaaactataaaaaagtggacaaggtatccatgtagaactcaataagtttccacaaaagctgaacaccttcctagaactggccctcagaacaagaaatagaacattccggcaccccagaagcacccatttctaattgctacccactccccaccaagagtaaccatgagcttgaattatcccatcagacaccagttttgtctgttactggacttcataaaacgccatcgtaggccgtgtcctctcatggccagctcctttggccccagactatgttggcgaggttcatccactgtgttgcatggaatttgccccgttcgcggctgttgctgggtcctgaattgtaagagtgcagcgcagcatgcacacgcactcagaggatttggttttaagagctgcgtgggagggtgcaatgcagaagacaagtctttgttctgcacagtgggtggttggagctcagagctgctgcccaaagcagagatcccggaagggactgtgccctctgatgggggtggctagaaggcaacccagccgctgccagaaggaagggactgtgccctctcatgggggcagctagaaggcaacccagccactgccagaaggagacagcagagaaatacgtttgctgagtctgagatgggtgataaaaacatttcctttgagaagtgacaacttcaggcccaccattatccaggtgggaggcacacattggcatcagttttgtggtccagaaaaccacaagctgagcaagtcacttaaagtggtcctgaattgataggacccagagcagcccggtggaaggaagtgcagcaaaacttcagacaaagtctgtgtcctcagccaaggccctgagctccccacctacagccgaggcaaacatgagctcacagcagaaaaccacaagcacacaaggaaagcagccaccgtgggcaagagccagcacccgcagtcagagacacatggagacaccaagggccatgaatgaggacatgaggagataaaataccagctaaatatttaaaacaatgggctcacccactgtcttgggaccacgaaggctcttctgagagagaaagtttcctatcctcagagttttaggtgaacatatgggtaaatctaatgggttattctcttcaaaatgtgtttgatgttgtaaacaaaaatcacaccattctctggtggggttttcaaaatgagtatttgtcatttatgagacaagtggtctctattgcgggaagattcctggattccacctaaattagtgaaatatcgattctaagtacacagtgcaaaagtaagcaatatacccgtactctagaacaaccattaaaaagatataaacaaagaatatagtcaagctggttctttgaaaagatcaacatattttttaaattttagcaagactggcaagatgaaaaagaaagaagatgcaaattaccaatatcaggaatgagaaaagggatatcacttcgggtcccacggacattaaaaggataatgcaggaatactgcacgccgcatacatttggaaactaagaggaaagggaccaattgctcgaaagacatgaaccaccaaactcaagaaggaagagggagcctgaatatctctatcaagaaacagaatttgtagttaaaagccttcccacacaaaaaaacccttcaaggccagatggtttcattggttaattctacataaccttcaaggaacaaataatctgaaagcaagcaggaaaaaatatataaatttatggataagtgtgtatgtatgcatataaaattagaaatcaatgcaatagaaaatagcaaaacaacggagaaaatttattcaaccagccaggcgtggtgattcacgcctataatcccagcacttcgggaggccgaggtgggtggatcacttgaggtcaggtgttcgagaccagcctggccaacacggcaaaaccccatctccactaaaagtacaaaaattagcctgacgtggtggcccatgattgtaatgtaagctacttgggaggctgaggcaggagaatagctgaacccaggaggcagaggttgcagagaactgagctgagatcgtgccaccacactccagcccgggcaacagagtgaaattccatctcaaaaaaataaaaaaaataaaacaagaaaattaattaaaccaaaatctggttctttgaaaagatcaataaagatcaataaataaagatcaaaaaagataagcctgtagcaagacagacaagaaaaaagagcagacacacatgaccgaggtgtgtgtgggatatcaccatgttggccaggctggtctcaaactcctgacctcaggtgatccacctgccttggcctcccaaagtgctgggattacaggagtgagcgtgcccggcccaaaactgttctatatgatactgtgatggtgaataaatggcattccacgttcatcatttgtgttgtagaacgtacaacatgaagagtggaggtgaaggttaggtctggactttgggtgctcaccacgtgtcaatgttggctcatcaatgatgacaaatgggccaccctagtgtaggatgctaacagcaggggacgttatgtaggtgtggcagcaggtgaaatacggtaattttctatacattcaactcaattttgctgtgaacctaaaactgccctaaaacatagtgtgttttctgaaatacgtccaaaaataaaaagttataaatctaacaaaatatgtacagaatgcacatgttataaatacaaaacactgatgaaaggaatcaaaaaatacctaaataagtggagagagtcgtgcattcatagatttgaagacacaaaataataaagacgtcaacttccccaaaactgatgtgcagatttaattggattccaacaacaatcttagcaggattttttggtagatattcataagctgtttatgaaatttatgaggaaaggcaaaagaaaatagaataacctcaaggatctagaactagaaataccatttcacccagccatcccattactgggtatatacccaaaggattataaatcatgctgctataaagacacatgcacacgtatgtttattgcagcactattcacaatagcaaagacttggagccaacccaaatatccatcaatgatagactggattaagaaaatgtggcacatatacaccatggaatactatgcagctataaaaaatgatgagttcatgtcctttgtagggacatggatgaaactgaaaaccatcattctcagcaaactatcgcaaggacagaaaaccaaacaccacatgttctcactcataggtgggaactgaacaatgagaacacttggacacaggaaggggaacatcacacactggggcctgtcgtggggtggggggaggggggagggagagcattaggagatatacctaatgtaaatgacgagttaacgggtacagcacaccaacatggcacatgtatacatatgtaacaaacctgcacgttgtgcacatgtaccctagaacttaaagtgtaataagaaaacatttaaaaaagaaaagaaaatagaatagccaaaacaattttgaaacaagaaatatagttggaagaatgacattagctgactttgagacattccataaagcgacagcaatgtagacagtgtggtatgggcagaggggtagacacacagatcaagggaaaagcacggagttgagatgtcactcgcacacacaagactgcgctaatttatgacaaaggggcaagacaactaaatggagaagtgtctgctgcaatcacaaaatacctgtgactgggtattttacaaacaatagaagtacatttctcacagttttggaggctagacgtccccagatcaaggtgccagtattctgcatctggtggaggctctttgctgtgtccttttggtggaaaacataaggggcaaaaaggacccaagctcatcccccccagccctttaatgaggcactaatctatgcctgagagcaaagccctgacttgatcacttctcaagagaccccacctcttagtaacaccataacaggggttaagttacagcgcatgaattttggggaacgcattcataccagcgcgcgaaaggagaaccgtttccaaaaaatggcattggaacaattgaaccgccgtagacaaaacgaaaacaaaacctcaacctcaacctcatactttatataaaattaactctatgcccatcatagacctaaatgttgaatataaaacaataaaacatttggaataaaacaggagaaagtcttagtgaccttgaataataaaaacacactgtgtaagaaataataatgtgagtgaaattcagtgtcctttaaagataaaaggtcacgtcataaggagagagacacacttggcagtgctcctggttgctggtggaggaccaagtgagtccttatttagaagggacattttttttttctgtgccattttcttcatcgaacatttagtcctttgaaagcttgtgattatcttatgttcaaatgctatgaaataataaagtcacagggcagtcccactgcagcgtgacaatgagggggaactccagagatccacttccatgtgaaactggtgaagactttaaaaacaaaaacaaacgaaaccccacccccaacaaccatttaaagcatctgcaaatggccctgtagccatttcaaatagagaaacatttattcaagaaaatcgactaaagcttagtgagaactgtgtgagtctgtggtatctgagccaatgcgtgtgccctctcccagcccagtgagacagaagctccactccaggctgtacagccaggaatgcaagactatctctcctccagtttctgtaattgcccgacaggctcttcccgcccgctgcacagacaaaaccagttcactctgagaacatggtattgcagtaaatgaaatgtttaattaacgcaaggcctgccaggtggaagaactggaatgatcactcaaacccgtctccctgaaggcttgaaggttagggtttttccaggacagtgtggtgggtggggggctggggaatgggtgctcctcattggttgcgggggcaatcacaggggtgtggaaaatggtccttgtgccctgaatctgcctctgggtggataacaaccccaaagtgaaagcaacccagacatccttcaacgggtgaacggttaaacaagtcgtgagtcacgagtctgcatggggtcagttggaaaaccacctcaaaagaccaatcttaattctaccacagtgatattatctataggagcaactggggaagccacaaatcttgtgatctctggacaaatgactcctaagcagagggggattatagaaactatgcctatattttagcagaactcatgccctcctgtaattctaatcttgtggtctttcattagtcctataaaggcagtttcagctccccaaaaaggaggggatttgttttagggcgggaccgttatcatccttgcttacaagttaaactataaactaaattcctcccatggatataatagaggcaggaggcagacaaatcccaggcagatgggggtgggtccccagtgaaacctcaccttcaagccaaaacatcctgaaacctgcagcccagagtgaaaacttctattcttgtttgcctgctcgctccggattggttcattttgaataatgcctttttaaccaatcaaatactgccttttccaatactacctatggcctggcctgcccccgtcctgggcctataaagactccagactcagttggtagagagagagagaaggcctgacttcaaggaagagatctcctgactttggggaagacgacctgccctccctgtcccctttccagttcccctctctgctgagagctgttttcattgctcagtaaaagtctccactttcaccatccttcaatcaccagcatgacctcattcttcttggacgctggacaagagctcaggacccacagagtgcaggtacctagaaaggatgtcacccgggccctttgccctcgccagcagagggcagctgccccacgcgatgaggccaggggccgaccgagctgctaacacattgccctccattgggatgtggatggtggaactataagagctgattagagcactaacaccccctctggggcttcggggttgcgggcacccttgtctgggcactgccatgttctcctcgaggtgacacacctggtctggctgtgggccccacgtggagtttgctcccgtgtcagcgttcagagtggctggccagatcccacacttgctcgctcatgcactccctcccgcaaggggctgagcatgctgggccaagtagatgaggagcctctgctgtgagtccagcaaagaggctgagaaaaaatcctgcatcagttagcttggcctgagtccaggaataagcaaggacaaccagcctatgagccagaagcaagatggagtcagccatgctagacctctctcgctgtcaaaaggtagtttcacttccagttggtgaggctctcttcctgtgagggtcagtgtgctagcatcctgcccccagctacctgtgtctcaggctgaattctgagtgagtgtgtccgagaggtgagggtcccttcctctactcagcctcaggtctcactcatgcagcaaaggctgccctgggttcatcatgctgagaatcctgggtctcgggtctctggtcacctttgctccagcttatgggaggggttcatgctgagagaggcaagctgaggacacctggagctgctgcccatcactcaagtgtccagcttctaaagtaggcatgacaccagtgagccaagatccctgccgtcagttccagagctgtggcttagagattttgtccagggagaatggcaggatgtagaacagaggatctcctagtctctcccaaaaggaactgacttcatttgcaacagagtatgaagttcaaacctaagggtgctctcagagtcagtggcggttgtggtgaagggcaactgggagaagattgatagattctttagagacgtagcctaactctaagatggctagttttctggagagaaatggagaaagagagagctgggaagagactttctgggttagtaagaaatctcaagcactggcctttcctttcaaaggagtcagaatttgattggattagtctgtgaagcaatttattccctagggtgatgtcaaaaacaatcgagcaaccagcttgcaatgacgaatttagcagctgggtttggtcagggaaagagacgaagagagccttcccacacccccatcatatcaaggtggacctgcccactacttctcaggggaaacagactttactgcagtattccagtcattgcagctttcacctaaaagctttcacacaattgctttgggctattcataatagccccacactgaaaatccaggcgtccttcaatgggcgaacagttaaataagttggggctcgttcagcttatggaatatgtttagcaagaaaaaggaatgaactattgatacataccacagcctgctaatctccagagaatcatgctgaatgaaaaataaaaagccaattcaaaaggttacatgctgttttatttcagttacataacatccttgaaatgaaaactttatagaaatggataaccaattagtgtctcctagggtttatcgcccagggttccggcagtgatgaatgtggtctgtgttttgaaaatatcgatgccaatattctgattgtgatattgttccgtagttttgcaaggagttaccattgagggaactggataaagggttcatgatattctattatttcttacaactgcatgcaaacctaaaataatctcaaaataaaaagattaatatattaaaaaaagaattaggatacttctgctttgggtcaagatagagcaacagagaataaatatacaattgtaaatgtaaaacaacaacaacaaaaccaagacaaacacattattctcaagaggtagacaacagacaagaaaggactgggaggtgagccctgggacgtgagcccttcagtggccccaggtttcagccctcagagtgtttccaggtcatggcgcagggagaggagaccccggggaagctcagtgtattccttgagttgagcatttgtgaagaccaaggcagcccgaggtcacagggcagagcatcggagagtggagcgctgcacagggagctgggagacatgcggagggtcccctcttcagtcctcagcagggcactgaatggcacatgcgtgggagagaactacttgaagccagggaaagaaccagcagagaggaccaaagggaactgtgccaggcgcgcacacagggctggggacagtgactgaccccagcagaaaggctggaaaattccacaattcatggagcatgtgggtggaatattgagaagggtctcaacagtggagaataaataaccttctactaagaatcttccctccataattgctagaaaaagcagatggaaactaaataagaacacagggccgggtgcggtggctcactcctgtaatcccagcacattgggaggccgaggcgggcggatcacgaggtcaggagatcgagaccatcctggctaacacggtgaaaccccgtctctactaaaaatacaaaaaattagccaggcgtggtggcgggtgcctgtaatcccagcacattgggaggccgaggcaggcagatcatgaggtcaggagatcgagaccatcctggctaacacggtgaaaccccgtctccactaaaaatacaaaaaattagccgagcgtggtggcgggcgcctgtagtcccagctactcgggaggctgaggcaggagaatggtgtgaacccgggaggcagagcttgcagtgagccgagatcgcgccactgagttccagcctgggcgacagagcgagactccgtctcaaaaaaaaaaaaaaaaaaaaaaaagaacacagaaggcttgaacaacgctttaaaccagcaggatgtagtcagcgtttagaggtcactccacccaataacagcagaatacacactctcttcaagtgcacagggaacatttaccaacatagaccatattctgggccagaaaaaaagtctcaacagattttaagaggtccaagtcccacagagtatattatctgaccctatggaattcaatcccacatatttggaaactaaatagcatactgctaagtaatccacgggccaaagaataattaaaagagaaacccaaaattatttcaaactaaaagaaaatcaaagctacatctaaatttgtgttttcacaaatttatagcattaaatgtccatgttagaaaagaagttttccaggttggacatggtagctcatgcctataattccagcatttgggaggctgaggagagaggattgcttgagctcaggagttcgagaccagtctgggaaatatagtgagcccttgtctgtactaaaaatcaaaaatattagctgggtgcagtggtgcatgcctgtagtcccagctactcaggaggctgaaggtgggagggtcactggagcctaggttgttgaggctatagtgagccgtgattgtgccactgtactacagcctgggtcacagagcaagaccgcatctggaaaaaaaaaaaaagaaaagaacagcaacaaaaataagttttccaattcatgacctcagttttcaccttaagtaatgagagaaaggagcaaataattaaaaaaaaagaaaaaaagtacatttaaaggatcagagtgaacaatcaatgaaacacagaacaaaaatagagaaaatcagtgacgccaaatctcattctttgagatcaataaaactgataaattcttagctagactcatcaaggggaaaaagggagagaaaagacacaaattactaacatcaggaatgacaacagcataatcatcgtaggttctactaagtgttaaaagaattgagaaggaataatatgagcaatttaatgttgatgcatttaacagcttagattaaatggacaaaatttatgaaaggcacaaactttcaaagcttactcaagaagaaaaagataaccagagtagccctgtatttatttaatacgtaaaatttggctttaaaaaacaaaaacaaaagcaaaaacaaaacttcccacaaagaaacctcctggcccaggcagctttacaggcaaattctaccaaacatgcaaagaagacttaacaccaaatccacactcatgtttgcaggaaattgaagaggaaagaacattcccaactcattctaaaatatgcacagaaatgaaaaaaaaaagtcacatctgaaaaaggaaaagtctaccctacttgattttaaaaaatgtaaacctgcctgggcacggtggcttacgcctgtgatcccaacactgtgggagactgaggtgggcagactgcttgaggccaggagttcaagaccagcctggccaacacagtgaaatctcgcctctaccaaaaatacaaaaatttgtccaggcgccacggctcacgcctgtaagcccagcactttgggatcttggacttctgaccgctagaactgcgagaaattgaatttctattgtttaggtcacgcaatctgtggcactctgttctgtcagccccttgttgactgaggcagccatatctcaagatattttgtttgttaaacttgtggggagggtgctgctggcattggatgggcagcggccagggatgccgctgaatactttatgatgcacaggacggctccacaccaaagaatggtctggccccaaatgctgataatgtcaagattgaggaaccatgagataaataaataaaccagtgaaacaggatagagagtttggaaacagagccgcacataaatggacaactcctggtctctgtaacaaacgctgctggaataactgcgtatctgtgtgcaaaaagtgaacttcaaggtacacatcatgccacagaacactacctccaaacaaatcataggtttacattcaaatttaggagaaagtctttgtggcctcgtattgggcaaacatgtcttagacatgaggccaaaagcacacttcataaaatacaaaaagtgatgagttgaacttcatcacaattaagaaattctgtgtttggagaggcactgttaggagagtgaaaatgcaagccacagatggagagaaaacatttgaaaacatattatctgataaaagacatgtatcagtctttaaggaattcttgaagtctggctgggcaaaatggctcacgcctgtaatcccagcagtttgagaggctgaggcaggaagagcaattgaacccaggtgttcgagaccagcctgggcaacatagcaagaccccgactcattttgttttaaaaaaataaagctaaaaaaagacttcttaaaaatcatgactgggcaagtggctcatgcctgtaatcctagcatttggggaggtctaggcgggtggatcacttgaggtcaggagtttgagaccagcctggccaacatggtgaaaacctatctgtaccaaaaaatacaaaaattagctgggtgcggtggtgcacgcctatattcccagctacttgagaggctgaggtgggtgaatcacttgaacctgggaggcggaggttgcagtgagccaagatcgcaccaccacactccagcctgggcgacagagcaagaccctgtctcaaaaaaaaaaaaaaaaaaaaaaaaaaaaaaccaataagaagaaaacaactaagtatggaaaatgggcaaaatatttattatttattttgttatttattttattaatttttatttcaatagcttttggggtacaagtgatttttttgttacatcgatgaattctatggtggtgaattctgagattttggtgcacgtgtcacctgagtagtgtacatcgtacctaaaagtgtcattttaaaaatctccagccccctctcgccgcccctcttctgagtctctgaagtccgttacatcactctgtatgcctctgtatactcacagcttagctctcacttaaaagtgagaacatacggttttttattttccactcctgtgttacttcacttagaataatggcctccagctccatctaagttgatgcaaaaggcattattttgctccgtttttatggctgagcagtattccatggtgtatctgtgccgcattttctttagccactcgttagtcgatgggcacttaggttggttccagatctttgcaattgtgaactgtgctggaataaacatacccgtgcaagggtctttttcatagaatgacttcttttcctttgggtagatacccaggagtgggattgctggatcgaatggtaggtctacttttagctctgtaaggaatctccacactgttttccatagaggttacactgatttacattaaaaatgggcaaaaggggccgggagcatggcccacacctgcagtcccagtactttggaaggctgaggcaggtggatcacttgaggtcaggagtttgagaccagcctgaccaacacggtgaaaccccatctctgctaaaaaaaaaaaaaaaaaatacaaaaattagctgggcgtggtggcacacgcctgtaatcccagctattcaggaggctgcggcaagagaattgcttgaacctgggaggcggaggttgcagtgagctgagatcatgccattgcagtccagcctgggcaacagagcaagattccatctgaaaaaaaaaaagaaagggcaaaagatttaaacagacacttcatatatatatatatatatatatatatatatatatagcaaataagtgcatgaaaatgtgctccgcataattagtaattaggaaaatgtaaattaaaacccacgaagtaacactatatactccttggaatggcaacagtttccatgtcgagtgctggcaggggtggcagaaatggaactctgtacaccactggtgggagagaaaatggtatggcccctggggaaatcggcgtggcagtttcttataaaattaagcgtacacttagcataagactcagcaatcctactcaaagacatttatccaagtgaaataaaaatctgtgttcacacaaaaacctgcataggaatgtttgtttgtaattgccaaaagccagagaaagcccaaactgcccctcaacttgggataaagtgtggataaaagtggataaactgtggcacatctgtaattgggagtcctacctcgcaaagcaaggggcaaaccatagaggcacacaacacgaacgaatctcaaggcatcagcctacgtgaaagaagccaggcttggaagattccctgttgtatgatcccagaacgtacggcattctggaaaaagcaatattacagaaacaagaaaaagatcactggttgccagggcctgggagtggggaaagaacgtttgaccacaaaatggcaccggggatttgagtggaggtgacacgactgtatggttgctaaaaactcatagagctgtgaatgttaccttatcatcatcattattattattattttgagatggagtctcgctctgtcacacaggctggagtgcagtggcacgatcttggcttactgcaacctccaccttgtttgggttcaagcaattctcctgcctcagccttcctagcagcagggattacaggtgcctgccaccacgcccggctaattttttggtagttttagtacagatggggtttcaccatgttggccaggctggtctcgaactcctgacctcaaatgattggcccacctcggcctcccaaagtgctgggattacagacttgagccaccatgcccggtctattgtttaataggggaaatacgtcccatcccaagtgtgtccctggcccctcctggtccttgccagctggttcttgggagtcttcaggtgtgttgtgtctttctcacctcaccaggtcccatctgtcactgaccaagttaggctggcatttaacctcagttacctggaagtcaggtgaaaagatgaggggcagctttcaaagggcacctgttgtcctgtgtgagaaaggtttcagcagctcgctcaaacgtgacagcagtgttagctctgcctgggaagggccgacctcccgctaagttctgagagtccaggtgggttgcagagtccacatctttggggacacatatccgcatgtttctgtctctgttttcagggcctgacttcacgtccctggtcttccttggctgagcagtccaacctctctgtgactctgggactgtcacaatcaggtcatcagtctgccactcagctgggtctgccttccatggaggggggcaggggcttctttgtgagctggcaccaagccccctggctctgtgcttagtccaggactcttcattggcagccgtccatgtttcattatccttgggctgggctgccgtgcagctcagcggtgccacccaaccctgctgaccttgttggcattgtccccttttgctttgcaaatgcctacgtcatcgtactgccacaggcctctcctccacctagaccttccctgcaaatcatcaccagcaaagattttaacaatgggggctccacctcgtgtcaaggactgtccatgccccacccaacagccagaggggtggttccagtgcctcctgaccagtaggtgggcccgtcccaagtgctcatcccagcacccgccttctcagaacactctcagcactacttgctttcgtcaggggccttctaaggagcaggcccaaagatgggatcaaatgcaggggatttcagcagggaaatgtctacgtggaggaaatggggaggagccataagggctgggggagccatgtccctgctgcaagtgtgaccctgaatgaagggcgaggggaagcagcatgggagaccgccatgctatcaaagaaacattggatgaggcctccggggatccctacgccaacgtctttcatcagaggggtgtcgggtctcccaggagcaagcccgcatagcaccccagtctctggaagcagcccatggctttggcgtaaatgcggtgctggatgcagagtgcacctgccggggcctgggaaagccactgtctgcacggcaaagtcaattcgtatgcaggagagcagaacatcacaacgaatacacagcccacaagtcctctaaggaacccagcaccaacacggaaaaggacataatttttctcaaggacatgtgacacattcacaaaagatttaccgtaaagtcagtattgaaaaatttgaaaagattgaaatcatacggtgagtattctctgcaattatgctacaactccatgaataaaatgtaaatagaacattctgggccgggcactgtggctcacgcctgtaatcccagcactttggttggccaaggcgggcggatcacctgaggtcaggagtttgagaccagcctggccaacatggtgaaaccccgtctctactaaaaatgcaaaattagccagacatggtggcacgcgcctatggtaccagctgcttgggaggctgagggaggagaatcgtttgaacccgggaggcggaggttgcagtgagtggagatcacgtccatgccacttgagcccaggagaccaccctgggcaaaatagaaagattccatctctacaaatataggtacacacacacatatatacgtatacaaaaattaacctggtatagtggtgtacacctatagtcccagctactccagaggctgaggtgggaggacggtttcagcccaggaagttgaggctgcagtgaatcatgatcacacctctgaactccagcctggatggcagagtgagaccctgcctctaaaaaaaaattaaaattaaaaaaatacattaattaaaaaaaatttttttttttgaaatggagtctcactccgtcacccaggctggagtgcagtggcacgatctcagctcactgcaagctccgcctcctgggttcacgtcgttctcctgcctcagcctccctagtagctgggactacaggcgcccgccagcacgcccggctaatttttttttgtatttttagtggagacggggtttcaccgtgttaaccaggatggtctcgatctcctgacctcatgatccaccagcctcggcctcccaaagtgctgagattacaggtgtgagcaaccgcgcctggcccctaattaaaatgttttaacaaaggttcattttaccccttcttgttttttttgtttgtttattttttgttttttttttgagatggagtttcgctcttggtgcccaggcctgagtgcagtggcgccatcttggctcactgcaacctccgcctccgggattcaagtgattctcctgcctcagcctcctgagtagctgggattgcaggtgctcaccaccacgcctggctgattttgtatttttaatagagatagggtttcactttgttggtcaggctggtcttgaactcctgatgtcaggtgatccacccacctcggcctcccaaagtactgggattacaggcgtgagccactgcacccggcctaccccttcttttattctgcattttcttcaccaatttgtcaaccagccaatttgtcaccaacttgccacagttaccttgcactcaaactacacttaaaaataaaattagaaaacatgaaaacatctgaagggaaaaatcgaagctcatcgtcatagcatttttacacagatatatactagatgaaagagctgcagaaaatgctgcctctatggccctcttgtttgctgtttgtgcaccagttaaaacaactgaggttcgctggaatatggtgcatacttcagactgtggaatataatattctctgactaaaaactgttgcgttgagtaaaacaaacaaacaaaaaagtattttttcccagctactcaggaggttgaagcacaagaatcgcttgagcccgggaggtggaggttgcagtgagctaagattgtggccactgcactccagcctggacgacagagtaagaccctgcctcaaaaaaaaaaaaaaaaaaaattaatgaattaagcattcggtgcaagatattggagagagaaggacataaataggatagcaaataaagcaataactattaaaggaattcaaactaaattaaaaccttcctacaaagaaagctccagggtcatgtggcctcaccagctgctgcaccaaatataaaatgcagaggcaaaaaccctgttaagcaactcgaggccaagcaggccaaatcttggcacccaagccccaggggggcggcgggcacaaggaagcctgggagtccagcgcacacttgcttctggaacaaagaggcatgacaaaaatagcagcgtttcaaaacacaaatacacaatgaacattttaggcccagtccaggcacgcgagcctgttttaacattagacaaaatgtccaagaatgtcatttgctgcattaacttccttgaatacacgaaagaaaatcacataaatgatgtagaaacgtcattccataatatttcataggaatttaataaaacggggtcatttctgccagaatgcattgtgtaaaatgcaaaccagctcaaaagcaactggcaaataaagtaatatcagtatgacactagaattattctcctttagacacctttccccccagcatattaatgatgtaaaaggactgaggtaagcattttcacaattaagacaggcgcttctctccacgcgggccatggctggcttggtgtccgcagggactgctgctgcacctgccccgatgagccatctgaagaagctgggggcacacatgaaaaggctgagaagtgctgggcaaggtggctcacacctgtagtcccagcactccggtaggctgaggtgggcggatcacctgaagtcaggagttcaagaccagcctggccaacatggcgaaaccccgtctctactaaaaatacaaaaattaaccaggcgtggtagcgggcgcctgtaatcccagctacgcaggaggttgaggcatgagaatcgcctgaatccgggaggcagaggttgcagagatcgtgccattgcactctagcctgggtgacagagcgagactctgtctccaaaaaaaaaaaaatgcatttcacccatggtgaaaaaaaatcatgaaaatgcctacaatctgaagcacacgtttaaatttgggaaaatctgaagtgagtgcctgtcagggcctctttgttgaaatgagaatcctgagccaggattgaaggctgagaaggggcagttaacaggtgctgggtggacgtgatgacggggactgaactttgctaacgcttgtcatttactccagtcccaaaattacacagctttggaacaaaactgccgcccagatctatttttccatcagctctgttagtttttagtccatgctttcttttgcagaataaaaagtctttcctatttatggcattatagcaaaaatgtaaatattagcatattataaatgatagggaagttctttaagttaatagaggatgtctgcaaatacccagaacaaatatcacacaagtcctacaaacttcaaagatttatctttgagataaggattataaaagaaaagcctgctatcaccacctgttttacattgaaattgaggtcctagaaaatgcagttagtcaagaaaaacacataaaatgtatgtgaattagaaaggaagaaataaaactctaattattcatatgataaggtgccatgattatatatataacaaatccagataaagctacaaaacattattaaaataagaaatgcatttagtaaggatcctggctatatgattactctttaatagtcaatagtatttcttcacattagtaataaaaacttagaaaagaaaatgtttcaaatggtgtgacatttacagtagcataaaaatcaaatatctagaaataaatttaacaaactgtgtaagactacacagagaacaataaagcgtttttttttgggagaaattaaagaaggcttacataaatggaaggttatagcatgcttggagatttggaaaacccttgcctattataaaaatatgtaaagaaaaacttacatattataaaaatgtaaattcattaacggcaaaaaccacagttgtttttgcaccagcctaatatttggggagaatttacgtttttacaatgtgtgagagtttttgtttacatatgtttataatacgtaagggttttccaaatctccaagcatgctatatggcatacttttaatggcaaaaaccgcaattaattttgcaccaacaaaaatatatctatagatttaatcaaaattccgataggcttaaaaaaatttggataaactggctctaaaattaagtgaaaatctaaagtaaaataatcgagaaattcttggagagtgacaatatgaggggtggagtggacatgtgggcttattctcaagctacggtaagtaagatgatctggcatcggtacagcaacagacagaagagcaaatagagagccgagcactagaccctgcatccaggaacacttgaggtccagctaaggtgtctcagcagaacaatgaagaaaggacgggttttcaaaacagcagagaggcggaactcacctctgcctgtctccatgcgcagggagattatccatctaaatgtgaaaaacaacataataaagaccctagaagatcatcaagggtgatatcttttattttattattattatttttttgagatggagtcttgctcttgtcacccaggctggagtgcagtggcatcatctcagctcactgcaacctccacctccgggttcaagtgattctcgtgcttcagcctcccgagtagctgggataacaggcgcacgccaccacccccggctaattttgtatttttagtagagatggggtttcaccatcttggccaggctggtctcgaactcttgacctcaggtgatccacccaccttggtttcccaaagtgctgggattacaggtgtgaaccaccgcacctggccggtgatctcctttatatctggttaaatcaagaactggtaataaagaaaaggacaaccactgaagacccctgcttcgttgagatgtcgtgtatcactttaggaaacaacgctacgaccactagaaaaaatgcagatgacaagtacacacaggacattcaagagccataaaagcaaagaagactagagcaactcaacttccaaagaataaccttttctagatagttgctctaaatggctgattttctcctgggggcccatcttgggagagggctgagggttgggtttggcctgggtgttgggattctgctaggggaagagaagccagtggagacattgctgagtctcgtggggctggaagggagtggcgggaggcgcagggcagagccggttgtggccgctggacacttgtccaggtctagggtggtccgcagagcggggatgttgggttggtaactgttaagaggctgagtgggccagacgcggtggctcaagcctgtaatcccagcactttgggaggccgaggcgggcagatcacgaggtcagtaaatcgagaccatcctggctagcacggtgaaacccgtctctactaaaagtacaaaaaattagccgggcgtggtggcaggtgcctgtagtcccagctactcgggaggctgagggaggagaatggcgtgaacccaggaggcagagcttgcagtgagccgagatggggtttcaccatgttggccaggttggtctcaaactcctgacatcaggtgatccacccaccttggcctcccaaagtgctgggagtacaggcttgagccagcgcacctggtttaaccagatttaaaagatatcaccggccaggtgcgctggctcaggcctgtaattccagctctgggcgacagagcaagactccgtctcaaaaaaaaaaaaaaaaaaaaaagaggctgagtgaactcctctcttgcggccccatgattcgtgagtccctctggagacagtggcttgcccccagtgctcgaggcccccaggattcccacccagatctccagccagagcgaagagcaaagagcaaaacctctgccgggaagacggaatctgcatcctctttcacggcttaggagaaacatttaagggctcaggagggttctgccccaaatcggtaacaaactaaaagcgactgactcagaaaatctcaaatccaatcctgagcaaacgcagtcaaacgaattcctcaaacaaactgggttgaaaccgtcaagccctcccatgcgatccacctagcaggagaaaatcttcttcacgagaaaacaacaatttgtctttaataaattaatacataatgtttagcctctgaagttcttttatgcataatgtatgaaatgcaaaaataaatagagacatgaaaagaagataaatacatccaatatcaagaaaataaacttagcaggatggttacctgttgtaaagaacgaaaaaagaaaagaaagccagacagtaagaggcaaccacttataatctgtatgttggagttatgcattaaaagaactattatacatatgttttgaagatagaggaaaagatgaacaaaatgcatgagaaggtgaagaatctcatcagaaaattggaatctaaaaaacaatggtataagcattgttaaactaacattatatctaaaatttgaaaatgcattggatgaaaaaacagaatatagctgtgctatgcccacatatactttctgagagtagatcctgagatatttacacaagttatatcctaaggtagtatttcttaaagtgtttggcaataatcaagatataattaaattttgcttaaaatacacaatgtatagaaaatgttggattaagcaacactcaatagatttccaagcaacatgtcttttgtgagttttattttacctagctaatatgcattatgaatcttcagagaagggttcttaacatattcttttgttttccttcacacaagccaagagtcctaatcaagattttctgcaatcaactatgattcttctaaaaacatgttgggtatattcaatcatatgctgaacagagcagaagactgaattagcaaatttaaagaaagatgaatagaaaatatacaaatcaaagacagtctttcaagggacaatcggtcagcgtaactgactgattttatgagttagttgatttctcattagaaacaatggaagccgtaagagaacgggatgacagtgtggtggtggtgtttttttaaaagaaaaaaatggccaacctagaattctataggcaacaaaaatatccttcaaaaataaaagcaaagaccatttcagaccagccaggctgttgcaggaaacactcaagggagatttttgtgctgaaaaaaaattgtcccagatagaatgcggaacttcaaaacagaatacagtgtcctggaaaggctgagtaagtatgcaagtcactacatggaaaaagagaaagagaaagagagagagagagagagagagactgcgtatttaaaacaaagagattacagatgtttataacatatatagaggtaaaatataaaatgacaatagcacaaagggcaggaggaggtagacatggttaaattcctgtaaaatgtctgtactgtttctgggaagtggtaaaagcacaactttctttagaccgtaacaagccagtaactcctgttgtcatattatcactcctaagagattaatacaaaagtatatagctaaagatctaatggagataaaatgaaataaaaacatttgatttggccgggcgcggtggctcatgtctgtgatcccagcactttgggaggccaaggtggatggatcactaggtcaggagatcgagaccagcctggccagcatggtgaaaccccatctctactgaaagtacaaaaaattagctgggcgtagtggcactcgcctgtagtcccagctgcttgggagactgaggcaggagaattgcttgaacccggcaggtagaggtttcagtgagctgagatcccgccactgcagttcagcctgggcaacagaaagactccctctcaaacaaacaaacaaacaaaaatttgattcatctaacaaaaggcagaaaagaaataaggaggaaaaacaagtgagtcgaggaaaacattgcaaaacaaaggtagatttaaatgtaactatatcataattattttcaatgttacaataagtggataatcactgcagataaaagtcaaattagtcaatacaactttaaaaaaaacaaatgttgtttacagcagggcacagcggctcacgcctgtaatcccaacactttgggaagctgagatgggtggagcgcttgaagctcagaagttcgagaccagcctaggcgacattgcaagaccccatctgtaccccaaaaaaaaaaaaaaaaaaattagccaggcttggtggcatgtgcctgtgttcccagctactcaggaggctgaggtgggaggatcgctgaagctcgggaagtcgaggctacagtgagccatgattgtgccactgcactccagcctgggtgacagagcaagacccagtctcaaaaataaataaatacagcctggccaacatggctaaaccccatctctactagaaatacaaaaactagctgggcgtggtggcacacgcctgtgatcccagctactcgggaggctgaggcaggggaatcgcttgaacctgagaggcggaggttgcagtgagccgagatggcaccactgcactccagcctgggtgacagagcaagattccatctaaataaatacataaatagttttttataaaagatataattaaaggatatgcacagattggaatcgaaatatgatatagcttacaaacattacccaaaagaaagcagaggtagttaaataaacatcagaaaggaagtagacttaataaaagaaatattgctaccaataaaatgaatcacttgataatttcaaaaagatcaatcaaaaagacacgacaattctaaacttccattcatctgatagcgttgcttaaaatacgcaaaagcaaagcttgacagtggcaaggagacatagacaaatctacaatcagagttggaggccgtaatgcacgtctctcagcaactgataggacaattagactgaaaatgaaatcagtaaggcaggagaagatttcaacaacataattaaccactggaaataattaaaatttacagccaataactggaaaataaacatcttttcaagtgcacatagacacagttacaggaacagaccaaaatctgcttcaaaaagaagcctcatgcattgttaaagtattgaaatgatctagggaatgttccctgacaatagtaaaaataaagccagatactgagaacagaaggataactacaggccgggcgtggtggctcacgcctttaatcccagcactttgggaggccgaggcgggcagatgacctgaggccaggagtttgagaccagcctggccaacatggtctctactaaaaatgcaaaaaattagctgggcgtagtggtgggtgcctgtagtcctacctactcgggacgctgaggcaggagaatcgcttgaacctggaaggcggaagtcgcagtgagctgagattgcgccactgcactccagtgggggcgagtgtagagcgaaactctgtctcaaagaaaaaaacaataataatcactataaaaatctgaatgtctgccgggcacggtggctcacgtctgtaatcccagcactttgggaggccgaggtgggcagatcacgagatcaggagatcgagaccatcctggctaacacggtgaaaccccgtctctactaaaaatacaaaacaattagccgggcgaggtgacaggcgcctgtagtcccagctactcgggaggctgaggcaggagaatggtgtgaacccgggaggcggagcttgcagtgagccgagatggtggtgccactgcactccagcctgggtgacagagcgaggctccgtctcagaaaaaaaaaaatctgaatgtctgcaaattaaccaagtgtctatgtaatcaaggattcaaaaaagaaatcaggatagaactcagaaactatattgaaacaaatgataataaaacatatataatatcaaaacttgtaggatatttatggatttaaattaattcattatattatgaaaaaagaaagttaaaaagaattattcaccaaagaggctggagggaaaaacagcaatttaaacccaaagaaattacaagaaagggaataataaagttaggaacaaaaattaatgaaatgaaaagcagacacacaatggaaagacccacaggcaaacttttcttttttaaataagtatattgataattatctacaagactgaccaagaataaagagaatcaaaagttgtcaagagtatgaaataggatgatcagaaatgaaaatgtgggtacagacatccaaaatggaataaaaatatactatgaacaactttatgtcaatacatctggcagcttcaatgaaatggaaaaattccttgaaaaacattaccagttatgaagacttaatacagatagtattcccacaggaatggagacagtctgatgctgctgtaaagtcagataaatagaccagtgggacagactgaagtccagaaacacatgcaccacgtctctacggccacccaacaaaccactgagggcccctgcaacttagtgggggaaagatggtcttctccatgagggacatggcagcactgggacgtctctatgggaagaataaaaatactaacattgccccggagttggttcaggttctccggcagcagaaccagaagtgagaagatctccatgtctgtaatttactggggacatgctcctaggaaaatgggggaagggaagtaagatttcaggagagtgggggtttctgtgcaggcccagcttctgcctaatcaatggcaactcttgatcatagatcataagtttatcttgatgcagacaggggagcttggctttggggctccagccggaaacagcagtgactaaagactgtgaaagggatatgaagtccagatacagggtcttcccaagtaccatctcagtcgtggactcttggagacagatgcacactgaggctgggggtggggcacagaggaacagtggtatgacccaagcagacctgggtggaggacctacagtgtcctcagctcccccgacctcccacctcacatcatacacaaaaattcatccaaggtggagcacagacctagatccaaaaggcagaacaataaagctattaagagaaaagcttcatgaccctgaagtgagtaaaaaaaaaataaagaaaaaagaaattaaaaattaacaggacatgaaaaacatcagtcatacaagataaaaattataaatggaatttaataaaaaataacttagttatcagaatataacattaagacagtgaaaagacaaactgcagagtgagagtgtgcctaattacatttgtctggaatggttcctcaatctttccttgacgttcatgacctcgacacttctgattataggccagatctattctcacgatccctcagtttgggtctgcctggtgtttggctgtgcgtttttggcaggatattagtcacctcaggctgccacagctaatatgactgggtggctgaaacaaaaaaaattattctttctcatttctggaggctggaagtacaagaccaagatcaaggtgctggcagatttgggtcctagtgagggctctcttcctggcttgcaaacggccgccttgtcactgtgtcttcacaggctgtgggagagagagaacaagccctctggtgtcttttctcataaggacactaacctcatcatgggggtcccatcctcacgacctcatctaaccctgatcagctcccagaggccctgccgtcaataccatcacagtggaggtgacacaaacattcagtccttaaccggcagaaatatcacagaaacgactccgttcttatcagtgcatcccatcaggtggtgaacagtttcaatttatctggttgttgatgacattcactttgatcatttgatcaaggtgatgcctgctgggcttccccacctgtaaagttacctctgaaggcataaagtcataaagtttctttgtgattgcgatgactctttaggaaatttctttggaactaaagatcactgtggttgttcaactaccagtttattgatgtattaacatcagtgtattaaactcgggttcctattttatgcaataaactgtaatcttgactaacattattggctttgatgctcaagttgtctctggcgtggccggtgggaagcgactcctgcgtgttttctgcatgtcctcgccctggctcatcctgcccctgacctgtctcagcctggaatcagctgcttccccagggagccccgggtcctgtcggtggtgagtggtatttaggggccagggtctgccactggggggttgctgctttcagagcctcttagaggaaggagctggagaataaatggattcctccaactccaatccaacaccacaggctgcgttctagtttcatccctttcaatatttgtcactctctttgcccacagtgagaaagcagactcccatttacttcaatatctttacttcttctaccgaccccctgggtgtaatcacctccctcccattgccactgcccatctccccgcagatgcccttctcatcaggcatggctctggccccctccttgcagcccctcctctccgtgcccagcctcctgcccccctcctcgagtgccttccccacagggatgcccccacattctcctctctgtgcagcttagttcacaataaaaattactaatcaccactgctcactttccattcccagagccacttttcttctggagatattctttctatgcattggaattacttatgaataaatataaggctaatttctctcagagatattacttgaacccaaagatgttcatagttatttattttattttcatatgcatatgaaaatatgtcagtagacatttgagttatttcccattgatggcatttatacataacactgcaatatataaaagacataaatattatacagaaaactacatcaagcataaatgtacaacttaatgacttttataaagcaaatagtcatgcaaccaccaccagcatcagaaaacggaaccttcccagcaacccagaagttgccccacctgtgctcagatttgtcaaatgcatcaacgtttttcattatgatcactctatttgtgtcttgccgagaaaagcagtaaccaaatggaagatgttggtaattgtgactatattaaaattggaaacttctgtctataaaaagatgccactaggagagcgaagaggaaagcctccgagcggaagaaattatctgcactgcgtagaaccatcagaggacgtggacacgctgtcctgagagaacccctagaatcacggagaaactgacagcctggtaggaaagaaatggtcaagacactgaaatagtcatttcacaaacaggaaaaccaaatggccagtctgtgcgcagaaaagacgctcgacttcctcacccatctgggaaacacaaaccaaacccaccacgagatactaccacatgttcccctgagtggcaaaaattaaaaaaaaaaaaaaaaaaaaaagactgacagcaggtgcactggggaggaaatgaaacggtgggaacacacactgctgggggaggcgcagccatcttggagggcgggcgtcgcctgctgaggtggaggatcagcagacttcataattcggcaatcccactactaaggatctgcccgagagacatgggttctgggggccccgagcagcacacacaaggatgcttgcagcagtggtacccctaaatgccaagacggaaaccgcccaagcgtttgtcggtggtaaaatggatatgtacgctgtggtacatgatgcaatggatgtcagtctgcaatgaaaattcataggcaccccagtgaatcgccgggggtgactcagcgcaaaacaccaagcacaaaagagtgcatggcccggttccattcataaaaagttccaaaagtcaggagcctgtttaacagatgacggcgctgagggatgcactcttaggtcgtaaaaatgtacacaaggacttggaattgattgctgggtgttgatcagtcagggtggtgggtcccagctgggaacgaaggggtggtcagaaggagcccccgggggcttccaggggtctggacaaagtgctctttcttgatattgtatggttaaattgatgggtgattgctttgtgaagattcatcaagctgtacattttcaaaaattttacttttaattgactttgggcactattctgtgcgttatatttcacatttaagaagtttttgtttaaagaaatcctttctttcccataggtcatgaacagcccattaattttggctaaaagtcatcgttgctgctttgaaaataatcggttttctctggctgcttttaaggcattttcctctgtgtctctggtgctgtgcagttccactgtgatgtactcagccggggatttactgttctatcgtgtgggcttcactggtctcaaattggtgggttgatggagcttatcagctgtgggccattttcagatgctgtttccagtgactacttctgcttcttccaccatcacagcctctctggccagtctcccaagagcacatctcccgtcctggctgcgagcggccccgaccacccctgcaaagcctccagctcagcaggtggatgtgaagtcggggtggggaggagattcctgtcccttttctgtctcagaacagttcccctctccgcccagtccctgtcaaggacagttcctctcatcctgaggttcagtgggccctgtggttttgtggggtcagagacttccctggccccttgtgcccccatccatctgagctagtcagctgcatgctatgggaggaggaccccagggagcgtatattgctggtctctaaagcccccgtgggacagctgagcacatgcaattaggaaagaatgttatgcggatttccagtgtctggagaagaggcatcaagctccaccacctgcaggaatgggcagtggcttggcaagggcaggggagcctggagagctctggaccactgtggtcaggggaagggaggctgggggatgaccctatagcacctcctccccaatgcacacacatcttacacatgcacacacacacaatacacacatgcagacatacacaacacacacatgcacacagccacacgcagcacatatacacaatacacacatgcacagtcacatacatgcacacatgtacacaaaacacacacatgtgaagacacacacatgcacatatacataatacacacatgcacacagtcacacacacatgcacacagccacacacagcatatacacaatacacacatgcacacacatcttacacatgcacacagccacacacagcacacatacacaatacacacatgcacacagccacacacagcacacacacacaatacacacatgcagacatacacaacacacacatgcacacagccacacgcagcacatatacacaatacacacgcacacacatcttacacatgcacacagccacacacagcacatatacacaatacacacatgaacagtcacatacatgcacacatgtacacacaacacacacatgtgcagtcacacacatgcacatatacataatacacacatgcacacagtcacacacacatgcacacagccacacacagcacatatacacttatgcacggccacacacgtacacacaacacacacacacatacatagtcacacacatgcacacagtcacaaacatgcacatacaacacatccacatgcatgcatacacatgtacacacaacacatccacatgcatgcatacacatgtatacacaacacatccacatgcatgcagtcacacacactcacacaaagcacatttacacacatgcacacagtcatacatgcacacccttgtacacacaacacacacacatgcacacaggcacacacacatgcacacataacgtgaatatcacgtgcagtcacacacatgcaaacacacacacagttacatacattcaaacacatgtgcacataatacatgcatgcatagagtcacacacacatgcagtcacacacaacacatacatgcacacagtcacacagaagcagtcacacacacatgcaccacatacacagacaaaagcacacaggcacacacactacacacacacacgaacacatatgcacacagtctcacacacacacacacacacacacagatgcacagtgaggctcagcctttacagtcccctcagtcttgatcctttatttatttatttattgagacagggtctcactctgtcacccaggctggagtgcagtggtgcaatcacggctcactgcagccttgagctcctgggcacaagcaatcctcctgcctcagtctcccaaagcactgggattataagcatgagccactgagccaagccccaatccttttaaactggcctgttgggctggggtcccaagggcagtgaccagggcagcatggggagaggggagggtagggaaagtcacctgactccccaaagatgcacaaatatatggaggcacacagggagaaggacagagagagtgagagggggattgattctttcgttcgtacaatgtttattgaatgtcaaatgtctgccaggcactgtgcaaaatcacataaaaatgaggtgggaggagtgcagtggacagggagcgccagcaggtcaggcatgagtacagacaggcaaagacacagacttcgaagccagagaccagcgccggagctgatgcctgcttgcctgcctgctgagggcgagaatgcacctgctgtgggggcctgacctcaccgtggacacccaccgcgggagcaccagccctcccccggtccccagggtatggaagccaggggcctttgtagccccacattgcccggagttggatacaaacatcccaagagctaggggtgcctttactggctggaaggtgaccgttccatttccccaacatgaactcagaaagcttcagccaggcgcaggaacatcccagggaaaagctggctgagggcttccctaatgcaggggtgtttcctcctggcccctgtcccaggcagccaccagcactgccaccaaatgtttaaggaaaataggcaaagaaagcatttgcccctctactttcttccctcccaggcataacatggaagacacctggacactggggttggccttagctgccccaggaactagaagccaggaccctctctcttccaaggcccagcagcctctgccatcctcttccagcccaggcttgtccaggaagcctctgggtctaatggtgcaagcatccgaagtgcccacaaccaggctgcccacagtctcggcaaggctttcagccgcccctggcacttctcccaccatcctccaagaggctcaatgacagctccgtgcagccccgcatcagcctcgcagcccgccgcctcctgccctcccatcccaccactgcctgggttcaagggtcagtgctcaagagtcccacatggtccccaccctgtcccctctctcgactctgacccccaagccctcccattttgaggtcacacactcccctcccctcttccctgagcaccccctccatccacctctgcctgggctgcaccccaggcccacgggcaggtgctggccaccctcccttcctctgcaggtttctgggtcaggactgtgaccagaatcttgctcgctgcactcctgccacggctgtgccctgtcccctgcgtttgtcccatctgctgctagctcaaggtcctcccttctgaggcaccccacgtctccagcccagaaggctcttcccttctctgcttggtatcttaaagtcaacatcttcttctccctggtttcctgcccttggtacacagccctctccactgggctgtccaagtcaagggacaggaatcctccgggcttctcccccaccttaccttccaaaccagtcaaccccactgactgcacagctgccacgcaggcgccctgctgtccagccctctgctgccagccccagcccaggctcagctccctccacttgcatccacctctgtccactggactcccctccaagctggcctcgctaccccagagggcacgagcttcccaaaacatgaggcgcacggccatgccccttccctgggaaggtttgcctgccttcccacggaatagcaagtccttcccactgcgcacctgagctgcgggatttcctgcggtttcccagaccagctgggcacccacagcgcgaagctccacacccatggccactgcctcggcttcttctccatcttcacctccccacctccttcgtgtgcctcgccgatgccctgcacttttcctagtgcaccctcatcagcttgtcttcagggctgaccggcacccccatgactgtgcctgagttccaaggggacagagcccatccctgcatcctgcctcccacattgtggactgcacatgccatgggccgtcagggcgctggcctcggcctttgaaaggcatcttccgttcattttcacagtgattatagaagtgaaaggccattttcctattttacagctaaggagatgggcacgagagaggtaaaggggcctgtccaggtcccagagccctccaggagggacaggggttagccaggcgtctatcgtctctgcctgctgcttccttccgagtgaatttgtggtttcctttgctctgatttggccaatgcaggcagctgaggctgtgccccacccccttccgtccccccaggaggctgcctgaccctctaagtgactcgagtttggggtacctccaccaaatgcccccccttcccattcactgtctggcacagctgtgatggagcagaccgtcccctgcagtctgttgggacacagcacccggggccctgaccgccaggcagttcctgagggaggattgcaaagcctccagacttctccaggccctgccagggacacaaagtagaaggctgggctggagctgcatgggtatttcattgaaagttcacagacacaagggctctgagcggggtcacatcgtggaggaggcagggtcggggagcacagagtgagtcctcccaacctgggacaattttgcataagcccttcctgctaggtgtcaggtccaaggggccccaggagcctgggaaggggcacgtgagggcagggacacagacgctggaagccagggtgcagcagcgaggggagaagcccccaggccccagacacaggcagggtggaggccaggaggcggagggggtggactgagggccaagctcactgcccccttgctgtactcagcttctgatggccttgctgcccagttcacagctcaagggggccccaggacaagaagccctgccctgccccaacctcatgggatcctgcgtttcagggaccatgagaataaacatgtctcagtgcttgtctccgccagcagccgtgcctggcgggccttagtagtcggtgagggggtaccgcaggaagatgaagacgaggatgatgcaggaggctgccagggcagaactggtgatgttgaacagccgggccgtctttgcatcctccacggctccattcaggtcattgagaagcttcttgtctcgcacctgaagccgggaggaggacaggaaatgggcagtcagccagggagcagggccttggagcatccaggagcccagcagagccggtgccacagtgctcagcacagtaccagtgctttgtttccgagagctgacgaatgaacgatggttctagaggaacatgtctctgccctggggcactgtacacggatgaacttggggcacgggggcgtcatgtctgaaacctctcagccctcaactggtttataaagtaggtgagatgtatttatatatatagagaaaagcaaatatggtaaaatgttaaaaaattggggcaactgggtgaaggatataaagaaattccttgttttttctttttgcaagttttaaatgattaaaataaaagaagttggcctcagagaggatataattggaggatggggcgacacaactgtctcctaatttgattggttctgcctcgtttaaaattaactgggatgccttgaggatgagcgttgtgcattggcaggagagacagcagtccacagggcctttggggaggaatattaaggcgaaaggagtgggctggcactcaggaagtcttggggaggcagtggactgagctggactcatttccaagaggcaaccttcattcagaatgaattatagggccctcccctcctcagcactctttccttctatcacatccacaaatatgtgcgtgtttgctgtaagaagaaaccaagttctaggatgaggaagggaaggagaatggaaagagaggaagacaggaaggggcaaaaagtctttgccttagtagattggagctgggctgaaagaaggaaggtgggcagatagatactggggctgactaatgcctggatccctcagtgtgcaggttaggcagatggacaggagacctaggtcggaagactggatggacagaggatagatgtgtggtcagggtgatggatgtgtaattgagtgggagaatggaagcataaatggattggcctgtgggtggatggatggaggaggcagaatactggaaagaacaaagggagaggagagaaaaaagaagatagagggagtggggaagggaaagctagaacgcaattcagtggagtggaatggaatggaatgaagtggagcaaatgcagtgaagtgaaatagagtggagtggatggagtggagtggatggaatggatggagtgaatgcagtgaagtggatggaatggatggagtgaagtgggtggaatggatggagtgaagtgggtggaatggatggagtgcagtgggtggaatggatggagtggagtgggtggaatggatggagtggagtggatggaatggatggagtggagtcaatggaatggatagagtggatggagtggagtgaatggaacggatagagtggatggatggaatggatggagtggagtcaatggagtggagctggaaaaaagttggagagggaagggaagggagggaacaagggcaaatgggcaagtaggtgacttggaagataaattgtacagaacgtgctatcaaaatggagagattgaagatgggaagaagcaggtattgaggattcagggtaaggaaggaggcaggaagaaagtctatgctcttatcgggttcttatgctagtggttttggaggaaactgacatctgcaatgaaatttgtattcctttataaggactgaatgtgtcacccacttattgaggtcttatttgatgcctttgctaaaataaagttgtataactttctccagaaagagctattacatcttttgttagacttagtcttagtctatttattgtttttattataatgtaaaagtatattttaaaattgcatgtctaactgattttgtatccagctaaactatcatattgtactaactgaccacgtgttcttaataataaatcatatctacagcaaatactagtatttctatttcctccttgcagtctactcctagacagcacagcatagaggttaaagcacagatgcagaaacactgactggatttcaatcctgattctgcgggtcgtagactgtacagccttaggccagctaacaacttactcttctgctcctcatttcctcatctgtaacatgaagatgacgacagcgctgcctcccagggttgtgggaaaggcttaatgaattgatggatgtgaaactccaccacagtgcctgggccaaagtaagctcctctcatggaggcaaagaagattccagagcgtttccagacagcagcaatgaggacaagcagctgagtctcattcttgacctcaaggtaccaggaaggataatgctcatcttatcattagaggtctatgattgcgttagaatttccacaagataaactattgtttccttctctaattcattaatatggtagattatatttattgattttcttatatcaagacaactctgaattcctaaaaaaacttttggtcttgatttctttgttggatacttggagtgaggaataacgtggcagagggaggatgaaacactgggtgtcaaaagcggatggagcggagggcaggaggctgaggcagctggggtattgggtgcatagaaaatggcggccacagctaaagaagatagggaagaggagggtgggggagtgatctaatgatcgggaaggtgggtggatgaagctgaggggttatacggatggagactgggtgtatgggacagagaaatggatgtagaaacttgtgctgggtggggaggagggctggacggatataaaatgtacgttggatgagtgggacagggagagagctgaatttatgaatacaatgcttcttgatgtacaatggggctacagtccaacaaacccatcataagtttaaagtgtcataaggtaaaagtttcatacgcattttcgtatgatgtgtttttcacaagcctggtaagctgaggagtgtactgggtgcctatggctttcctgccattgtgaagttgaaaaagcatacgtcgaaccgtcataagatggggaccgtctgtatatgctgggtggggtaacaggtgcatagacgaacatatgaatatatgtccaagtggacagatggatatgcaagtgtatgccacatgggtggggcatctgggtaagcgggtaagtgaacggctgctggatgggaggtgatgtgtggatatgtaagagcatgttcggtgggcaggacaggcaaataggtgaatacacgagaatgtgtgctcatgtgtccatgatggcttggaccagggcagcggcagagaaggtgatgagacagagccaacttctggacatgtgttgaaggtggagctgacagtgtttgctgggatcaggcttgcagtgtgataaaaagaatggaggccaggcatggtggctcacgcctgtaatcccagcactttgggaggccgaggcgggtggatcatgaggtcaggagttcaagaccagcctggccaagatggtgaaaccccgtctctactaaaaatacaaaaaaattagcaggggcaggcacctgtaattccagctacttgggaggctgaggcaggagaatcgcttgaactcggagggcagaggttgcagtgagctgagatcgtgccactgcactccagcctgggtgacagagtgagactccgtctcaaaaaaaaaaaaaaaaaaaaaaaaaaaagaatggaactccacgtggtttgaatgaatggacaggtggttacaggaatataggaacggatgccagactggaagggcaggtgcacagatgggtttctgaatgcacgctggatggctggagcaggtccatggctggatatagtaacggatgctggatggctgggacagatccatatgctgaatgggtggaacaggtagatcaatgaatttatgatgtgttttggatggctaagattggtggataagagaaaggaaggagggttgttggtgtagtgtagaccactggatggtagatgggtagacagattccttaatcaatcaatcatcaatcaatatttacttagtgtctgctctgagtagttgctgttctaggtcctgcgtatatcacaaggaataaaacagagtctctgtcctcacgcagcttacattgtagggagaagatacagaaaataaacacgataaataagtcaaatatgtaatgtgctcagtgtgctaaaaagaaacctgaagaggctcaggggaacagagagtgctgtgggaggtgcaagtctagcttggtggccaggctcaggggaacagagagtgctgtaggaggtgcaagtctagctcggtggccagggaagaccttgtggggtgggaggtatttgaggaaagatcggaagaatgtgacagactcggccatgtgttcatctgcagggaggcatgtcctgggagcatagagctgtctgtgcagggcccggtgcttctgaggactaggtgcagagtaggggcagcagatcacagagagagaaggggaggacatacggtcagaggagaccatccaggagcacggtgcaggctctgtgggtgctttttagtcatttagagccggaaagatgaacgtgatatgacatatgtgaacgaggcagtgctggccgctgtgtaagaacagatggcaggggccaggcatggtggctcacgcctgtaatcccagcactttgggaggccaaggcaggcagatcatgaggtcagaagtttgagatcagcctgaccaacatggtgaaaccctgtctctactaaaaatacaaaaattatccaggtgtggtagtgtgtacctgtaatcccagctactcaagaggctgaggcaggagaatcgcttgaactcaggaggcgtaggttgcagtgagccaacattgtgccactgcactccagcctgggcaacagagcaagactccatctcaaaaaaaaaaaaaaaaaaaaaaaaagaacagatagttgaacaggcagagagaggtggattgaatggtccaggggagggtgagggtggcttggaccagggcagcagtggtgaaggtagtgagacctgaccagctcctggacaggcgtggaaggtgaagctgatggtgtttgctgggatcaggtgtagaatgtgataaaaagcatggaacttgacatgatctcaaggtttttggggtttgatcaactgaacagggagttgtagaaggctgcaaaaggaagactcgtttagcagttcaatttctgacatgtcaaggtaggaatgccctttagatatatagcagatatttggcatagcaatttgtgtgagtctggagttcagagatgaggtctagggcagagatataaatttgagaagcatcggcaaaaagatggtatttaaaactgatatagtttgaacacatgtccctgccaaatctatgttgcagcgatccccagtggtggagagggcctggtgggaggtgtttggctcatgcgtgtagatctcatggcttgatgctgtcctcaccatagtgagtgaattcctgagagctggttgctttaaagtgtgaggtgcctcccccttatccctcccttgtgaggtgcctcccctttatctctcccttgctcccactcttgccatgtgagatgcctgctcccactttgccctccaccatgactggaagcctcctgaggcttccccagaagcagataccagcaccatgctgcctgtacagcctgccgaaccatgagccaattaaacctcttttcttataaattactctctctcaggtatttctttacagctgtgcaagaacggcctaatactaaaaccatgggactggatggggcaccaagggagtgaacatgaaggaaggagaggatggagagctgagccctggagccctgcagtgtcagaaggttagggagtcaaaagcaattaggaaacgggcccgagaagagtgggccaagaagcagggaaggcaaaggggcaccagggtgctaggtggcggaatgggctgaaaagtacaagcagaggtgggacatagaggatgaggcagccatgtgggggcaggggagatggatggtgctgggtgggtagaggagagggaggaggagagcgggagagagaacaggctgatggctgggagttgggtgagtccatcgaagcaagcaaggaaggaaaatggaaggacattctgatgatgaattgagggctaggtggccaggcagttcttctatgactgtgaatattgatggatgacagatgggtgaatgtgtgaaggaaaaagagcaggggtgggcagatgtgggtacagagaggaactggctctggctatagagatggatggaacaggtcactggaggaacaggggagaggaaacacaaggaagggatgacatataagtggatgaaagggcaatgttatggtttgactgttcatgtcccccaaattcctgtatggaaatcctaacccctaaagtgatggtaggaggtggggctcttgagaggattaggtcatgcgtgggattggcacccttataaaaggggccccagggaggccctcggccctactggcaaatgaggacacagaagttgacagcctgcaacccagaagagggtcctgatcagaacctgactatgctggcaccctgatctcagacttcgagcctccggaacagtgagaagtaaatacccagtgtttataaaccaactaatctatgataattcattagagcaggctggacaggctcatgccactcaacttggaggcaggtgaatgggatacctgaataaagccaaggaaggaaagatgggatggatgtgcctggaaggtcagatggtcaacgagatgagtggtggggtgggtggacacatgcctgagaggaaacaagagagaatggacattttacagctgaatgattagctatattagtaaagcacgtaggcggatggtagaaagaatgaaggggatagaaggggagaatgcatggccgaaaagtggggcaaaagaaaggaaaagaaaaaaatgagagggaaaagaagaacgtgagaaatttatgcatgagcggttagagacaaggtggatgaggaaggagggaatagagaaagtgacagtggctggattgagctgacagttggggtgagctgaggcacgctgagtatgaaggaggcactcagtgaatgggtgagtgtgactcagctaggggagcagcaggaggaagggcgggtggatgtcttgaagggtgaatagatgtgttgccacatgaggtcacaggatggagggatgattgggtctattgacaggtagggcttggaaggaaagtgggcaattactgagaaagtgagactagatgaatagtttagtgggttgatgcataaggttggtggggacaggatgggagagcagggcagggaggggagcctgaatgatcatgtgtgaacacaggtggatggaaggttgggtggctatttggaggggttgaaggaaatgtgggaggatggattgaatataagtttgggtggatggacggagggaggatgaacagatgatggatggatggatggacagatggaggatggatagatggatggaggatggatggatagatggatggaggatggacagatggaggatggatggatggatggacatatggatggatgaaagataaatggatggatggattgagggtggatggatggatggatgaaggatggatggagggcggatggatggatggatggaggatggatggaggatggatggatagatggatggaggatgaatagatggatggatatggatggatggacagatggaggatggatggatggacagatgaagaatggacaaatggaagatggatggatggacagatgaagaatggacaaatggaagatggatggatggaggatgaatagatgaatggatatggatggatggacagatggaggatggatggatggacagatgaagaatggacaaacggaagatggatggatggatggatggatggaggatggacagatggaggatggatggatgaatggatggaagatggatagacggatggatggagggtggatggatagatgaaggacagatggaggatggctgaatggaggatggatggatggatgcatatggatggatggacagatggagaatggatggatggaagatggatgaatgatagatggatggaggatgggaaagataaatgtgtgatgctgatattcagaaaggagtgagtgggtgagtgtgtacatccaaaacccaacgcagaacccacccacctaacctgttctttctgaccgccctgtcactggaaggtctcacagcctcctgggctcacatctagcagctgctgtgtcctagccacacctgttcctcctctcccacccccatccccagctcgcaagctctcccacctggaccaccacactgggacttgaaccttctgcctcgaggcttgtcttgtctccttcccctacactggttgcagatttcatggccctgatcatatccttctctttccatggctcctacagatgagagcccagcccctcacgaggttttcaaacccgttcaccgcactgcctcaggcactcttccaggaatgtcttccatctcccattgaggacaggggccttgccgaccccctagactgccccacctacgtgtcttagtttatgccattttccccgcctgaaacacctttcccctcaccaagcttcaaggcccagtgaaattgctgcctccttctagaagttttccagcctcaccccaaactgggaatgaagtattccttttctgaaacactgtggtgcttcttccgtctcaccatgtgtcctctgtccacccacccattagacccacatgtcctgacccatctgttggccagctctgccttgggcacagattggctggggtgagcagatgtggctggggcaggactgtctctggaggctttgcagaagagagacccagatctcacaaaagctctccaggccgaggatgtgcacatcgctcacatcacatttgccgagtgaccggggcggggaaccgctgaggccagaagggttaaaaaggcagcttggatgctgagatgagacgtttggccatcatccagctgaccgcgggagccagtggtcatcaggagacagtgtgtggaggcggcatgaatggagaattgactttttgtatctctgccttccccggacaccaggctgtgcaaaataaggcttcaatctctgcgctgcagatccagcctgcgttgagccgaattggcccatgtgggtggggggggtggatggatggctggacgggtggatggacacgtgggggcaggcaaggacacactgtctagttcataccactgcatgcgggcctccgccctgctcacgtgtgctggcttgaatgttgttttgtttctatttgttttgtgaacagatgagggaacaggggctcagtgaggcaagatggcttgtctgtcccaagagctcggattttagccaagaccttctgaacctagggccaccccgcgtccttggtgtagggtgcaggtcaggagacctgcagctgggtgaccagatggatgcattcccaggcgtggggtccacagccagccagttccgtcctcccttctgcccaggatggagacaggtcaccttgcacccactcccaggtatgccccaaagcctctctgccctggctgcccccgcccaccgcaggaaggacacaggaggagcaggcttgggaggaggtgtaatgagccgtccctgaccctcagaagggtcaacctcacaccacccccaacccctgcagaaacccggcaccatccagaaatccctgacctacctacaacccgagccagatgggcctgccccatgccagccggccagccacagcctgagccaagcgggaggagggacagcttccggacgggagcccaggcagccagacccatgtccgcaggctgttggcagggcacagagagaggggaggcagagctccaccagctgcagcttcagccccccaacactggagctttctgctcaggattggtctggggagccacagctggagctggtcggaagcatgacctccaattccaggggcccttttcctttgttgcttctacacacacacacacacgcaggaatactcaccaccacacacacatgctctcacacacttgtgcacacacatttacacgtaccatgcacactcacgtatgattacacacgcatgcacagtcaggtacatacatcacacatgcacacactcacacacacttgtgcacacacatttacatgaaccacacacgtgtgattacacacatgcacatgcaggtacagacaacacacaggcacacaccctcacacacttgtgtacacacatttacacgtgccatgcacactcgtgcgattacacacacatgcacacactcaggtacatacacacagcacacatgcacacaccctcacacacccgtgcacacacatttatacgtgctatgcacactcacgtgtgattacacacacgtgcacactcaggtacatacagacagtacacaggcacaccccacacacacttgtgcacacacatttatacgtgccatgcacactcatgtgtgattacacacacgtgcacactcaggtacatacagacagtacacaggcacaccccacacacttgtgcacacacatttacatgtgccatgcacactcacgtgtgattacacacgtgcacacaggtacatacagcgcacatgcacataccctcacacattgtgcacacacatttacacacaccatgcacacatgcaattacacacacatgcacacaggtacacacaccacacatgcacacacgccctcacacacttgtgcacacacatttacacacaccatgcccacccacgtaattacacacatgcacacatatgcattcacatgtacacacatgcaaatacactcctgcctacacacagtcatacacatgcacacacatgcacacacaaaaatatatgtacacactcatgcacacaatgcattcacatgcacacatagttacactcacagtacatgcccacttatgcaattacacgtgagtacacacatacactgacacgtgctggctcacacacaggcccctgtgtcagagcccagggatggatccgcaggcccgaggttgaaggtgcccgtgccagtgggcaacgccggggttggcaatcatgatgagtcaggagcaggaggggaacgccgaccgcagttgcgatgccgggcggggtggggctcgagctcaaggatggagcagaggcgaagctggccaggcgtccttcctcccagccagcctctgcccagcctcttctctccctgcatcccctgtcttctcccccacccggcagggcagctgcattggtggagtacatctggccttggccactcaagtctgggctggggaaatgtgatgatgaggctaaacgtgagccaagcccttccttccggtgcgtcggggtggggaggagggcaccggggcctgccctcgccctcacgctcccttccccaggaagggctccagcaccagacacattgacacacggctgcccctctcactgtgagcccatcacagcctccctcccaccatctcagtccctgctgctccaccttgccctcagggggacagggtcatgtctgcccagcacctgctctgctaccagccagctcttctcgcagccctgagctggggaggtgcaggacctgtttacacccctcttccctgggctgccctggccacccaggtctggtctccacgcagggcttggcagagctgtgtaagcacctgcccttgggctccgggtgaggagctggataagaaggtggcccctcttcctttccataggggtaggattccaagccctcttcagccccacgctggccccatccctgcacacggagaagtggctgctgcccaggtctacgtcccatgtcccctgagcctgagcaaccccgcccccctcaacccccgctcccagcccctcctgcaggttccgctgagctggctgagcagaaagccaggccctgatggctcaggagagggaagggcagacccctgcccgcccagacctagccagtaccccgacctctctgggacccaccatcaggacccctcactgtcctttgatcccttggcccctcaactgcacctgttctacccgtgtgctcccctgagagggagaggggccgagcgcccacagccagggactgtcctgccggcaccacctctctagcccgcccttgccccctgccaccgcccgggctcactttgagggagtaggccaaggcgatgaagcccaggcagcagaagttgaggtagacgaagttgaagatggaccacaggtaatagtcgttcacctcggtggtgtccgggtagacctcgatgacggtcgtggggttggtcatcgtcttcttctcggctaggtgcttgcaggcagggggcgcgccggcagcccgcacgctgtcggtcttgctgctcttggactccatggggaacagtgtgggcgccatcgggggagaggccgagggctcaggggcaggggccgccggagcctgcagggcagggggcttggacacgcaagcgaagcagcccttgggcgaacctgccgggggcctcggaatccagaaggccccgtccagggggactcgggcttcctgggcgccgtccgtggtgctggccgggtctcccagcggggctgggcactggccggggccctgggcctggagaggagaaagtgagagcaagctgggcccggcctaccggccagcacccaccctcacgcccagcagctccgagaacagccccagtggagacggaaatccctgcgggggccgccagctgccagcctgccacctgcctcccccacccgccccgggcctcggcggccacggacgatgccaaagcccttcgcagcagccttggcagggacctggggctttcatcacttcgccatctgcgcataaacactcacccactgacacacacaacagcaccccccgccccgaagcacaccaacgctgagactgacactgttgcaaaacacagagtgccccagcaccccaaacaaccccgcacacacggggcgccggacccacagcgacgctgcctcagccgccaaccggcagagctagcagagcggccaaagcacctgcccacggcgcccgcggacacccgataccgccacgggcaccgccacgggctccaccgcgggctgcaccgcgggctctccagaccccggggcgcacccgcgggcgcgctcagagccattgacgagtaaacaactccccacacaaggcgatgcaggctcagccacgagcaccaagaaccggcacaggtgcggggtctccaactcgtgcgcaccgccccccacctccaacctggggaccccaagcgcgcacacttgcccggagccacgcacccccgggccatacatagacgcacaataacaggctgtgaaatgaacacttctccaacgaggcaccaagtcgctcgcgctctgcgccaccccgcgttcccagctcccgtgcggcgctcgccggggggtctgcggccgaggctctgcagcccccagccccatccgggtctgccgcagccccccggacggcgcctcctcacctacaagcgactcctcggcgcgcggccggaccccctgagcctcggtgcgcgcgtccttccgccgtcccgcgggccgctgtctgtccactgatccgcctcccagcggcccaaccttgagggggtggggagcgcgcggggctcggcggcggcgccgctgcctcccccgccgcctgcgctccctccgcagcgccagaccggccgcgcggctgcagcccagagcctgactcacggcggcagcgggcacagccacctccccgcctccgcctcctcctgccaggagggtgggggcctcggaagccgcgaccctggggagttgcaaggtcccgcagggatgggacccctacagcccccgaccagggtgtccgcgccacctccatctccccggacccactgcgtcttcctccccaccccacccggccccatccctctcgcggagcccccagccccgtggaagactggacgctcccggaaccctccccatctgcctccccaagagagaccctcttcctcttcccactctccccatggcgctccaccccagcgcctgggccctgctgcctccagggacccccgcccctgggtcctgcccttctggcctgttgactctcagttccagcagctcagtcccctcctgacgaagctccagtcccctgagccccagcaggccccctacctgactgcccgtctctgccccatcctgtccctaaccaagtccacaaggcccccaagaccaccctccagtcccttccctccttagcccaccaagtccaggccttccggtaagtttcagcaccccctactctgttccttcctggctgagcccactcctgcccatcggagctcctgccccctttcctggagtctgacttcacccagccggggccccactccagttcactcccagagtctgggagaatgtggcctctcctgcgcagaccccaggtcatgctccatctgctcgcagggcaaagtgtcccgttccgagctctggtcctgtgctgaggtcctggctgctaaggacacttgtctccctggaggctggtttactcacctgcccacagcctctctgtgatccctaccagcccttctgagcctggtcccctgaggatactttgttccctgtgaatcatttttcctgaccaatgcctgtcctcccagcctcagccgcctccgctaccccaccacatcctcactctcacggtatgcttgacgccagctgatcttccatccccataacagtccccatgagttcctccccatggagaaaactccagccttccctccctccctccaagtcccccacttcaccacgcaggttccctgagctgggtcctcttcaccaacctccagctcccactgagcctcgaccctctccaaagtcccccggaagctgaggatgcatggcggcccccgttttccctccctcatctctctccaagccccatcctcccatgaaactcctttctcctctgccactctcaactggcctcctgtgtctccgcaaccctctttcctgtctggaaggccagtcctgcttggggtcctgtctgcctgcctgtgcctgactctgaaccctttctctccccaaacctctgttctgaaccctaatcccctggaaaagcccagccctctgcaagcccctcctctttccagcctagtccccgcccctcatgcctgggctgacccgggcacagtgttatccacagcacgccaggaacccacagcacaaggctgatcttaaatgatgttgataaaccctaacgagcaggaggggtcatgaagcatgaggagcctcctcctcgtctccttgggcaccctggccatgctctccctggagcccacaggccgtgggtggatggggcctgtcggagaaccagggttccgttctccctccccaactccctcctcctttccaagggcctggcccagggaaaactggacccggtgtcctcagacggggcctgatcccaggctgagtgtggcctgtgtgccatgcccccatgtctccccagcatctgagctgggcttacccggccagccaccaccttctgggagaccctggcctgccacacagcctctgcccagtgctgccccaccccagtttgccctgaaggcctcaggcagtgaggaggcctccatagcaggagagggttgcctgggcccgagggtccagggcctgcccagggtcactgggtaggtgacaggggagccagggcctgctcccggcctcaggccaccttggggctgcctctgaggccaggaaacaccactgagagggagccaggggtcgcagggcagagccagggccgagccaaacttggcacagccagcattcatgtgactgttggtgggctccccaagggcctgggctccagcttcccctttgctaggggtttctggttacaacccacagtctagacagggggggactccaggctcagggtccagtcaccagctagaaaaccacggaggaacccggggtcagactccagggccccgagaatcctgccgggctggagggagccctcggagcaaccccagggcagcagccatgaagatgggagctggacggagctgacaagctgcagaaggagggagatggggagagtgggacagggcagggacaacagggtatggctgcctccttgtacctctctgccctcccaggcctcagtgcacaaagcatctgatgacaggacatttgtctccccagaagccctgccaggccctgcagagttctgcccagctctgctcagatttcaggcatgccaaacgccaggcatgtgtttccaagcctccgtgccaccctgggtaaatgttcttgctccaggtgtctgccgtagcatggctctggggtgaaagccctgcagccccttgggaggaaggccaaggcagccaccaccctcaggcagaggcatcaagataatggcaaatgtcacatctgcctcatcttctaacctgttggggtggggctcgagggggctctaagtgactccagagctactgatcccaaaaggaactctgctcccaccaccacatgcccacaaactcctacttacctattagaaccccaggggctgctaccactgcatccgggcacacgctcccaacccctcccctcccagcggaacaagcgcaccgcgttatcagcccggggatccgtgactgtggcagctgtggctggaggggacttctgagtccaatccctgcaaccagggaccctgggcaggcttgcttggtgccagctcagctcactgcacacaaaaccgcttctagggcctgggaggcaagaaggcccagctaggccagcccccccacgccacctggggccatttatttcccgggacaagagggctgaggagggtgactggtaggcctgctctgagggtccccgagagcagaaatagcctctgttcgagtgccgtggctgcctggctgggccacctccctgaaatcactcctcaaggctggcactcacactagacaccctgaaaccccagccaaggccacatcctgccggctactgctccagacctgggaacaagtcagtccccgctggccgaccaggctggagcccatgggctgggcagggcagggcagggggccataggcccggggcaccccaaatgcttgtcccggtgctgccgagtcagctgccgtgctggcttcgcactacccaccctccttccccatcccaagttggagccacccctgaccaggcacaagagcacaccagcacagaggggaggccggaggccaacaactgtatttccatgtcagctggggctctcagccgcccaaggggaggacaacagaggtcagctgcagaggaaggctggcaccagcccccaatcccaaccccacctccaggccaatacatgcccctgggactggctcagtcccagcaccaccctgcaggctccaacaaggtgggttttgtcccctctcactccttccagctcatcctcaggcctctagcggcctcatcctcaacgggcccgggacactgaacaggtagggtggcagagcccagctgggcccaagctgggcagaggggccctcaggcagggcaggtttccaagggagggcccgggaggacggcctggtgtggggtaggggctcagcccagcgggcgctggtagggccggggaggggactccctggagatgaagggagccccaggatacacgagctcggctgccaagcttgggtggggtcttccaatgcacgaaacagatctgtgctctggatcagctctacccccaccaaacagatggagagacagacaggcaggcagcatttctgaacccagggaggggaaaaccacagaacaaaacagcaagtcgggcttgggccgccggcttccagggcgcccaggacagtgggcgggcgagtgtgtgggtgtgtgtgggaggggccgctgggccaggggcctcctgctctgggactctcctctgtttctgtgctggcgcgcggacgccttgggaactagaggcgggcagcctcggcgaagcccaccctgttgttgtcacggtcaaacacagtgtagtagcggccgatgaagacgtcgcccaggatccagagtggcccgctgggtggcgggatgtccatgcccatgaagccgctcaggcagagggtcttcccggcctgcgacacctgggacggccctggtggtcagtacccaggcctagcaccacccgcccccccacctgttgcccgctcacctggagcgtgcgccccctcaccgcccgctcacctggggcgtgcggcaccccattgcccgctcaccttgagcgtgtagtcctctggggacagcttgtagcctttgcctcccagcttcagtgtgatcgcgggcagggtggacaccttctcacaggggatcatgtactaagaggggtcacagcagtgtcagggtggtagtggtggccttggggctccccctgccagccccagccccagccccagcccccggcgctcacctcgccctgaatcagcggcacggccccgatggccttctgcagctcgcgcacctcatccaccgggcccaccatgagggaagtgcctgtgtccacaatggcctcacagccctccttgcacagggtcagcccgctggccacctccaccctgcggggagtcagggcgtgaagcccctgccgggactggagtgtgccctgggggcccagtgcccctccctgggagcccctcccctggctgggctgcactctcctcccctcagggctcctggaagcacagccggctgtaagccctccagggaagagggtgggagaggagacacagagtggtagagggggtgggagaccctcaggtggtggtgaggggcatggagggatggaggggatggaggggcatagagggatggaggggatggaggggatgaagggatggaggggcatggagggatggagggatggagggatagacagatggaggggatggagggtcatggagagtcacagagggatgtggggatggagggatggagggatggaggggatggagggatggagggatggaggggatggagggatggaggagatggagggtcatgaagagtcacagagggatgaggggatggaggggatggagggcatggagggatggacagaagggatggtgggtcatggagagtcacagaggcatggaggaaatggagggatggagggatagagggaatagaggggatggaggtgatggggagcatggaggggcaaggaggggcatggagggctggtctgaccccatctctttcttgcccagctcccactactccccacatgcaacccccacctgcagaaccggggtcctccagggtctccgcacaccgcccccgcccacagaacccaggggagccgactgcagccactactcactggtccaggtggacctgccagtaggccttgcgggtgacattcaggtaggacagagaacccttgtaatacttggagtctgtgccacccagcatcagctcacccccaggctgcgcatctgggtccctaggaggaaaagggaggagtcagctgccacgccaccccccaagcacaagagtgccaggtcaggagtaagagggtgaatgtggcaatcagggagagcttcctgaaggaggggcctttctgaaactgcagggatggaaaggcccagaaggcaggaggagggacagactcccttcttcccggggtagggctgctctgcgtgggcccagcctggcccagaagaggttttcctcaaccctcaggttctcctggtctgctcaggagccaaggttcagccagacatcagggtcaaggctagcggcagacaaggaagtgagtgccaggagctccactggggaggaccctgtctgtctgtctggaagaaaaaaccaaagaaggcttccaggagggagtgatggcacaatctgggaagttgggatggctggttctggccgcagggcctctgcactggctgctcctgggaacaccctccacctgcatccccgagccacgtccgctcatctccccctcatccagaccactgatggccagccaaggtgctcctgggcaggagcgcactgcacttcctaggacctgcaacccatgtcgcccgggtttgtttctaaacattgctcaagtacagctttcaacgcagcaaatcctgccggtcctggtagagaagctctctgtgtctggggcggttctgccatcccgccagagcgtctgcagctaagctggccaccatcccactgcctgtcactcgaggcagtgccaggcctgacccagtcctcccaacaccgattggggcctccgccctcctccagcctcctccgcctttgcctcttgtcaacacctctgcaatcccaagtgtagaaacctgatcagcgcctcccacccctcctctcctcaccaaacatgctttcagaagccctcagaccctccctcctgcctggctccacttcctgcccaagctgctgccttgagactacacctgggcactcacaaccatgtgcacctcccccacctgggcactcactctgtgtgcccctccttccacctggcactcatgcctgtgtatgcctcccccgacctgggtactcataccgtgtgcccctcccccacatgggcactcatgctgtgtgcccctcccccacatgggcattcatgcctgtgtccccctccctgacctgggtactcaggctgtgtgccccctccccatgtgggcactcatgcctgcatgccctcttgccctcaggggaccccttttcacctggctgcctcccctgtgccccaaggctcctggggaaatggcccagccggttcacctgtgtcctggcctctagtgagcagcttagccctgggtgttgctaaggagtattcactgcccaggcaaggggcagagcaaagaggcccagccagccctacagccggaattctgccggaagcgatccaaggttaggggtcaggcccagagactccaagtgccaagtgagccacgtgaggtaaacctgcccctgtcagccctggagagtgtggggcagtgaccaggcgcagctcagggcaggaggccgccggctgacacgctgcccacccccaaaacaaaagcccccaacccccagtcacccctcttatgtggaaccctccactcaggtctgccccgagaagaggaaactaactgagtccgacgtccccttcccaaggtcacctgaccatgggtcacccaagctggagcagcggctgcaggtgggggccctgggggagaacccttttcccagaaggaagggccccctatgttcctcctcgagggcagccggcacctgctggggacgcccacagagctgctcgcagcgtggtgccggggacccatacgcacccaaggtcacctccccggggatccccggtcccctgggcaccatgaccctctccaccatcagcaaccccgggaccaggaccacatgtgcccatcaccaggtctggggaccgacgggccgactgaaccaagaggaactgccacgacccctgacctgggtccattctcataggagggaggcccagctgccaaggtcccaggacccacagcctggcccgagcccctcccactgggagaccccggccaaacagctttctctgtgctgccgcttactcctctgcagaagggcggccaacccccgcctcccggatgccctgaggtcagaggtcaggagctctggcacagcagcagggagggggcagcactgagagggggtgcctagaaggctccccgtccagccccgccctgcctcccagcaacgcggagcgagagggaacccacacgcccacctgctcaggtagaaggagaagatgttctggtccaccagcttctgctgcatcaggttgtcgaagacgggcagcacgttgttgacggagatgcgggggtaggccatgcccaggatgccatcgaacttggctgcgatgaaggtgatgcctggctgcttggtggcctccccaaagacctgcctctccactttgacaccgcccagggcagaggctgacgacgctgactggcagggcacctgcaggccagggcagagtcagtgggcagcagacaggctgagccctacaccactccctgagcatgaggctacaaaacccagttcaatggatgcccatcccacacacgatggggcccagagggcccagaagaaagggctggaaaccctgagctgaacaccgctggggatggggacacggggtatggcggggccctcttcgtggaagtcatcagggctcggtttacacgagatgggaaccaggcaggagcacagacgggcaggccccttgctccgctccctgctccgacctcttactcccaccaccaatgacaggcaggtcctgctcctgccctcagcgctgggaacaagacacagcctgggccaggagcccgagagatggggaacctgccgaccccatcccaagctcacagccatactgcccccttccccttctctgcctgtcccctcccccagccctggatgaggctgcagagagagaacacggccagagcaggatgtgggaagggaacgacagcttgaggctgacacggggcggagggggcagaagagggcggaagagggcagacggggcaatttcctgttcaggctgagcagggtccagacaggagggctctgaggagcccccagtacagactggactccagcccagcagggaactgttaggagcagcttcagctggaggaaggggccctcttcccgggtccctgggcctgcaggggggctctgctgccctcctggcccgctccagagctgggggctgtgtcaccatcccgtaactcctgaaccccttgtggcctggtccacccccagcagacagctccgaggtgagaactcactgaggcccaggcagggtgacaagggccagctcaccctctcctagggcagggagttgctctgcacagggccctgaggatggtggatgcaggcggggcccccaacagccactgctgctccccctcccttgccctcccaggctcctgccggtgactctccgccagcagcccccacagcgggttcctggtacatcctcccaaccccaagcctccccaagccctcggcctgctgcagggaccctgtgcagccccaggtccagccctcaacacctgctggcacctcaaacccaatgtgccaaaaagagcccgatcgatctgccctgtcctccctcccactcattgtggcctgactccggggacccctgcccctgtaccccctgggtttgaggctgtccctccagcctgcacacaaccaggcccattcccagacccctcctcaccctgctgactgccccggccacctgagggctggggttgggctgggatcaccgagccctccctttcaaccacatacccacggtgggtgaaccccacaccctggcaccctcgagtcctgggaaaggccccagagggactcaccgacacagtgtcctggctcaggtacccggagaggctgcccgagccatagtggatgtcaaacgaggtaccattcttcacgtaggtgctggacttgtcgctgttgtacttgtggtggatccctgccccgggcgacaagggggcccgccggtcatcccgcagcccacgccacggccttagccctcccatccccctacaatctaccatggagcccgcaccccccaagctgcctccccagggtgggatttggaggggatctgaggcccaccatcatgccagagccccgggactgtgggctgtgaccccgggcctccctcccagccacagccggctccctctgtggccaccccagccccagccctgctgagagcaagaccacagctggtggttcacccagaaagtcagtggctggagcagggtggagggctggcctggctcacggggccaagaggcaggagaattgcgttgcccaagtgattcctgaggcagccctgcagcgacatcccggaagggcaggacctgggcgacggggccagggttcgtgactcacagcaagcgatgtccagcagtttgcagtggatggaggggacccacaggttggaggagcccgtgtcgaagacgactgtgaagcactgggggggcgtcccgatgccaatctccccgtagtactgggcctggcaggggacagggtccgtcagggatgggagagggggccccatctccccactgggcctcagaaggcccggctgtccccagagccaaggcccatactggagggaggggcatcacggggcccacagctgccaacagccacccactcccacctgctcagcctgcagggaagatgggccaggtccccagccctcggtcctaatgcccacgggtacttggggtctctagacccctggcttctgtcacctacccctgctcaatacatggtgaggctgaggacttccccacggaaaagacaaggccagaggtcaagccagggtggggacagacgtggccctcagcctgagccccgggtgcaggaaagcccggcctggaagactcccctggtggcccgcagtccaaggtctgagaaaggaagtgacttcctccccaggttggggccatgtcaaggtctgattctgggtgtctcagtgcctgccctgccctccagggtgaaccccaggcttggagggcttccaggcagaggggttcagctggtcaaggggagaaggtaagccttacaatcactgcctgcccagcaaccctgccttaatggcccagggcctcagtttccccgtgtgtacacagggatagcaggcgcaggtgggggtgctgactcagggatcaggcaagtacaaggggtcccatgccgccgagcctctcaggaggcagagagtaagagggtcctggagtttggggtcgcctgggcgcccgcttcccccaggattggagcctgggccaccgtcagccaccagattcctggcaccagcccagcccaatgtttctccaaccgcctggcttcacggagcagcagcagctgctgactcatggccccacagaagtgaccactggcagggggacactcagcaaatttccatgtgtgtgtgtgcatgtgtgcgcatgcgtgcatctgcttgctcgcgcgctaggacaatcaggaactggccagtcgggaccaggcacacggcgcctggttccccccagggcccccctggcccagtcacatgcctgtgagtcttgggcttcctgtcacagccaggactcgggccaagcaggacagagggcaaggctcccccacagtgggccagagccccgaggctggacagtaggccctggcctcgaactgaccccatagagctgggaccaggctgaccaagccccagcttgctaggtggcttccagagtgctccaccttggatcctgcttccccctgaaggagtagtgggcacaggaggggctgttgcgagaggaagaagatggggaggggctggggaggccacgagtcaccacaggcctcccagcaggacagcagtgaaaggctccaggtcagccggccacactcaggcaggcccaaggaccgccccctcaggcgagctggcaccaaggcccgaggccactcccaatcaccctcccaggccctagcaggaccaagaccctgcaatgacaggggccagtggcaggaggttccagaatggggaagaaaggagtgtggctgagccgggacgccaccgtggccaggtgagccactcaaactgcgctgctgagaacaggaggtgggaatgttccccatactgccacggagctctcctgacagtggctccgcttgcagcagggctaagacctcatactcacgtccatgtagttcttgagcacctcgggaatgggcccctcggtcacggctggcaccgcctgggagtactttgagacggggcctttggcaatcaggtcctccacagagcccccaacctccgacatggtccggcggatggacgtgaacttgtgcagcgggatcctgtcaaccacgggtcggggcatatcagggaggccctcccgcctgccggccgacgctgccaatgctgcacatccacctggaggcccctggggaatctcagagtcgccacagccaaaaccaaactcctgcctgtcacctggaaactgctggcccagctcccccaagtcagtgaatggcaacccattgccccccgccaggttgcacaggccacagtcctaagaagtggtcacccgccacccacctcagccccacacacccaacctgggggccagtgtgcccaaccctcctctcctcagccattctggaggctccaaagcccccaagggtctcccgtcctccctctgcacctgcgctggtctcttccaggatggtggccagcatggctgctcagggtgctggcgggtacctgtcactcctgcccaaagtgctctgaggcagcccactgtacccagcccccatcacacctgctctccacccccagacacctgcacgaaggtggccccacctccaggctggcactggcagctctgcctggcctcctctggccatcagatgggccctccacaccacctccagaagccctccttgactacctgtcctcctccacatggaccctgtggctgcccagtgccctcatcccacatctgtttctgggcatccgcacctctcctcactccatgcggctccacgaggtccaggactgcacctggggccttagaggcttctgtgctgccccccccaccgccctgcctcctccgacagctgcactcagggtacccctccagagtcctgtcacccagcacaccgccagccagggtgcaggagggagctccagactgagatcggggtcctgagttctaaacccaggaagcgagtaagagagagaggggtccctgctcctcccccagggccactggccttccccttggtgtgaacccactccttgttccaaggaagctcccctgggcttttaatcacttaaataaaacctcttccctgccccagggacttgagagtacaaggtcatagctggcttttcctggcttgtcaggggcgtgatcccggaagatgagattattgcctaagagctggtgggctggaagagctccaggttttgtcctgggggagggacacgccctccagggaccaggaagcaggtgtaatagtatcagtcgcacaagagctggaatcgggtgagggcttggattcagctacccttccctccaagaagccccaggatcgtttcccctctgctgtgtctgtcctccttggagaggggaggcctgtggataggctggcaaggtcaaggcaggctcaggcttgtggctactcccccacaacgactttaattggggctacccgcccccgggccattccccacagcctttggtgaggctcagtcctacccagctggcccagccagctccagcccctgcagccttctgacctcacccacctgccaaaaggcagtggacccatcgcagatcccaggtctcccacaaaggcccagagcaagggtggggcaggtgcccaatgggatgggtcagcatacccctcctgggaatgcgggctgccttgcaagggctggggagggggtcaagaaagcagactgcagcatggccctcctctgcccagctggtcaggcatggccgggccccatcccatccaggcccaatcggtggcctcacctggcacaggggatcggcctgaggagcgtgtgggcctcactacagcacaaccccaggcccggggtgggtgagccgacccactccccatgcctcctcctctctcagggacatgggaactcctagggtctcgaggggtctcccagcccagggcctgtgataagagccgctggagcaaacttttaaagcccccagttcacaggtggtaaaggggtccctaaggaaatggactcgcccagactcgggggctctgaggcctgacctaggtctccagcaacaagggcgctcagtacagaccccaattccacctgccccgaatgagcactacctccccccgccccgccccgtctccagggaggctgcggtcagtctgcagtcctcaaggtacaacccagggtggcatatgggggagaggcatctggcgcctctgccccgggtcccctgcacctccggagcccggcgccccgtaggcgggtggtccgtgcaggaggccgcgcagggcggcacaggtgcattccagcgcggggggcgcaaggggctcgtgggggccacaggggagcgcgaaagtcaccacaggccccgggacctcggcgccgcgacccctgcccgtccctgagccccggcccctgaggcttcacctgacgagcgcggaggcgggtgcagccagcaggcagagggcgagcggcagaaggctggagggctgcatggcggcggcggccgggtcggagagggtcgccgaggccgtgcgcttatagccgggatgacgccgcagttgggccggatcagctgacccgcgtgtttgcacccggaccggtcacgtgggcgcggccggcgtgcgcggggcggggcggagcggggcctggcctgggcggggcaacctcggcgcacgcgcacagcgcccgggcggggggcggggtggtggtgcgcctgccgcgcctacagttcccgccgctcgcgcccgcggggtcagcccggcccagcttctggggtctggaggattcccgtttcggcctggcctggggtcgtggggcggcccaccctggagggccccgcggggtgacccctgtcccggccgccgcggccgtccccgcgtccaggcctgcgcggggcgctgcgcc

SEQ ID NO: 333 - DNA, 17264 bp, Homo sapiens
tctgacctgagagaattctttttattacgagtgaacagatgaactaaggtaagcgggtctcagccttccgctggtgcagcatctccacgcagggcctcagccccgtcctggccttgcctgaggactgcaccatgggtgttccttgggcatggaggaggcagcaggaaggggtgacaggagcaggagcaggtgcagggcacctcacaccacaggcctcccccacctctgagctgccaacagccaagactcctggcgaggccgggagaggaggggtgagagggaaggagggtctctgtgaaagcaagccccacccccagagcagagcagagacccaggtctgcaaatcacaccctccccccacgagttcctcctttgaggccagcagcacccgagggagggcaggggctgcacggagaccagagaaaggaaaaccccacagaagaaaactcaaagcatcagtcccatgcgtgtctgctgaacgagtgaatgggcccaaaggctcttctctacaaacggcacgcatccatccgacagggggccacaggacacggccggggccgtctgcgtctgtgcctgtgcagcccacaccagtgcagcccggggccctctcagacctcaccacacgcgtgcccagcacatgtgtgcacacgcagatgcaggagagaacacacaccaccgtctctttgcacacgtgtgcccctgtccggcccggggggctcatctctccttcacgtggttctgtgctcccgggcccccgctgccggccccatccccactgcccccactgtggaccccgccggccccgctgcatagcacctcggtgaggtcgtccatgatggcggtctctttggggtccagcaggttgaactcccgagcaaagaggatgaagtggacgtagagcgtgttcaagtgtccgtgcagctccagggccagcgtctccttgaagtgggcccagtagatgtgtgccagcacgtggaacaggtgtctgcagatcttcctcaccagggactcaaaggagctggggaattctctgcctggggaaggccaccgtgtcacaagctgcagacatcccttggccccaacagaggccaggcccctggcacccagcctggtgggtctggtacctgccacccacaccttgaccctgccaccctcagggcctacaaagccccagcagcaacagcttctgcccatcagcaggcaccacagggacttgccaaccccgggtctgggctgctgagacctccctgcgtgctcaggctccggaggctgcacctgccctgagggctgggagctcgttgggccatcctggccacctcctcaggaaggggcctgtgatcgggcactcgggcccccgtggtgtctccctgatggacacttggggccatctcccgggccaggacggaggtggcgatggtggcacaggcctctcctgttgtcccctgccgtccctctggcagcacgggagtggcgtggagccccaccacatcccaccaaaatctggacacaggcttggcggctgatacccagcccaagtgcccacaagctggacggtgagagcagcatgagcggcagaaaccaagaggggcccagtgcagccgcatggcccagagggccagggagatggcccttggccctggctgggctgacccctgcccaagggctccggcctcaccccacagcccaggtggctccatgctaagcagggactggggtggtgcagctgccgccctccgtgcctctgcccctcccggcacaggagcttggtcacttgcagacacgtcctgaatgctccctgccccactgtgaggatgaccgcccagtgctgggggagacgaaccgtattttgtggggaacacgtcctcatccgtcaccagcttctgcacggagctcatgacgaagtcaacgtactgtggggccgtgcacttgaccttcttcccccgctcgtcataccagtagtactgtctgtggagacagagacacggtcagggcatgcgcccgctgcacacccacccagccactgggtcccacccgctcaggtcatctgcgggcagaggtggcgccagcagcggaggtgtggcagacccaggtgtctccctccctggacatgcacactgtccccacacactgtctgcggggaccacactgcactctatggaggggtctgcctgcgctgacttagaactacgccaggatcacgctggggagcctgccagccacatggctgtacaggtgtgtgattaaatgaaggggtcatcttcgttttctccgcttctacatggcttcagttgtattcgtttacacaagtgcgtgctgctgtttttctgttgtattttgaaagcacacagaggctccttctcttcccaggaagctgtgctgtggctcgccggccaggccccaccctttgggagagccctgctctgactgctagaagccaagcccctctccggggaaagcagaggagggcggtggtctctgtgggtacctgcggctaacagcctggccaggacagggacctggccccctcttgcccctgtacacaagggcggccagtcctcatgtgagactcgtggccccagagcaggctggagcatcctagggacatggacaccctgggtttgcctcttactgttgggtccagccatgacaagggtgtgctctagttcatgttaatataaggtgacccccagcccctaacacccctcctcccccagcacaacaccaaaacccagggcacccacctggcagccaccacccctctccccctgccacggtgctgggtctcagtcctccaaggccatgcccacagcggccgcccccgcaggcctgaaccagggcatgctggggccgatgccgcagccccacccacaggcagtggagagtgctgtggtgggagtgctcacacctgagacacagccaacactatgggtcgggatttcctccctgagagccagctcccagctcaccacaggtgggaatgggccacacagcacagagcagtactggccactgagcaaacgccccctccacaccatggccacaaccaccatcgcctccactgccccagctagaccaacaggcagtctgccagtaccaggctccacatgaaccgctcccaccctcctcatccagtcacggttcctcttggaatggccctgggtggggcagtgctgaaaaggatggacccaggctccactctggaggccactcttctcttggccagctccaagcatcgtgccctgggttccagagcccaccaaggcacctggggagacgccccaagggctgagacagggccacggggggctcgcccacttcctgcgcagccagagaagccatcctcccagctgggcacagggcctccagtgtctccgggcacagggcctccagcgtctccgggcacagggcctccagcatctctgggcacagggcctccagcgtctctgggcacccctctgctgtgtccaagaagcccctcagcctgtgcactgcagatcccggggggagtcaccagagttaccaagaagctagaggatgacactgcaagccctgcatgctggcaccctgccctctgcaacagaaacagccatcaggccacctcccagcaccaccagggccctaggacaaccccctcccagcacccacctccagaatgcaaaccaggagctctcatgtgtgccctgtgcggggctgactcagcccacccgaaggggaagtgcagccccaaaatggacaggccatgaggacggggatgcagtgcccacacctgcctctcaggtgctgtcctccccctgggacagctctgcatgaccttcacgcccaccttcccaggctgcaggcctcaccgtgggcatcgccaccaggctgtcagaccctctgagaatgcagagacaacagtcctttcagcatctgctcctcgagaatgatgtagaggacgcacgtatccccactgtcctggggttcccagatggtgtaggggaggcccagcccctaagggccaggctgaggcccatgtttccagggcgaggacccagccaggatggctcagcactctgcaggagtcagacactggctccaggtaccctgacactgcaagctgacatctgatgcacctggccacaggtgtgcgacaggtctcaaaacagtggaggttagagacggaaacccttttccacaatgcaaacccagagaaagcagtaactcagggacactgtggattgtcccatctgttctgaaagatggaacaccactgtttcctgtacttcttcaattatcagtaaaccgtttctggtatatagttctaagatttttatccacatgtggactcacgcattcataaccacaatcaggacacgcggcggcttacgtggcccctcacacccgtgctgctgtgcccccagcaccccggggatggctcctcagggatgggccgcgggaaggaatcgcaccgcgcggatcctcccgatctgggcccctcttgcacggaggcccctgggatgcagtcacgtggcagacgtgtcggaagtccacggctcctcactgcccagacactgcccctgcagagatggacatggcgtgctcatctattcacctgtgtccctgccagcagaacagagtcccaggtggccacatcctggccagcaccagtgtcccgaccggcatgtgggcaggtggacatgggtctgcccatggtttcggcttgcctttctctaattgctaacaacacaggatagccccagctgccatccttacaccctctttggcaaactgtctgctcatttcttttgctgacagttaactggactgttttgttttcttactgctgagttgtgtatgttctttatgtattctggatatcagtcctttgtgggatgtgtgatttgcaaatgttttctctcccagcctggagtttgtcttctttctcttaaaagtgtcttgaagcaaaagttctgaattttgctgcctagtgtcaggtcataaggatttcctatggtttcttccaaaagctttggagttttagatgtttgcacgaggcatgagggataggtcagcgtttggtttttgacacaaatgactgcttttcccagcagcatttttgaacagactaccctttctcccttgaatttattttgctctttgtcaaaactctgatggccccgtttgtgtgggtctatctccggactctccatccacacgtttgtgtggggctgtctccggactctccatccacacgtttgtgtgggtctatctccggactctccatccacacgtttgtgtggggctgtctccggactctccgtccacacgtttgtgtggggctatctctggactctactgtgttccatggagctctgtatccattccttcaacactgcacactgtcttaattactagagtttcacagtaagtctcaaaagtgtgagattcctcttattttttcaaaatcattgtagctatttcagttaatttgtccctccatataaattttagaactaactggtctatacttgaactctgctgggatttggattgagactgcactaaatcaacagatcagtttgggggagaatttgtgtttggagtcatcttccaggtgataaacgcagtgcgtctctccatttatgtagaccttcgattttctgtaacagcatttcgtagtttccagggtgcagatcctgggaatgtcttgttaagtttataactaaggatcgcattatttttggagctattataaatggcatgttaaatattaatttcagttttaaatttcacattgctaatatacagacctatgactgatttgtgcgtgttgacctcactaaatttatattattatttgctacaatccttgaggttttcccaatcacacgtgtgcacagggatacagcaatcccccccatccacaggggatgcactgcaagacccccaggggatgcctgaagccacagagagcaccaaaccctatatatgctgcgctttctcctatacatacattactaaaataaagacaggcagacttgattgattgactgagatagggtctcgctgtgttgctaagttagtctcgaactcctgaagtgatccaccgcctcagcctcctgagtagccaggattacaggtgtgagccaccacacccagtgtaattcataaactgaggacaatcagttgcagtgagtggctggggtcgcatatcagggggtcccttgctggcctcctgcaggctcaatggcaacacgctgctgctcccatcctctcacctcctccacccacagatccaagtactcaacacgcactgtggctgtcacttttgcaatttcagatgtaacagcgaaattaaagggactttttttccctttttcacaatttcataaagaagagatttgttcttaccttagatcttagcaacctcacacacaatctgtttctttctagtcaggaactttcaccttttcatctttaggtcaaggaagtgctttctgtcttctctttggcatatctgaattgccagcatcacgctcttgcgctttgggccgcctcatgtcacataagagcaacctgagcacgagcaccctggcactgcggcagtggatccacacgggggccgaggcacagctgggccgagggaggaggaggcacacctggagcaggacggtggagaccgcatcacactgctcagaacagcatgcagttgaaaacttattaactgtttatttcgggaattttccattaactattttcagaccatagttgactgtgggtaacggaaactgtagataaggggggcttattgttttatttcttttccaatttggatgccttttattctttcttcttaccttatggcactgcctatcttaggcgagttctgatatactgcgctttccaaagagttggtccatttaacccaagccatagaattcatgtgcacagagggtttttttccaatacttccttattatccttttaacatccactgggtctacagtgatactcctctttacatccacagggtttagtgacactcactcctttttattgatcattgcatcttctctcttatctttgtacctactaaaggcttaccaatttattacctttcaaagtcatcacattttgatttcactcatttcccctattgttttaaaaatcaatctcagtgctttctgttcttatttactttcttgtccttgattttgacttattttgctctttttctagtttaagttggaaacgtagattactgaaagtcatcttctttttctaagaaagcattaatcctataaatcccctctaggcactgcttgagttatgtctcacaaattctgacatgctgtattttcctgtgtacagtttgttaaagtttttttgttgaggcatcctctcggacccatggactactcagaattgtattagtctgcaagtgtttggagactttcctgttctctgttactgatttctaatttaaccccaccatggtcagaaaacttacttcgtatggttttgattttttaaaatttgttaagggctcttttgtgacaggtatgctccatcttggtggctaatctttgtgaagttgaaaagatgggtgttctgctgttgaggctgcagtgcatgtgtcatttcaatccaacccacgggtggggtcatcgggctccgtgctctcgctgactgtctatgaggctccatcactgaggagagggctgcaatccccggcgatcatgtgatttctacacaggccgtccgtttgctttgtgtggaaagccctgttgtctggcgcacacacatttatggcaggatttcttcaagagctgctccttttctaattagataaccttcttattcctggtcacttccttcctcggagtctcctttggcactgacatagccacttccgcttccttctgatgggtgttttctcagcacatcttgtcctcttacttctcacccgcctgcaccacagcacctagagtggtgtgacacacagggtgcttatgccccacattcctatgttgaaagcttaaccccagacgcaagggtatctggagatggggcctttgggaggcgatgaggttgcaagggtagaacgctcatgaacagaactggtggctccgtcgccctgccttccttccagcaagaaggtgctgtctgtggaccaggaaagggaccctcaccagacactgaatctggctaatcagatccagtgacgtggtcagtgcccccttcctggtccacagtggatcttcaccttggactttcagcttccagaaccgcaagaaataagattctgttgttcacaagccacctagcctatcatgtttcgtgacagcatcccgaatgaaatacaacaaatgagcttcttgtaaacaccagagagttggttattttaaaaatacattctcataagctgcccagtcccgtctgttcatctgttagcatttaggttttccactatttgctgtttgttgcctctgtttctcattccttatggtatttcttctttcctgctttctcttgggccactgaaatgtttttgtatttcatttaaatttacctattctgattctgactgcgtctcttcacataagctctgcaaggcctgctcaaagggctgtaacacgcaactcaaccccacatgctctccatggcacccacacatgtgcttccactggagcatagcagctctcttgcccacagccccaccgccgccaggccccacagccgccacagccccaccgccaccacaggccccacggccgccctggaaatggcactgcacaggccccacggccgccctgggaacggcactgcacaggcactgccggacactactcttgtcttcttgcaccatcactggcgtctccacaaacactcagtgggaggaggccctcctgttgggagaactctgcagggagcctctggaacaggtctgctggctgtgagggctcttggttttgagtgactttggacactgactggatgtggaattctgggatgacctttcttttctcccagcactggaagatgtgtggggcttccttcttccttctggcctcctgggtttctaaaagtgccacggtcattcactgcggcatctgttgtcagtaccaggccaccgccgtctgactgctgacagaggatggctgccaagggctttttctttgcccccagttctcagcatttggttgcatgcatctgcacgtgtctgtgagccttatttggggtttgcttagcttcttaagtctgcaggtttgtgtctttgtgggaagttctcagccattattgctgcaatgtgtttccggccccgccccctttctcgtctccctaggagtcagacatcagcctttttgggactgtcctacaggccctagcagggaggagacgcgcctcaatcccagagccctcacacgacccaggcagacttgctggtcttttgggtggcaagtggccctgaggccctctgagaagtctccatgtttctcttagtttgagtggatttctgtcccttggtttgaaaggattcctggaaaggcattacatgcaattaattcacacacatctactaccaccatgatgccagctccagatgagaaggaccaagaggcaaatctgggtggcctaggccctccaaggggacataggtctgcccaacaccacatcctacactcctccaaggaccccttttccaaaccaacccagtaccacagaacatgcaggagcagagcctctgggaagggtgccaggccccgtctgcccaggagcagaggcgctgagccagcacttggccacaggtggctccagagccacagtggacacaaggctctcgagtagctctcgggtgctgccctgccacctcaggacccatctccatgcctgatccatggaggccaccgccgtctcacattgagcttgctcccctcaaagccataagcactgtccccatcttcctgggccatgcctggctgtgacacctcattttcctggggaattaagacagtgaagccagctgttgtctgtacctgccccggtgtcacccataaccaaaccaagctgtgacccatcatggccatgagggcagggcccagcaggactgaagccaaggggacgcctgccagctgcctgtgcagaagctccccttggcttcttgaaggcagaactcagctttgtctggggaccacgtctccctgtgccagggccaggaaagccatgtctgtgggcaggatgactttcaggacgcactcacaggcacacattctgtccctgacctgtgtgcactgacaacaacgggacatcagggaaaagcttccgccctcctcagccgcacatgtcccaggctaagcccagcagacccagcctcctcctgcctgcagcctccaaggctgctttcagcaacccaggcctggcggcgctccttcccatgctacgcaagtgaggtgctcagggccactaacggacacccatttactgaggaaatcagggtgcagtgcttccaggagagagctaccagcaccaggcatgttggatggtcacggagaaggtaactgagcccccatgaaatgaatggccgagcaaggacctgtggcctgcccagcccagccctcactgtcccatccagagctgtcacgggagccagcggagaagggctctctgcaatcttagggcattccttctggaaacgtctctgtccctagaaacatagcccatcaacccccaccagctcctgcaccttctgggccccactggggacctgggtagctgggccactggcccagcctgtggcctttccacaggaaggtggatgttgtggaaggcctgtgccaagacttctcagggtctccaggtgagaacggaatctgagaggacaggagcctggggcagcgggggctcagagccccaccgagtctcccaagagaaagtgggctgtagccaggcagcactcacgtgttgcacacggccatcgtctgacacgtctctcctgtgcagaactcggagatggtgctatactgcaggttgatgtggtggaaaaacgtcgtggctggaagagaagagaaggagccagatgtgaaaaacgccagagctgagccgccccgtccacccctgcttccagcaacaggtgcaggagctcggctgggtgagctctgcccgtccacgggccacattctcccctcgcggcagggggctgctgagcaccagccgtgggggtcccccttgaggaggggcttcgaggaggagcagggaggagggagggggcccgcccccaggcccccgcgcactgttgctggccagccactcgttaaggtcaatctcgcggggcagcaccaccagctccttgaactggaagtcggtgatcctggccttggtgtgctcaggctccaggtaggccttcctctcctccgcagcgggcttcttgccattaggcttggctttggacttcctgccaagagaggagacgcggtgtggtcactacacgcccatcagacccagggtctgcccggggggtcagttgtggccagcgcaggtgtagagggagctgcccgagcccatcggggcgacactgcctccctgccaggctcaaaggacaccaacgggacaccaacggtgaggctgctccgcagaggggccagtggagctgccttgcgtggcacctcctgggaagaagggctggcgctcccacttgccacacgggcccctgcacggagggcatcctcacccctcaccaagtcctccaaccagggaggggcccagggtttagggcccccagcgcccaccttccagttttccagtgctcttggaaggaaaggagaagcaaaccctctcactcctggcttcttttgagttggccagcctgtccctgcccctgccgctggtggccccggtgaaaacataccacaggccttgtgcagggcacctgccttcctggccagcctgagagcacggggcccctggcatcaggcggcagcctggcctgcagctccagtatccctgttgtccaccaggcctggggaggccacagggtgatgaggatgggggccaaaggtctttgtggcaacctgaccctgtccttattttttttctttcttgttttgaaaagttgctaatggtttatttaagagaaagagaaaggaaaaatgctccctgaatgccagggaaatgtttccctttcagcttctcacagcagatcttcgccttaaaaggagaccagcgcaggcctctgggggcagtgctgggagtagccagagccaggcagggagcaggggcaggagcaggggcaggggcaggggcaggggcagggaggggcaggggcaggggcagggaggggcaggggcagggcccctgggccctggcactcccactctgccatctctccagagcacagggcgtggggtctgaggaagaggaagcacaggtgtggatgggccacatgcagcgtgggcacttggggtcctcacagtacaggggtgggacagacagggtgagcttccgtgtagcctgcagcccctcgccccagcacagcgaggcacccagactccacaccagcctgtgccaggccatgcccagcgtgtccaccacagggaaggctctccccatgacgctgggcctggccctgaccaccggcaggtgggcctgcacctccctgccctgtgctctcacagcacagcacaccacaccccacccgggcagctacagcctgggctcggccttcccatttggaggggtgggttgcagtggcccaggctgccaagcgggctacaagccgtctccctgctctgtgtcttaggagctgtgtcaactggcaagctccaggtggcagttacctggtggtcggtcacgcagggctgccagcaggagcagctgtcagcgcgctcactctcagggtgtgccccagggcccactcagggaggctgccctactggcagttcctgcccccttgccagccttccaggctggggctaccttccacctccggtcctcagagagggctgggcaggggcagaacctggagacctggcttccctctcccaggctctggctgtggtcaggaggtagtgagcagccgccactccggcactggcacctcagcctccctgcctcttcccgtccacacctgctctcctagaacacagaagaaaagtacgcacgaggccctccaggctgggcctccccgagctgctcccccagtctcaccctgtccccagcacccagggctggccgggccccggagcttagtgcactgtgagacaagcctcctgcaagcctaccttctttggaccgggtcactcattcccatggggcaggtggacgggcactggcccaaaggtagtaggaccaaggggacgcgcaggacatggcctctgctccaggaacggctgtgcgggcaccaacagagggacttccatgggaaagccccgaacgcctggcagcacccacgtctccctgacctcaagtgccctccttcccagaagggcaggctctcagcgaaggcccaggcctgggcaggaagcagtcactctgaggcagcccattgctcggtccaagccagcggcagctaccgaggaggcctcagagcacacgacacctccatggcactcttctcgtccttagtcattcttggctttgcccagtggagaaaacacctctgcggcgccccccgcaggctcacaggctctgaaacaggctctgtgccgtccaggcccagaggtctgcccagtcactgcctcagtggcccagctgcccctcacccagggaagtgccgaggccctgcgccctgctcccagctccccctgtgctgctggctaggagccccggggcacagaaagaccaagtccttcgatgtggagggaggactgtgggagcaggccccggccgcaggcaggacagagatggcgctgaagggactggggagtggaccctggacctcagcccacccacagggcttccgtgaccacttggaagaagcagaagggcagatgctgtgtgcacagcccccaaaacaaagtccctcacactattccaacaggtgggctctgagcctgggtcctgcctggcaggcaccatgcacttaggagggccgggccagatggaaccacctccttcctgcctcccacacactcaccagcctcacctccctcctccctgctctagatgacctgtcctgcctgccacaggggtctgcaccctgtttgtgggcaccagctgctgctctgccaacttgcccatcttacaccaggcctagcaaacttctcctggtcctttaagagcctgtcaaatgccaccctccccattctcgccagtggtacccatgacgtgccagtcggcctccttggcacccagcacgtaactgatccctactgggaagtgaggcaatccctgctagacacaaatttggtgggcaagggaaggggcacagggaggcatcagagctgctgggctcccgtggaaaacttagacaaccacacagtcaacacacagggggtctcaccctgcccacagcaggtgcacactgcttcacaggcagggggagctggggagtgggctgggagccgcccactcctcatccgccctgagggacgaggacagcacaaccgagtgccctgcacctttgccacgagtgtcaacttcattatcacagggatggaatcctggccaggccccacggcccacaggaatggggtgctccaggctcagagacccccactcgcccagagcacgcttgctatggaagtcgagcctgtagaccctgaggtgagtgggcagcagcaggaggtggccctcatctggcacttcccaccacaggtcaacgccaaggggtggggcaggcacgaggggcccagaaatacaagtccccaagcccaggcctggaaaatacggtgaccaggcagcgtgtggggtgcaggagaaaggcccgcaggtgacgcctctgaggagggcatggtccttggaccccactcagccatctgcaccgggcccctcatgctccttggttcgggtgaatgtcagtgctggttggtccacccagagcctgaaagtcaaggctcccagtgaccccttcccccaagacccggccaggcagagcccccagtagccacccggtacagagcctgggtctcagcacaccttgctgcccagggtgcacgccacgggcacctcctgtcaccccaacatgcagggagggcaccacatgctggggtgcttggcgccacccccacccctacatttctgatgtggccttctgggtgttgagggggggcctgaaaactgcatttctaacaccgtgttctaacccgagttctccctgggtgctgatcccacttctgtcacacggcctcaggctgaggggtgggaaggcctccggagcccctgtccatctctcagcacagcctgcactgcccacaggcttcagccagctggaagctgtggagtgtggcttcttttcttctgagtttaattgtctgcccccccaaacaggtcagcagccccagacaaagcgagcttttaccagcctactgtgccctctgcagaggcccattgagaaggaaaaagccaagatggcacaaggaacgcccgcagacatcccagaccaaacgtccaaacaggcaggtgctgctgctgtcctagaacctcagccccacgtggccaccatgctccactgcgcctcggcccctccatgcatccagctcccagccaaggtggcttcctcatcgcttcctttgaaaccttcctgagccccagggaagggactccgcccgtcttccttagggcctggctgggctccaggcctgcctctgtgtctcctgtggagctgccttcggcatttggcctcagacacacaagcacacactggcacaggcacacacacacacacgccagtcccctcacaccactgatgtcaggcaccattcctgatttgaactcacgagtactgccaacttgcccacacatttccaaaacctcacagtttcaccttaagataggacatcctaggcagggtcaccggccggcactcttgtgtctacttgtggagccctccctgttgaatgcacaggtgatcgggagatagggaaggagcctatgaagagaaagatggagccgggtgcccagggacaggcagaggcacggagatgcacacgggtgccgcagcccccggcccttggagggcacgtccagcaggccacgctcgcctcacacccccaccaggcaaccccacccgggaggacacactcactgctgcagctggctgtgcctgccccactcccccggcccctcatgcccacacacgggtgcacactcccacacacacgggtgcacgctcccacacacttgggcgcacactcccacacacgcccctgcacacaccgagctgagtggtgtgggcagggaggcacccccgcagcaggtcagagaaagtacaggtgagaaaaatgtcaaaaatggattttccggcaacatccctatggcagccagcacaaaaataggcacccgggaaccccatgccacttctctggacaaggccacacaaggacagactccgggtcacctctgcctgggtggctgaagcccctgcccagggcacaaacagccgcacgctgggacaaagacaggcacacctgctggcggctgaggaaccacaccctgtgggttgcgggaggacaaggcaggctcctgtgccggcaaggtggggtcaaccccgaaggtcgaggacaccaagacccgctcctctcccacagagcaacaggaagtgcaggcggctaaggaaagccccactgggcagggctccagagcaaacccgccaggctggcccgggactgcacagccgcctctgccctggacagcttgcgtgtggcccagcacagctcgctgcacagccgccggccacactgggagggcagccacggacacagtccgccgcctccccaccctgacctccttcctgggggcaagaacagggcagacagatgtgctacacacccctcccccagccaggctggcaggtgttacctgagcactttgctgacagcctgaagcaccattttgcagcagagtccactttgcagggactggccgggccgggcttggtcttcagggagactgcagtggtctcccagcatgagtgggcgacgggaaggtggggaggagaagcggggcggggtgccggctggccagcactcgcaaatgcctgctgccgggccctccagcctcactccctggccaatgggacgcctggcagagacaaacagctgccccctttccagaggcaagggctggccaag

SEQ ID NO: 334 - DNA, 158530 bp, Homo sapiens
ccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggttccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgtgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggtaaagccccacctactttatttgacggtcctttggatcccaaatttggctcggcgaagccagttgatcgagttcacccttcacttggcattctctgttggactccgagtgggacggggaggccaacttttgaaaggggctgaaattaggagaatgtggagcatgtgcctaggtgttgggataggataagaattattggtagccagagggatttgctaccgggcagcggtggtgaaggtcatcttagtacaaacgaattgtctcctggtttagagtctggcaggaaacttggaatgagtggggaagttgaaagtacagatgcttcttcttctgtgcatttcaatctcatcaaaggctctgcagtgatgagctgcgtctgggtgtagaagcgtgttttcattcctgagatcaggctgttctttttaaatgagaacaaccttgtacctttggatgtattttgcttgatggttgcacaggcatttagtataaaataattattaaaaaaagactcttctctgccccttttggatgtttgatgttgttctacctaatgatgcttaagccttacagtagcagcattgctctgacgttcattaaactaatgtctttcagcccattcactatacagcgaatagtataggagcccatgcaaaattgtgtaagtgctttgagagtcgtaatgtcatcatcattgttttaatcttataaaatatctttaagctgaactttcccaagagtccgaaggagtcgcagcacttccttttttaacctctagtggtgtaaataatggtgtgtcattccggttgactagtacattctaggtttaaacagctgagtttgggctacttgttgcttgacttactgaagcagcttgcttaaatattgccctgattgggcataggtgaacataggttattagtaggagcaggtttatgctgaaggaagtcagccacattatgcatgcataaaaattgccattattgatatagtaatcttgccaagaatatagaccagcctgatacaggatatgaaaataactgaatgatcttggaacttattttatccatgaactaatatgttaacacgtaaccctttgaatgtcaggttccaaataactaaggccatatcaaatgtgaaattaacacagcatgtggaagtaaacttaaaaactaagaagttctttacaaacataatcatttcttaacttttacagttaatgatgtagaacttctaaggtagtgtgaaattaaaactactcattaattttatagtattttagaattgaaaaggtgacagatctttaaaaaaaaaaaacctcgtcaaacgaaaactgttcattttggtcagtcatattcaaaaaacttagtctgggccaggcacggtggctcacgcctgtaatcccagcactttgggaggccaaggcgggtggatcacggggttaggagttcgagaccagcctgaccaacatggggaaaccccgactctactaaaaatacaaaaattagccgggtatggtggcgcgcgcctgtaattccaactactcgggaggctgaggcaggagaatatcttgaacccagcaggtggaggttgcagtgagcggagatcgcaccatcgcactgcagcgtggtgacagagcgagactccgtctcaaaaacaaacaaaaacaacaacaacaaaaaaacttatgtccgattccttttggtttacaggcagaaatttacaggtagacacatttctttcttgtactatcgatgcttattgatactgatgctggaattttattcttccattatagttttatatttgaataggtgctttttaacaattttgttttccttaaccggttaccttacttttttaagactggacccaattacttgttgagcactttatgaattaattttgttagttttaattatttcacttctgagacttcttagcatgtgatgtgtgttttccttttatcacctggaattttctgatactttattatcttggaactgataatacagtgaaaaaaacttaatttgtctaatgtcacgataaaaactttgtccaagcttctcaggttttcttagaactcgtaactttttggatttttaattctctatctaggcatgggcattaccaaactaaagaaaatcttacatcgcatattatttttgagtcatttcaggatttggctgcagaactagatgaatcctagcttattaagtggtacctggtttagaaacttccatgttatttgtctgtgcttctgtaattttttgttttgattttgaaaagattatcttacctgaaaaatcctttatagcagtagttaggcagtatttttggttttttgaccaggacacttgcactacatgcctaataaaatattcagtgggtcagtgtttgaacttttatctttggagccaaattaaaggacaagccaagggattactaaagcactggaaagatagaaactttttcgctaaatctatccttttaatatacatatatttctgaagcaagacaggagaatattgagttaagttgttgagttaaaaatcttagtgtattgaaactgggagaaatcttaggttattctgcccagctatttatttgacaaataaggaacctgaaatcatagagcaggtaaataacttgattaggtagatgaagaacaaaagctagttaggatctaataatttgggagatgacaaagcatttgtagtccagtagatggctaataagtcatttcaaatgaagcaatattgtgttggtgtggaagtggctgttggatttctggagaaacccggtccttatacccatggcaaatttcaggcttctgttttgggtgttgatttttatcacttcaaattgagatataaataggcttttgtggatgggtcaatatggtatacaaatcaagctattttctgtcatgctaatttttttagagtcatgctatgcattgctctttagtaaaacaagcatcaattcttttttttttttttttttttttttaaaaaaaaaaagagacggagtcttgctctatctccaggctagagtgcagtggcgcaatctgagctcactgcaacctccgcctcctgggttcaagcgattctcctgcctcagcctcccaagtagctgggagtacaggcgcaccccaccacacccagctaattacaagcatcaattcttagtaaataatgcctaggtaatattttgataccacaggaccttcagtaattaccgagatgtttaagatgcagatttctttaactggttttattagacaagtagtgcaccttaattttaatatttggttgtcttggtcagaaaatattactgttgggctctatctgcagagtttacattgcttttctagaaagggatctggtttttcaaaaaagatagcataatttcctttaagaaaacattgatggagccgggtgcggtggctcacgcctgtaatcccagcactttgggaggccgaggcgggtggatcacgcggtcaggagttcgagaacagcctggccaacatggcgaaaccccatctctactaaaaatacaaaaattagctgggcgtggtccgcacgcctgtaatcccagctactcgagaggctgaggcaggagaattgtttgaacccgggaggcagaggttgcagtgagtcgagatcgcaccactgcactccagcctgggtgacagggtgagactctgtctctaaaaaaaaaaaaaaaaaaagaaagaaagaaaaagaaaacattgatgcacagatttaagaatgatttattttaagcaccttcccaagttgcctctgaagagttcacatgatgcgttatatgttgatgagattgtttccacatctacctgaaaagagaggttaaatcatatttttgttgaagctccaatatacttaactgcttatttttctctgtcttttattaagactgtgtgtcatgagtacatgacattaatattttgtgaatagtatagcagtgttacagaaatgggatgtggttctgtgattaagaaaccatcatttatttctttgctatagttctttttttttttttttttttttttttgagacggagtctcgctctgtcgcccaggccggactgcggactgcagtggcgcaatctcggctcactgcaagctccacttcctgggttcacgccattctcctgcctcagcctcccgagtagctgggactacaggcgcccgccaccgtgcccggctaattttttgtatttttagtagagacggggtttcaccttgttagccaggatggtctgctatagttcttaaaatatctaattgaactgaatctctctatttgaatgttggtgattttttccctcttatcttttaaatttgtgccacattccttattttttaggatgagaatcagcgtaactttccgtctcagggaatagtttttggagtttgttcttaaatcctcaaagtcaccgattaggagtattggcaaatttttttctcttaccttttttctgacccgtagtaacacagtctgagaagtaatctaaaaacctggaaagaggttgtttttgtgtaaaacaaaccaggaatctattgttgctttgtgacaattcatttcttgacattcaaattctgatgcaagagcctagtcatttaaaatttatcttattccaccagcagcttatcaaagaatttcaaaaaataaaaaatatatgtatataaatataaataaaattcatcttagttcatccctatggaaacattcaactaaaactgggctctcattttcagaaatcatcctaaacctgttatttgggttttctggtagtttttacatttttttagataaagctgtaaaagcagcaagagtagctgtactcaattatcatttctgaaaatatttagcatactatgaaataattcataattaccgttagtacacctttgctataccagttctttaaattatattgataatttaaattatatatttagtaacttgcattttgtttgagttttttgtttttttgtttttgagacagagtctcactctgtcgcccaggctggagtacagtggcgcgatctcggctcactgcaacctccacctcccgggttccagcaatgctcctgcctcagccccctgagtagctgggattacaggcgagcgccaccacgcccggctaatttttgtatttttagtagagatggggtttcaccatgttggccaggctggtcttgaacacctgacctcgtgatctgcccgccttggcctcccaaagtcctgggattacaggcttgagccaccatgctcagccgttttgttttgttttaaaacctggtctgcaggaataggtgagacttagcatgacctcagtttatgtttgaagaggccatttttctgccttgtaacatagtagttaagaactagattgcctgggctcaaatcaaggctcagctacataattgtgtcaccttgagcaagttttgtgctacagtttcctgtctgtaaaatgggtgtaaaaaagagtacccattttatagagttgtgctgattaaatgaatgaacatatataaaacatgtaggatagggcctgccacataaatattaactgtgatgatgcagcatcttttttaggttgtccttttgagggaatctgtgaagattttgtttgtttatatttatgcttgaaaaatcatatagcaaaacttaactactgttcttggaggaggaggaaagcaggtattgatctttatgttactggtgcttttaaattccttagctctacctggcctttgcctaacattttaattttgtgacccatcacccaaatgccaatctttctgaactgcttattttcagaatctgctaagatccttgtctcatctttgcatgtatctagaaagcatattttcttttggtggatctcatatataattcttatagtatttatttatcatattgaaattgtttatatattttgtctaatccattagtctttggaaagttcactatggtgtaatagaatactatacaatgaaaaggagcaccaaggcagaacccttgagttctagattacccaattttctgagctttgagtaaggaacttaatctataatgctcatttattagcaatatgtcttactgatttaggattgttgaagatccactgaaatactatgtgaatgtactttgaaaaatgttaagtgttatataaaatataacagaatacttaaatattcatttagaaggctataaattgtcacctattacaaatggaatatattaaacttagttggattttaggagctttttgctttgtcaacttaatttctcaaatcttaacaggggagcttttcagtttgaagaaacattgtcagaagctcttaatattttatttggaagatgattatgcctttgacaggtagcaggcttaattttatatgtagttttttttttattgttgttgtttttgatggggtcttgctctgtcgcccaggctggagtgcagtggcgtgatcttgggatcttggctcactgaaacctccacctcctgtgttcaagcgattctcctgcctcagcctccagagtagctgggattacaggcacccacaaccacacccggctaattttttttttttttttgtatttttaatagagacagagtttcaccgtgttggacaggctggtctcaaactcctgacctcaggtgatccacctgccttggcctcttaaagtgctgggattacaggcatgagccgccgttcctggtctatatgtagtttttaaaagattggttatttgtgatttttacataagaggaaaagcatcagtaagctgtggttttgtggccaacttaattgatcatataatatctccaccttcacttacattaatttagatttttcaggtggggtttcataaataatttactttttagtgttgtgacttgaatcttggctttgccaaattaccatattaaatacattatgctaaatgaatatgttggaatgattttttagaagagtcctcagataagctgttagtcataacaagcaaataattttctcaggaatgtaagaattcttaagaattttaacagtttgaatttaagagtgtttggaaatttgcttgttgtaatcatcatactcaggttagttaagaaaaaccacagtcattcctgcagataccttttgtgcagctgaggttcagcttctcagagacaatattatttttgtcagtagatacgtggtagatggtctagttaaccaaacacacactaatgtataaaccaaacagtgagagatgaaattaattagtgaatcaaatgattaatgtgcacattctctgttactagatagagattaacagatttcttgggataagatcattttcatggctaagagttttgagctacataacctgatatatctatctttatgtggatcatctccttccatggactggtagattattgtggattaaggtaaatcgggaaatgcaacagatttatctctttaacatgctaaagagttactagatatcattgtcatattaaaatgttctttgaactctccatattgcccctctcacacacagtcatccgtcagtatacacaggagattggttccagacagcccccaccccagggtaccaaaattcacaaatgcacaagtctcttaaataaaatggtgtattttcatataacctacagtagtacatcctcctgtatagtttattttttaatttaatttttttttttttttgaggctgagtcttgctctgttgcccaggctggagtacagtggcacaatctcagctcactgctacctctgcctcctgggttcaagcgattgtcatgcctcagcctcccgagtagctgggattacaggcacatgctaccatgcccaactaatttttgtatttttagtagagatggggtttcatcacgttggccaggctggtctcgaactcctgacctcaagtgatccatctgcctctgcctcccaaaacgctgggattacaggtgtggctcctcacgtatagtttaagtcatcactaaattacttataatacctaatacaatgtaagtgctatgtaaatagtttttatactgtagtgttttaaaattcatgttgttttttattattgtgttttgttattgttttttcccccaatattttcatctgcagttagttgaatccatggatgcagaacatgtggatatggaacctgaggatgtggagggcggactgttcttatgtgtagaaagtagagagtaactgaagagttgagttttaaacagagaagttaattggttagatttgcatagcagtaattgcccaaaaatagattaaaggcatacagggggaagtgtagagattccagtagtccccactcttcttcttaggggataatggttatttttttctcctgcttttcattttttttttgagacagagtttcactcttgttgcccagctggagtgcaatggcgcgatctcggctcaccacaacatttgcctcctgagttcaagggattctcctgcctcagcctcccgagtagctgggattacaggaaggcgccaccatgcccagctaattttgtatttttagtagaggtggggtttctccatgttggtcaggctggtctccaactcccgacctcaggcgatccgccagcctcggcctcccaaagtgctggaattacaggtgtgagccaccactcctggtccgtatttttatcttttggttctgtttactttgaggtttgcaagacctcccgtggatacctgaagctacagacactactgaaccctatgcatactttgctttttccatcccataacccattagactaagtgactaaaggacgagatgggtgggtggcattaacagtgtgaatatgctgaacaaagggatgacatgtcccattcgagatttcatcacactagtcagaatggcacacaatttaaaagtcgtgaattgttggctaggcgtggtggctcacgcttgtaatcccaacactttgggaggccgaggttagtggataacctgaggtcagaagttggagaccagcctagtcaacatggtgaaaccctgtctctactaaaaatacaaaaaaaaaactagccgggtgtggtggtgcatgcctgtaatcccagctacttgggaggttgaggcaggagaatcacttgaacccgggaggtggaggttgcagtgagccaagattgcgccattgcactccagcctgggcgacaagagggaaactctgtctcaaaaaaaaaagaaaaagttatgaattgtttatttctggaattttccatttaatatttttggacagtgggaagtgaagcctcaagtaagggagggctactctagttaggatatgagtgtgagatttttaggacctaaactagggagataatagaaggaatagaacatttagatatttaggagataaaatatttagggtttagtggataatttagtgattaattggtgtttggaggaaaaatgaagcatggataagaggttaggggatgatagtgctgtcaactgagagagaaaaatcaaaggttttttttaagttttaaggttttttgttttttagatgggaggaggtatggagatgtattcaattggacatgttgagtttgagattcttatgtaatctccagtaagaagttcaataggcagttggatatattactaaaacttgaagactaggtctgagatgaagataaaagctgatgattcccaaaaatgtctatattagttgtagctgaaataatggaagtaaatgagatacgctagggagaggatatgaagagatagaaaaattagagagagggagagggaagagtaatggtcctcaggcaaaatagtaacaattaccaagggaataaaatttcaagaaaataatacatcagagaagttctattttcatagtagtaattgtggagaatgaatttaacaagtagtaaagaaatgtagtagttaggctgttgaaattgttgcacttggctattaacaaatcattaacacagcacggtggctcacgcctgtaatcccagcactttgggaggctgaagtgggcggatcacctgaggtcaggagttagagaccagcctgaccaacatggagaaaccccgtctctactaaaaatacaaaaattagctgggcctggtggcacatgcctatattcccaactactcggcaggctgaggcagaagaatcgcttgaaccggggaggtggaggttgtggtgagccgagatcacagcattgcactccagcctgggcaacgagcgaaactccgtctcaaaaaaaaaaaaaaaaaaaagaaagaaaaatcattaacattcccactgagaaacagccctgacaaaaagaaattaaaaaaaaagtcagtaacaattaaatttaaggttgcctcagtaagggggaggttgaataagagagaagcacataaatacatgtaagtcactggtaatgccctagatttctgcactgttcactatctaatacaatatccaccagcctcacgtggctatttcgctcttgccacccaggctggagtgcagtggcgtgatcttggctcactgtaacctctgcctgccaggttcaagcaattctgcctcagcctcctgagtagctgggattacaggcacgtgccaccacacccagctaattttgtatttttagtagagacagggttttgccatgttggccaggctggtctggaactcctcaggtgatccacccatctcagtcttccaaagtgctgggagtacaggtgtgagccactgcgtccagcctttatgtggctatttaaatttaaataaattaaaatgaaatttttagaacttcattgtcttgtactagccacatttcaagtgctcagtgacaacatgtggctacgatattggattgcacagataaagaacattttcaggctgggcatggtggcttatacctgtaatctcaatactttggaaggctgaggcaggaggattgcttgggcccaggagttcaagaccagcctgggcaacatagcaagaccctgtctacaaaaaattaaaaaattagctgggcctggtggtgtgcatctgtaaccccagctactttaagagactgaactgggtggattgcttgagctggggaggtcagggctgcagtgaggcttgatcatgccacttgcacttcagcctaggtgacagagctatgaccctgtctcaaaaacaatttttttttaatcattgcagaaaattcttttggaatgtgctatatccagatcttgggtcaagttgtgcttttaaaaaatataacgatatgaggactgtgcatggtggctcatacttctaatctcagcacttctgggaggccgaggtgagagcattgcttgaggccaggagtttaagactaggctgggcaatgtagcaagatctgggtctccaaaaaattttaaaaataaaaataataactttatccaaaaagttcaactttaaccataaagttcatccttttaaagtatatagagtgttgtttttagaactgaagttacacatttaaatatgtatactctattaataaagaaaaaatagttattttttgggaaactgtacaaaggatgttatcacatacatgcagaattaataaaggttaacaatatgtcatagttactcaaaatatttggtgaccttacagtttcagaagaagggaaaatttgcagtgggtttaatgagtggatgagaggaagtttagaaagtagagacaataagtgtaggctggggtgagggttgaaaaattacatattggatacaatgttcactatttgggtgataaggcgataaggttaggtaactagaaaccctaacctcaccattatgcagtatatccatgtaacaaacttgcacatgtacccctgaatccataataaaatatatgtatgtaaataaaaattaaaaaataaaaccatgaacaaaataagtgtaggctgtttattctggtaattttaaatgaataagttcagggaaggttgggtacaaggatgagatggatagatgagctggaaaaggtctttaaaagttgaaacattgaactgtcatgttttgtctgctttggtatctatcataagtctgttccaagccaattactgctttagctttgattattctttttttttttgagacagtctcgctctgtcacccaggctggagtgcagtggcatgatcttggctcactgcaacctccgcctcctgggttcaagtgattcttctgccttagcctcccgagtagctgggactacaggcgcgcaccaccatgcccagctaatttttgtttttttagtagagacgaggtttcaccatgttggttgggctggtattgaactcctgacctcatgatccgcctgccttggcctcccaaagtgctgggatgacaggtgtgagccaccacacccggcttattttattattatttttgagatggagtcttgctctgtcgcccaggctggagtgcagtggcatgatctcagttcactgcagcctccgcctcccaggttcaagtgattctcctgcctcagcctcccaagcagctgggattacaggtgtctgccaccccacctggctaatttttgtgtttttagtagagacagggtttcaacatgttggccaggctgatcttgaactcctgacctcaagcggtctgcccacctgggcctcccaaagtgttgggattacaggcgtgagccaccgtgcccggccctagatgttctttagattaaaatagttcattgtggtcaaacaggttcatgctctcttacaccaggggtaatccatacttggacacacaagagcttatgtcaaaatatggcagatttcttaaaatattcctgttgtggcagactttctgggttgataggtttttttttttttttttttttttttttttttttttggagacagagtcttgctctgtcgctcacgctggagcgcagtggtgcagtcttggctcactgcaacctacgcctcccggattcaagcaattctcctgcctcagcctgctgagtagctgggattacaggcgcgcgccaccatgcctggctaatttttgtatttttagtagagacggggtttcaccatattggtcgggctggtctcaaactcctgaccccgtgatccaccctccttggcctcccaaagtgctgggataacaggcatgacccaccacgcctggccgggttgataggggttttcagccttacctacacatgcaaatctcctttccctctgtaatccccaaatttagactttaattctcctgtctttcaaggggagttgccttactctgtgtgggttcagggtgagggaaacttttcagccagtttatgtcattgaagtacattgaagtttatcagggaatttctaataatagtaaacttaaaatggaaggccttggagttgtagttgtttaccagaagagtttttggctttttctgcatacttctacacacctcttacctcccttcctaattgatagagacagatttttatcaggtcacacatggaatctgctactccctttgaattcaggtctgtttgcttcaacgacgtaactgagaaggaccactctagatggctcctttctacctagacatgctcttttctacctagacaaaaaaagccaccagccattaataaatggtaaactatcaacttaaatatttgttctgcctacccaggcaccctactacatagaggggctagtttaggttttagtttggtgacaaattgtttgtgttgcattgtatcaggttttttttgttcgtttgtttttgaggcagagtctctctctgtccaggcccaggctgtagtgcagtagagagatatattggctcactgcaacctccatctcccgggttcaggcaattatcgttcctcaacctcccaagtagctggggttacaggcgcttgcaaccatgaccagctaatttttatatttttagtagagacgggatttcatcatgttggccaggctggcctagaactcctgacttcaagtgatctgcccgcctcggcctcccaaagtgctgggattacaggcgtgagctaccatgcccggcctgcttgtatcggtttctttatgtctccacagatttttttgttttcatggacataagtggggagcatagagatattttgctagtgatcatcctctggctaaagcatagtttgatttctgtgataagaatcttgaccatattctatccctcttagaagggcagaagtgaaactgccatattacccataaataccactattataggctttcacaaatctgtatttactgagtgtgtacttggtgtgaatacctcattaatgttttaaacatctgccattcttattctcttaatgagtaaagttaacttcttcaacaaccagtacttagctaaatattacacaatataatttttccctttcttcatgtaatggatgaagtttttttgttttttttttgagacggagtcttgctctgtcaccaaactggagtgcagtggtgcaatctcagctcactgcaacctccgcttcccaggttcaagcgattcttctgcctcagcctcccgagtagctgggattacaggcacgcaccaccacacccggctaattttttgtattttagtagagatggggtttcaccatgttgaccaggctggtctcaaactcctgacctcatgatccacccgcctcagcctcccaaactgctgggattgtaggcgtgagccactgtgcccagcctggatgtagtatttaaagaaaaaacaaaaaactctttactgtgaaatactttcaaacataacagttgtcccagatttggctagaagctaccttccgtttccttttttttttgacagattctcactctgttacccaggctggagtgcagtggcaccatctctgctcactgcaacctccgcctcctgggttcaagtgattctcatgcctcagcctcccaaattgctgggattacaggcgcatgccaccacgaccggctagtttttgtatttttagtagagacaggttttgccatgttggccaggctggtctcaaactcctgactgacctcaagtgatcttcccgtctcagcctcccaaagtgctgggattacaggtgtgggccacaatgcctagccccttctgcatccttgttattaacatgtccctatcatttttttatgacatccttactttctgtagaagatgttctcagttcattttattatttccccaccccagtcctgcagcagcaatttctcctggagccctggttctttttattgtagaaaggtattcagaaaaatctgggtgccaggtgtgctcggctactgggcctgttttcggtgaagaattagtgtcttagttcatttgcgctactataacataatatataaagaacagaagtttatttcctcgcagttctgtaggcctagaagtccaggcaagacagaggcatctgttgaggtctttcttgccacgtgctcacatggcagagggcttcagggcaagagagtgtgaacccactctcaaaagccttttttatagctgcattaattcattcatggaggcagagccccacttcccaaaacactgttacattgcataagtttcttttttttttttttgagacggagtttcactcttgttgcccaggctggagtgcaatggcgtgatctcagcccaccacaacctccgcctcccaggttcaagcgattctcctgcctcagcctccctgagtagctgggattacaggcatgcgccaccatgtctggctaattttttatttttagtagagacatggtttctctatgttggtcaggctggtctcaaactcctgacctcaggtgatccacctgcctcggcctcccaaagtgctgggattataggcgtgagccactgcgcccggccaggaattaagtttctgatacatgaatttggtggggaggaagcatttagaccatagcagttaggaaatatttataagtaagcatgtgtgttttggattttgaaaatttagtatgaaaaagaaaagcatttgttttcaaaaaattggattacatattgaaatgatgatgtttagatatatttgttaaatatattaatctgtttctttttacatttttaatgtgactactagaaaattaaatttcatttagctcacattatgtttctgttaaccatcgctaatttagactattctattaaaatgctgtgaaagttgatgctacagcaaatttactacttccttttaaaaaatatcttaataccttcctttttgtggtttcttgcattagcatcctctacaggccataattctttgctgttgctgaacacagaaatttggggttttaaactcttagtggtttgtgatgcttttcataccagattgttaagaaaattggaatcctcatcctttaaaatattatcttttgttatttgccagcatgtccggtaatcagaaatggcatttctttatggctttgttctttgagaactttaattgttgttaagagaatattagaagtgtttactataaatatcttgaaatatttgggaaatattttggtttatttcagataaactgctagtgtatgtttggaatacgttaaatgcataaacttactgctttatattttctttttttttggagacggagtcttcgctttgtctcgcccaggctggagtgcagtggtgtgatctcagctcactgcaacctctgcctcctgggttcaagcgactctcctgcctctgcctcctgattagctgggactacaggtgcatgccaccacgcccggctaattttttgtatttttagtagagatggggtttcaccgtgttagccaggatggtctccatctcctgacctcgtgatccgcccgcctctgcctcccaaagtgctgggatgacaggtgtgagctactatgcccggcgctttatattctttagtaatttctggccattgtggctccttaagcttgttaattaatttagtgtccatattcatatcttaatgatactgagaaattggttaaattggtttttggtgtctgtctcttgcttatgaaagataaactgtagttcagctatttattagcattgagtttttctagaatagttaaatttttttgtttgtttttgagacagggtcttattctgccccctgggttcaagcgattctcctgacccagcctcctgagtagctgggattacaggggtatgccaccacgtccagctaatttttgtatttttagtagagacacggtttcaccatattggcccggttgatctcgaactcctgacctcaggtgatctgcccgcctcggcctcccaaagtgttgggattacaggcatgagcctctgcacccagccttaactgctttattttaataaagttgtaatatatttgagatggcaagaccattctcttcagactgttaatggtaattttttaaaattattttttatttttagactgggttgcacactgtcacctaggctggtcttgaacttctagcttcaagcaatcctcctgtttcagcctcccaaagtattgggattacaggcttgagaaaccctcttaatttaaggactgcagaagcttactttttttttttgcataagggcctttgatagtcattgtttatggctacaaactaatttgattttgactaaattatctgagttataaacttcatttatttccaccttagttattgtaaccatccttaattcatacacaaaaaagatgctttaaaaaattagtaaaacactctcgttataaaaattaggaaattagaggaggaaaaaggaaataaaaaatcacctgcagtcagtatctttatccagagataagcattgttactgtgtatgacacactggtttctgtgtgtttgaactctgtttttatagttatcgttatattgtatggttgtacagtttgcctgttttaccacatagcaaaagcattttcccatttaagatcttgaggtttttagattaaaaagcagcaaaatatttgtacacagtaatcataattggggtgtgtgtgtgtgtgtgtgtatgtatgtgtgtgtgtgtatgtataggggtgtgtgtatgtgtatgtatgtatgtatgccaccatacagcagcgtaattatgtgtatacatacgtatgcacacacggttatgttgctgtatggtggcatcatttgcctgatttaccttatagaaaaaccatttcccacattaaaattttgaagttatatataaaaaacacttgaattcttgagtatatattatttttttaattctcagtaagagaaaattagaatgtttgtcccacagatgcaaacatttagttagaactaaatctagtaaattgatcattgatacatttgattgctctgaacagaagtttagaagtcatggttgatatattacaaagctaaattatttttttcacttccagtctttgttcagagatttgcaagaaagtccattcactgcttcgcatataatttggggtattatcagtagtttgtttttagaacagtggtactgtgtggttcagaaatttgtaaaagccaagtgttagggtgtttaataacagtacattgtaagttctttgaggagctgggcacggtggctcacacctgtaatccagcactttgggaggccaaggcgggcagatcacctgaggtcaggagttcgagaccagcctgaccaacatggagaaaccccatctctactaaaaatacaaaattagccgggtgtggtgacgcatgcctgttatcccagctacttgggaggctgaggcaggagaatcgcttgaacccgggaggcggaggttgcggtgagctgagattgcgccattgcattccagcctgggcaataagagcaaaactccatctcaaaaaaaaaaaagttctttaaagaagtttagtttcgtatattgactaagctatagggggaaaagccttactgtgccttttccacttcctacccactcaagataacctaagttggcttcctttatttaaagtgttaaatctactctagagcataccaaagatattttgaaaatataggaaattcttaatgcatttaaaaggaactacttcccaatcagtttttttcccatcatagaagtaatgtatactcagagatatcttaaaaaacaaggaaaaataaaaaccaaaataaccccactgaagtttcatcactaaaagacaatgtcgatatagcatttagaatgtttgcctgttcctccctctcatgatggattttaatatttattcaccaaatgtttattgtactcctatgtgcttgaggctgtctcaggtagcaaatagagaaaaaaattctgcccttgtgaaacttatgtttcagtgggatcataggtgtatgtttgcaattttatatcctgaaaattttataattcagtataacataagaattagtataaatatttttaatagctgcttgacagttccttatgtgcatatgccataatttccttcatttccccacagtgttaagtatgttatttttgctattgtaaatatagtgggcgagggtcttactccacaaggttgtaaccatgaaataatatttctgttttatgaaaaccaaatttaatctgtgttgtatccttacctaattgagatggccattatttccctgcacaaatccccctccctctaatccttggtgagcttcttacattccagaactttatcaggaaagggctttcctccagtctttcacctacaccgcttgtcattgacatgcccatttatgtaagtctggaaggtttctttaaggcctcgttacagagaatattgggtaataggatctttgcacaattttccgaaggaaagtttttaccattattgtctctcccttctccctgcagctcccaaggagggtgagtgtattgatcttttctggatgaatcctctaatcccttcctttcctccagcatctacctctcaaactccattctcatcccctccctcttgagtataatccaaccagactccttcctttgggcctggactttctcagacagaagccagctgaggagactgtcttctaattgctggttctaaaataacagtcttgaggctagaggcccacaagggcttggaataggagaagggaatttgcctacttagccttgtgaacaaaacactgatcagtacctcagatttcactgtttagaactattttcttaggattaaatttcagaaatggaattactggttctaagggcatgataagggcatgaacatttaaatactttctattcattgtaagattgttttccagaagagttatatagattttcagtgtcccaagtgagagttcttattttattaaccccatttatcaatactgttaaatatttcataaactatagtttatgtctgcagaacttcccccatatgctttgataataataactaattgtatttcctcttttgtcttttgttatatttttgccttcaggtgcttttctcccctaaccagttttcataagttccttatatcagaatgaatccttttatattttctgcaaatatttttcaatgccgagaatttaatgtcaatagtatatcactgtttataccatcaaattggttagtcatcttaattctgtttttctttttttcatttaagtatagtgaatctttgaacttgataggtgaatttctggttttttatcttcttgatattggtgtttaaaatggatttatcttcatggatatatttatgttatagtattaaaatctgaaattgaacttagtatacaaaaaatagatttttaaaatgtttatactagctccttatcaatgtttaaaattttgcttttgcagttacaataatggttattcccttatttctgtatttactagtagagagtaaattaagacattactgaatacaatgagataaatggcttatcaagtaatagtctttcttgtaacacaaatgagttcttagatcagttgtctttaaatttgtcttgttatggcaagttgtgttttcagtggcaactttttttagggcctaacgtaaagtttgatcagaagtttgacgtgtaatcccagcactttgggaggccaaagccagagaggatcacttaaggccaagaatttgagaccagcctgagcaacatagcaagacctcatctctgcaaaaaaaaattaacatattagctgagtgaggtggtacatgcctggagtcctagctatagttcaaggctgcagtgagctatggtcgtgccactctactctagcctgggcaatagagcaacaccttgtctcaaaaaaaagtttgagctatgtatgtttgaagggcttgtgttctcaaattggtgagaaaagggtggcgatttgatactatttatgaaccagacactgtgttttatatatattctcttttattcttgtgtcatatattcttatgtcacctgaatgaggtatcagtcccattttacagggtgaagagactgaaatgaagtaatttgccaagcttgtgttcaacaaacgtagaagtggcagtggagcctagatcattcttgtttgtttgtttttcatttttgttttaaaagctgagcatgcttctcttcaaactttatgattaccttgtagtgcacgttaaaactaatagctcaggttgtctgtgaccccaaagacaataaagacaggatctcattctgtggcccagactggagtgaagtggcaggatcatggcttactgcagctttgaactcctgggctcaagcagtccttcccctttagcctcccgagtagctgggactacaggcatgtaccaccatgcctggctaatttttaaaagtttttgtagagatggggtcaagctatgttgctcaggctggtctccaactcttggccacaagtgatcctttgcctcagcctcccaacgtgctgggattacaggtgtgagacactgtggcctttttcagttttcaagctgctgtttgttgttacattttaaaaatgtgaagttaaagtcagatctctgtgtgtgtttgtgtgtttgtgtgtgtgtgtgtgtgtgtgtgtgtgtgtgtttcttgagatggagtctcgctttatccccaggctgagtgcagtggcgcaatcttggctcactgcaacctccacctcccaggttcaagcgattcttctgcttcagcctcccgagtagctgggactacaggtgcgtgccaccgtgcctggctaattttttgtatttttaggagagacagggtttcaccatgttggccaggatggtcttgctctcttgacctcgtgatctgcccgccttggcctcccaaagcgctgggattacaggtgtgagctaccgcgcctggcccagatcttaatgtgttcttgctctgcgtggtgtttgtacctgggctggtgctttgggagagaagttgcattgtatggttgtccaaggacttccaagaagacagtaaaagaaaattaagatttattataaattagaatgtgaactatagagaattgacccatagtgctatgtttgagtcataataactgactagtgtttacaaagacttattcacacagagtagctattcattcagaagtgttgaagataaaaagactgtactaaatgacctcttggtccctttattgttactattctgtgatttattgagaattatgtgtatatttaaactcattccatgatgtgcagtgttaactttttagttacttttcttattggataaaattagtcagcatctgtgctttttttcatttggagggattttttttgtttttttttttgtttttttttttgagatggagtctcgctctgtcaccaggctggagtgcagtggtgcgatcttggcccactgcagcctccgcctcctgggttcaaggaattctgcctcagcctcctcagtagctgggactacaggtgcacgccaccacgcccagctaatttttgtattcttagtagagacagggtttcaccatgttggccaggatggtctcattctcctgaggtagtgatgtgcctgcctcggcctcccaaagtgctgggattacaggtgtgagccaccgcgcccagcctggaatttttaagtagctaaagaattagatttgtttttatgtgaaagatatgattttgtcatagagttaggcacttgtgttactttggaccaaacgtagtctgctagaattttgagatagagctagatatgatctaccatggaacataattcagctatgtaatttcttaagtactagtatattatgaactgggaagcatttgaagagaaacagtgaaagcaaagctcctggtatttttcatgaaatgacaagtggtaaatagtatctattaaaattcactgtagttgctcagtgaaacacatcaatagctacatggtagctatttaagaaaaataacttaccacagactcaggaaactttacagtgtttgacttccaacagtttacagtatttatcatctgtgtttgtttgctgttcagatatggtagattcgtcatattaaacacaagcttcatgcggtaaatgtgactctaaaacataatccaaaactttggcagtggatgccttgttactttagaaagactttaaacctcactttgtatttagtgctctagctatcaaatctataagtagtagctgagtcctggttacttaaatgatttaaatgatgatattctcacctaaaagggctcatttaccaacctaagcaatttcacctttttgcttataattagggttaaattgtgcttaaactgtttacttgacctgtgggaaaccagaagaaggctactcccttatactactgaatgtttagaattttaatacctgtgattgtggtttgatgttttagttttaaaaggcattgaaaatcttgaaatttatgtaaaattctctttttaaattttttattattaatttttttttcgtcttttcctttttctttctttttttctgagacggagtctcaccctgtcacccaggctagagtgcagtggcgccatcttggctcactgcaacctccacctcccgggttcaagcagttctcctgcctcagccttccgagtagctgggattacaggcatgccatcacgcctggctaatttttatattttcagtagagacaggctttcaccatgttggccaggctggcctcaaactcctgacctcaactgatccacctgcctcagcctgccaaagtgctgggattacaggtgtgagccaccgtgcccggccaatgatcttttttttttttttttttaaagtcattcgtagaaattggaaggaaatatctatcgtgctaacattcattagagtttaagattatgaatgacttattaaaatataaaatgataaggacagtacatgtaaactctagaacgaattttaaattcttagtaatactggtaatagttattaatacaggtatgacttctctctcgtgctgtttctggtgaacaccaccacagggtcacagtaaggttctaaaaatatgagcaaaagctggtactaccaggaaattcaaattccatacctgggaatctcagaactcagggaggaataaacattacagggggagcaaacaataatggggagtattgtttgagaaataagaaattaagaattttactgctctaaaatgtaaaagtaaaacaggtgaagtctggattttcttttgtttttatgaagttcagtgggagagcattctcttctgttaaaattgccactaattatgtgttttttctaaatcatattgtctgcttttctccaaaacagttgaataatgtactcattttcataaaattttagaaaaattagtgagtaaatttttggcagttattttatttgacatgtgagtggtatttgccttcagatttcgaattccctgttgggaaagtaatatggttatgttgctgtgactataatattaaaatgcacagacacactataaattccctttcccttaattttctttgcctttcttttctttcttttcttttctgttttttttttttcttttttttttttgagacatagtttcactttgtagcccgggctggagtgcagtggcacgatctgggctcactgcaacctctgcctcctgagttcaagtgattctcctgtctcagcctcctgagtagctggaattacaggtgcgcgccgcacctggctaatctttgtatttttagtagagacagggtttcgccatgttggccaggctggtcttgaattcttgacctcaagtgatccacctgcctcaccctcccaaagtgctgggattacaggcgtgagccaccgcgcctggctcctttcccttaattttctgaaagaaaaattcacatacagccgtgtgaattgactggactgtgaaattaaaataatggatttttttggtctttatactgcaagtttgagaaataaagaacaaagcattttctctgtggatgcgaagaactctgtacttgactcagcttcctttttctcttgcctgcattttttgtttacttcactggcttgattagtcataataaggctcagtacctctgccattcccaatgttaagcaattttttaaaatttggaattttgtggataatcattaacagagttgcttaatgggtaatgttgttttctttatggaaataatttgaggcaccttttctggggttcttggcaagaaatatgagtttattatggatatttaggaaagaggatgtagaaataaacctttgtttgtagtatgaagctgtgataatctgccccatctttgtctaattccgttttaacttctgtccttaacatgtttctcttcttaatcagttgtcagtgaagatttatttatcaggagatgggaatggagtattttggatatacttcaagttttgaatgataaccgttaaaatacatacaatgttttaatagtgagatacactgatcacaaaaatatggtctgatttaactttattttgtggtacttttcttctaagtttagacagatgatagaaattcacaaaaatttcagtcatagttatggccacagttaggcattcccaaaggaagtgtgttgcattcctaagtgtagtgtgttgcatgcactactgagcataatgggaaaagaaaagtgctataaaaacctaagtaccaagtaactagctagaaaaagcttttaatgggagagctggcatggtcattaatctggtagaatagtatttgaggaaacagttgcatgtgttaagctgcagtttcttttggttattgaaaaccaaataggaaattctgaattaatacttacatgctgaagtatctttgtggagcttattttgagcgttagagtgggagacttagttctaatgcaaactatagaagaatgaccttgggtaagtttgttgtctaattagtaaactgagtggtagagttggataatcctgtcagctttaggcccatgccttaaatatgcttcttatcctctcacagtcaaaaaggatttttaccttggtacagtctgattcctgcaacacctctctagttattgaatgtatagtagtttgctatagacagactactttgcagtggctatcaaacctttctgagactcattctaagaaatacatttacattgtgacttagtatatgcacacataaaaagaagaaagtttcacaaaatagtttccttactagcaatgagctgttttttgttttatttcgttaacaacaacaacaacaacaacaaaaactgctaaccatctttttcttggggttgcactactgtccaatgagcacatagtgagggcagtactgctaacgcctacataacatgcctgcatcatctagagctttgctttaccttggtacaatttttggaagaatgaaaaactgcttttccacagggggaaaatactgtttactgcccatctttgaaaaacattttacttagagcataaacttgaagctagatccttttaaccacttaattaaatcatacagtaagttgttgatagctatttgccacaaaatgaaaatatagtggctatatgaattttagctgctgtcactgttcattaatcataacataagctctgaacacagtgtttcttcttagaaaggtacaaatgattatgattttgtataacaactgaagttaggtgtgtgtgaagttttataattgctggtcttcattagataaattaaattataattaaatgatctgttttatttttgctttttatttggtctcttattaataggcacaatactggcattagctataacacaaaccaatggcactaaaaatcttcagaacctttttggatttgagtttttgaaagatattttgtggagactacagatttaattttaaagtataaatatgctcttattttaaataaatggggtttatactttgtgttctaatgattgagataacttttttttttgagaacttaaattaaaattcccagtcttctctagttctgtcagatttctttgttccccctcccagtggttgagttcttatgggatttgtggcttatttttaaaatccaatgattaaaatgaagttttctggcaatattaatatttgtgtgaatctggatatcctcctcacttaacttctaaggctttttcttcatctgaaaatgacaattttgtatacttggctggattattttaagtaacaagtaacaaacactgtggtagactaacatttgagtttgaagtttcatataattttaaatcattgtcatcgactgactttggaaagtaacttctgagatttttggtctgaagtgaccctgaaagtttatgacctaattatcattttattaggtctgaatgtgaatgttgcactttgagaggaaatagtatagaagtagttacattgctgggtgactgatctagcaagtccctaacagtgccattaagctgtcctgtagtacatcttatttagttctctcaataactacatagtatgttgtcagtcctattttatagatgagaaaaccaagggaacaatttgatagaataatgtttccaaaatcagagatctaatcttagaaggcttagttgaataacattggatatattactctgcggttcctaagtctatgaattaatgggaattttgaaatctaattgaaatccaaggagaaagtgatagaaataaaattgtagtgagcgatgtcggctcactgcaacctccacctcccaggtttaagcgattctcctgccttggccttccgagcagctaggattacaggcatgcaccaccacgcccagctaatttttatatttttatagagacggggttttaccatgttggccaggctgatctcgaactcctgacctgaagtgatccacctgcctcagcctcccaaagtgctgggattacagacatgagccactgcgcccaacctagtttaaattttctagtagccacatttaaaaaaaaacaggtggaattaatttcatgaatatgtttcatataacccaatatatatccaaacatagtttctttttttttttctgagacagggtcttgccctgtcacccaggctggagtgcagtgagtggtgcacgattatggctcactgcagcttcgaactcctgggcttaagcgatcctccagccttagctttccaagtagctgggactacaagcacgtgccaccacaccctgctaatgtttaaatttttttgtagagacgggggtagggtgggtctcactatgttacccacactggtctcgaactcctggcctcaagtgaacctcctgcctcagcctcccaaagtgctgagattataagtgtgagccaccatcctggcctaaatatctttcagcatataatcagtataaaaattataaagatagtatatattcttttctattacatcttcaaaatctgctgtgtgttttacacttaacatatctcggttcacaccagcaacatttcagtgaagtactcaataaccatacttggggctgggcgtggtgacacatacatgcctgaatcccagcactttgggaggctgaggtgggaggattgcttgagcccaggagtttgagaccaggctaggcaacaaaccaagatgctgtctccaccaaaaaaaaaacaaaacaaaaattatccaggcacagtggcatgtgcctgtagtcccagctacctcggaggctgaggtgggaggattgcttgagcccaggagtttgagaccaggctaggcaacaaaccaagatgctgtctccaccaaaaaaaaaaaaaaattatccaggcacagcggcatgtgcctgtagtcccagctacctgggaggctgaggtgggaggattgcttgagcccaggagtttgagaccaggctaggcaacaaaccaagatgctgtctccaccaaaaaaaaaaaaaaaattatccaggcacagcggcatgtgcctgtagtcccagctacctgggaggctgaggtgggaggattgcttgagcccaggagtttgagaccaggctaggcaacaaaccaagatgctgtctccaccaaaaaaaaaaaaaaaaaaaaaaaaaaattatccaggcacagcggcatgtgcctgtagtcccagctactggggaggctgaggtgggaggattgcttgagcccaggagtttgagaccaggctaggcaacaaaccaagatgctgtctccaccaaaaaaaaaaaaaagtatccaggcacagtggcatgtgcctgtagtcccagctacctgggaggctgaggtgggaggattgcttgagcccaggagttttgagaccacagtgagccatgattgtgcccctgtgctccaacctgggtatcagagcaagactcccatctctaaagaaattgtattttatttattttatttttacaacccagatgtgtgaatcttgaaggaatttttttttaattggctaatggctactattactggacagctcaatttctgaatgccaagtacctcttgttaaactgttcaacagcctttccctaccatctcaagaagttggtgataaaaattatcaataatgaattacagttttttaatttttgcctttgatgtgattgtcttattttataatatgttagcatttaatatgaatatttttgttgacatttattttttatttttaaaaatagcattattgaagtatagttgacataataaaatgtacatatttaaaaggtacaaatttaataagttgtccacatccatgaaaccatcaccacagtcaagatatttattactattttcctgaagtcttccctcctagctgtgcaaatctcctgtcactacattaaaacttttagatattcttcttttttggagataacctctcttaaacttctaaacttcaccatttgtactggttgcattctaggttgatgcttaggttggggatcttcattcattctcattttggagattcttcttatatctagctggtttttgatcctgcttccagaatcccatttctttctctttcttggtctcctcatttgtgaaagaataacttcataactctttgagaaaggtcatttgggagataaatgtatttttgagaacttacatgtctgaaaatattttccttcatcttcctttccctttcctctttaataggtagttcggataacaaattctagattggaaataatttatttcagaattttaaagacatttattctattttcttctagcttccagtattgctgttaaagtctgaggctagtaggattctctgttccctgtaacctattgtttttttcctctggaagttttcaggttttttgtcttgtcctcagcgttttgaaatttcagcaatgtgccttggtatgggtctcttttttccattgtggctttttgtctggaaactcactggccatcaattctgaaaatttaccttctactcatttcatttcttgccctctgttttttatgttgccccttccagaactcctgttacatatatgttggttctcctagaccaatggtctaacgtccatatcattttctcccccccccccaccccctcgaagtggagtcttgctctgtcacccagagctggagtgcaatggtgtgatcttggctcactgcagcctccacctcccaggttcaagcagttctgcctcagcctcccgagtagctgggattacaggcacccgccaccacgcccagctaattttttgtatttttagtagagacggggtttcaccgtgttcgccagggtgatctggatctcctgacctcgtgatccacccgcctcagcctcccaaagtgctgggattacaagcgtgagccaccacatgaccctgccttttccaggttcctttttttggttgttgttatttgttactgattttagttgctctttaattttatttatttatttttttgcttcccatgtagattggatgctctttaaagacttttttcaagtaatcccatgagccttggttgtcgcatttgagttgggcactgaaaactgataaataaatgcggtttgctgattgtgggccccagtataatctgactgtactgttctggcatcttatgaaatgcagatgttgggatctttagagctgttcatttatgctactcagatccctagttttatatgccaaagtataacttatgctttatgtgatttccactttagagattttattaaaactttttatttatagtctaatgtatgctgttgtaaaaattgaagttctatgtttatttgaaaatagtatttattaagggaaaaaatctgtatttgttaattgtattgcttaaattccatgtatttttgttgccttagactacttgattagctgatatttgataaacgtgtcagccctacaaaataattgtggatttgtcaatttccgtttgtatttctaacagtttttatgttatatattcatagctttatatttaggctgggttaagcatgaatgttatatacgtaaataattgtactttttatcaatataaaatatgcagcattttctcaaataattctctttgcttaacacattccctttttatattgtcattcttttttcacatttgttttatttgttcctctatcttccctttttttttttttttgagacagaatttcactcttgttgcccaggctggagtgcagtggcacaatcttggctcactgcaacttctgcctcatgggtttaagtgattctcctgcctcagtttcctgagtaactgagattataggctcctgccaccaggcctggctaatttttgcattttagtagcgacagggtttcatcatgttggtcaggctggtgtcgaactccttacctcaggtgatccacccaccttggcctcccaaagtgctgggattaccagtgtgagccactgtgcctggccctttatcttcttttttatgtcattttaattttgatgtgtttcttataaataaacagtgtttagacttttttttaaagcctgttccacaggttttttgtaatagagaactttaacgtacatttatagtaataattggtatgtttggagttggtcttcttcctgccttctatgtgttttaattggtatgtttggagttggtcttcttcctgccttctatgtgttttatttctgccttgcctttcttagatagatttattttctttgcattttacacctagtagtctatcttttatgtaattttcattatttaagtgacttaaatgaaattatgtatttttcattgttaatttttaaaacacctacatattagactataaatctactttataaaaataaaattatttctctacttttataggtggtattgtggaatggcaaagcacagactctagaacaaggcagcttctgtttacaccttggcttggctttgccacttttttattgtaatcctcttgtgcatccatttcttttttggttaaagtagagatggggtctcactgttgctgatctgaaactctgggctcaagtgatcctcctgcctcagcctcccaaagtgctaggatttcaggcgtgagccaccaagcccacgtaggtacctacttcacagaggtgttgttgagtttaaatatgttaatatatgtaaagcaccagaacagggtctggaagtcaataaatgttagctattattaggtgtcagttattaacaaaagcttgaaactacattattagcgtagttcttgtgggttcctgtgtttaatgcttgcctggttcttaacctatattagctttctgtgtgtttaaaaaaaatctttatcttttgtgtaagtcggttttccttattcttacacactttaatgtatgtaggctgctctgttgtaaagaccatctgtcttctgctgggctgaggacctctgtgcatttccactctttgaccatctcaggacaggcacaacaaaaaaatgttaaaaacttagatgttgtcatggatatgtggatgctttacattgtgtgtgtgtgcgtgtgtgtgtaattttagtgtgaaaaatggtatcaggtttctccaaggcaacaaaaccattaggagattttgtatataacagatagatattatatgtaatttcaaggaattagtttacttggttgttggggctggcaagtctgaaatctgtcttctggttgagctggccattgggttgggaactctagcacaggagctgatgctgcacctttagccaggatttctcaggaaatcccagtttactgccttgtaagtgattagatgagacccaaccacataattgagggtagtctcctttacataaagtcagctgattgtaggtttaaccatatctacaaaaatacctttatagcaacacctagttagtatttgatagaataattgaatactgtggcaaaattgtaacataaaactaaccatcacagatgagtatattatttcacaatagattgtccttcatatcagcttcttgaaattaaaaaaaaagctactgtgtgtaatactatatggaaattaaacattgtccatatttttagtaaaataataattcatagttatactctgctaacatgagatcaacttatgcactaatggaccatatttctaaaagtttgtgagttgtttgttgacttaagtgagaaaggcctgtaatgccagtaccggaaatgattgttcccagaataaccagcaaaagctgatacccagacagtatatctgaaatatgttacatatgaaaaatatatttaaaaatgaaagtgagaggaccgggtgaggtggctcacgcctgtaatcctagcactttgggaggccgaggcaagtggatcacaaagtcaggtgtttgagacaagcctggccaaaatggtgaaaccccgtctctactaagaatataaaaattagccgggcgtggtggcagttgcctgtaatcccagctacccaggaggctgagggaggagaattgcttgaacccaggaggcggaggttgcagtgagccgagatcgtgccactacactccagtctgggtgacagagcaagactctgtctcgggggggaaaaagaaaggtaagtgagcaaacatctgtttggtgccagtaatattaatagtttagactttaacctttgcttataacagtttttgtgggaaggtttattagttggttctcaaatgtgaaggccacatgcttccttcaattaaggcataataatgaaaggacatactgaggctacattacatctttgttggtgaaatcaggagtagaggaaagggtagaaactagaacagatacagattgggaagtggagaggtaagattcttagcccataattttcagagaaagtagttgtttgttgatggcaccaaacagggctcctgatttatgataaagaatcatacatttggtaaaagttacagtctgaagtacaaaaccccaatgattttccattctagtgcttcagtgagaagcttaacagtgtactatgtataggtagataagaataaagtaaaagacagaattctttgctgttaaaatgaaagaataacttttacttagcatagtatggtagtatactaataaatggtacacactgctagtcataaaatttagattttgtccccagttctacctgtatacctgtattattagtcctttgttctctgttcagtgtcctagtagaaactgtgtggttatactccttttttttttttttttttttgagacagagtctcgctctgtcactcagactggaatgcagtgattcaatactcactgcagcctcaaactcctgggctcaagcagtcctcccactgagtagctgagactacaggtgtatgccaccaaacgccaggctaagttttttaaagaacttctgaaagcatagagttttcaggatgtttttataatatttcatagatggtaaggcagtgtcagattgattcagttatgtcatcaaatgtctctctgccattctcagcatgtatttcaggctaatgccccttatggccctattttcagccatcacatgcatcctggatagcattcagcagcagaagcagcaatttctttaacaatgcttcatatcttactggtcagagttgtgggtcacatggctttgtctagatcaaatactgaaaatggaacttccatgattgggttaggccagttatgactgtcttgacaggagatggggcttgcttttcctctagtacaagatagatacttaaaccaaataaaggattatggttagcaaggaggagggggtttgggaatgacccagtagtagactgccaacagtgcctgctacttaactcactcttgcgagatggggaagtaagatagtcttgagggttggggctatagtagaatagaaggaaatgactttttggagaaagtgatttctttttatcttttcatgtttttattttttattacattttgttttttacttagggatggggtcttgctatgttgaccaagctgatctcaaactcctggcctcaagccatcctgtcatctcggcctcccaaaatggtgggattacaggcatgagtcaccgtgccacatctggagaaagtggtctgtaaactaagttttgtggacaaatggagattattagggagaaagacttttccttatccttctgagcccttggttgtctatgggtactgttgcttgttttcatttttaaggatagtaaacatacttaacatttcccaaggaatctgtcttgacctgtgtatgtgtgtgtaaaagctgcattgtggactttttgaaaaagaacatataataaccagttcagttgaatgcaacgtgctctgtgagattaagggctcacaagaaactgctaatcacagttttaaaaagacaatcttttgatgtctcatatcttagtgttactatgagtttatagcctgttattttgtttagtgtttactctgtcttgcctttcttttttccttccttcctttccttttctttcttttcttttggaagggaacttaagtacatcttctggttctttctgcctgatctcttcctcttaattttagaaatgaagatgtagaagtccaaagaggatttacttgatgatttgactagaaaagctaggtttaaccaggtcttctatggaaatgaattatagctgtagtgaaaaaataagggaaatgtgctatgtttggattctagagacagttctctagaatagaaaatcttctaaacccaagacagcttgatatttgaaaaagggggtataaaacctttttttaaggattggcagatcgtagtaaatattgtggatgtcatagtaccacaatatataataattaagtaacatacttagaatagaaatctagaaatgtcagtaacagaattttactatttctctcaccacacacacacacacacacacacacacacacatacacaaaattatgaacacataataaaggacttccttataactaagaaaaagataatacatgaatagagaggcctatctggaaattttcatgtatatgcacaacatttcagtgataacagagtggctgttataaataatgatcgtaaagtgcggttataaattatatcatgtatgtgaaaattattttttgtacagtatggttctttatctaaaacgtagatctttgcttttctataataacattctcttctaggtttcagcttatacttgacgcaagaggttctttgagagagcttcttttttaaaaaaaaaaaaactacatttcctattacattttatatctagcctgccaccctaagatggaaatccattttagttcatcaggtatttattaatggtttcactttgtgaaagatattgaagagggcagataaaattgtcatttacagcttacttagcatagtacattgtgcttaaaatatatgacattaatataaatgatgccctttcttgataattttttttatctctaatcttaaattgggggatgatgtttctttttagcctttttatttttatacatatggttgtccaagagtcatgtattaacccaggtttagaacacatcataatgtcactgcctccacttcccagactccaatagggaatagcagctttattctacccaggtcctatcagagggtgcacaacagatgaggggaattgcaggatttcccagtacaccaaactgttggtcagccttcctgcctttattccccatgtagacctaaatacagaaactttttaattatcttggttatacctaaacattgctactcccctacgctagccccgcaaaagtgagagagcttgtcaaggcaaagttttttgaaggaagaagccacatgaaatgagagagggaaataatgtatactgtgagcttaggaagagcaaaggtataaaggtgatagagagattggcacagaactacagtagtatatgtattagttctgattaataaatgtttcaatttttatgatactgttattcttttttttttttttttttttttgaggcggagtctcactgtgtcacccaggctggagcgcagtggtgcaatctcggctcactgcagcctccgcttcccagcctcaagtgattctccctgcctcagcctcctgagtagctgggactacaggcacccgccaccacgcccagctaatttttttgtacttttagtagatgtggggtttcaccatgttggccagcctggtctagaactcctgacctcgtgatccgcccacctcagcctcccaaagtgctgggattacaggtatgagtcaccacgcccggctgatactgttattcttgtaacaaaaaagcttacaatgaggaatacatttatattgttttgcttaagattaaagccatataaaaaatttacagcagaacctggaagttctttcttgaccctaacctcctttactcctttgcccagaggcaaccatatatttgtatgtatttccaattcttcatgcttttacacaaatatgtactcacattaaaaaaaatatatataaacatattattctatgactttttttttctttaattcatagagttcttaatcaggtctagtgaactcaggacaagagacacaacttggatataaatacctttaagcctctgttttcttcatgtgtaaaatgagggtaatgttttagtgttattacaaggtttaaatgagactacatgtggacaccttagcctggtaactaagtcacggtagctgctattattaataaacaaggctaacatgcttctatatgatcctcctgtacctaagaaataaacttatagcaatagagcacaatcagccagccatttaattttagagaataacatcttcatgtggcctagtaaaaatgactgttaccaaataataggctttttatgatgaatgaatgagtcagatgttttctctgtagtttttagaatcattgagataccaaattcttagctgttttatggaagaactttataaagtagagtttactgaagttgggtgactagaaaagcctataaagttaaaaaggagaaaacgtgttggttctcctaattaatgtaaattaaaacaaggagactgcccacaagagctaaatagtaaatttcggtcaaaaataatgatagtatttcttttttcaattggtagtaaaacattggaaataattattccaaatgaaaagacaggttgataacagttttcaaaaggatcaggataatagagattcatattgggtgacggtatggttttagaactgtcttccctattcttcctaaatgaagtgggccatttcttctcactatatgtatattcttgtctggccctgagacagaacactggattagaagcactataggttgactaaatatggcagttcttaaatctatatgatgatagtttgcattattttattgttaacttaccatttgcatttttataaacagctttattgagataattcacatactatacaattcacttggttaaaatatacaattcagtggtttttaaagtatattcagaattgtgcaaccatcacagtactaagttttagaacattttaatcacttcctccaaaaaaaaagaaaactccatttcccctcaactcttccagttgtgtggataaccactaacctactatgtctctagatttgcctattctggacattttatataagtggaaccatataatatgtgatctcttgtgactggcttttttcactcagtgtaatgtttttaatgttcatccatgttatagcatggatcagcacttcatttttatggttgagtaattaatatttgattgtatggagataccattgtgtttattcatcagttgattgacatttgtgttgtttcccgttttgggttattatgaataatgctgctataaacgttcatttataaggttttatattaacatatacttgaatttctcttgagcagatagtaaagagtgaaattgctgggttatatggtaattctgttgaaccttttaaggaactgcaaacctgtttttcaaggtgactaccattttacattctctacagcagcgaatgagggttccaatttctttacatcttcatctgcgctaataaggttaagcataatgttagctgtggggttttcctagatgccctttatccaactgaagatgttcctttttcctagttggttgaatttttttttttttttaaatgaaagggtgttggacttcggtgctttttctgtgtctatggagataatcgtatgggctttgtactgtatggggtgtactacactaatttttggatgctaaaccttggattcctgggataaatcccatgtggccatgggaaataatcctttttagttgctggatttggtttgtttgtattttggtgaggatttttgtgtttgtattaataaggaatattcttcttttaaaatatttatgtattcatttattagagacagtcttgctctgtcatcttggctggagtgcagaggcacaatcatggctcactgtaacctcaaactcctgagctcaagcagttctcccacctctgtctcccaagtagctaagactatgggtgcgtatcatcgtgcctggctaatttttttaaaaaattgtgtagagatgtggtcttgctgtgttgcccaagctggtcttgttctaacctcaagtgatcctcctgccttggcctcctgaagagctaggattacagtcatgagctaccatgcctggccaagatactgtcctttagtttccttgtgatgtttctatctggcattggtgttaggttaatactggcctcatagaattcctcttatattttttggaagaatttgtgaataattgatgtcaattatttaagtgttttatagaactcatcagtgaagtgatctgggcctgggcttttcattgtggaaagtttgttaaattactaattcagtctcctttcttgttataggtctattcagattttccgttgttttttttttttttttcttgagtcagtttctgatatggtttggctctgtatccccccacccaagtctcactttgaaatgtaataatcttcatgtgtcagtggcggggccagctggaggtaattgaatcatgggggccgtttcctccatactgttctcatgatagtgaataagtctcagagatctgatggtttgataaggggaaactgttttgcttggttggttctcattctctgtctgccaccattgatgtaagacatgacttgctcctccttgccttctgccacgattctgaggcctccccagccacatagaactgtgagtacagttaaacccagtcttggatatgtctttatcagcagcatgaaaactgactaatacagtttctatagttcgtgtctttctaggaatttctttccattttatctagatcatctactctcttgctatacagtttcttgaagtttgcccattataatattgatactgttgcttactgttttctctttgttcctttaaagaaaaaaatttttatgctttgggggtcatttaacatttctctttttatccattggcttaacaagtatcttcttttctccttcttctttttgagacagagtcacactctgtcacccaggccagagtgcactggtgcaaatctcagctgactgcaacctctgcctcccgggttcaagtgaccttcccaccgcagcctcttgagtagccctccaccatgcccagctaatttttgtatgcgtttgtagagacagggtttcaccatgttgtccaggctggtcttgaattcctgagctcaggtgatctgcccttcctggcctcccaaagtgttgggattacagacgtgagccaccactcctgaccatgtatcttatttttaattttttttagtggttgctcttgtgcttataatatacattttaaattaatctgccttcaaataatattctacccttcaagattagtataaggaccttgtaacagtatattcttaattcctttattccatctgttgtgctacttgtcatgtatttttctgaagtataggaaccagagaaattataaggcagaggagtaggaaacacatactttcctgtattacgcaataaggagcttgataattggaaagggaaagggaaatgaatatatgagaaattcagaaagaatataatcagaattcttaatgaaatttgaaacctcaggtgatccacccaccttggcctcccaaagtgctgggattacaggcatgagccactgcgcccagctgaaatctcaaattgaagttgaatgatcaatttgggataacttaaatttctttgtggctatagacagatctatttcaagaagtctccctacctaaccatttttcctgcccctaaaaaacaaaaccagaaagttctgagaatcatcctagacttctcttcctcctttatatcttcattttccatttctaatcagccaccttgtcatcttgattctccctcatctgtaccaatatatcaaccaaaaatgatcttcctaagtctaattacacttctctctgttccacaccaatgcaagcatgatcaatcttatgaagatgcaaatctgatcacatcttttaaaattttcggtggtgccctattctccacagtataaattttaatctccttattgttatgtgaagttctcaagattttagtgtttatccaatcttctctcctaccatctcttctaaaattatataaacaattcccagactttattttaagttactatacatatgctgattttcatttccacacccacgttcttctttttgcattcctattaaattcatattcatgaaaataaataaatgtttctttaaagaatcctctcagaaattaatctcttttttgtctccttgttgtacttatacgctcttctcataatgattgtgtcattcttactgtgattactgtgttctttaaggctgtagctataattgttggatggatattgtgttcaataaagattggcagaatttagctagagtttagtaacatttttatgattaccttctatataagagaaacatcagattagtggttttgaatcagtattgtaatgtaaaatttctttataccaataaatttaagttttataaaaaggtagattttgggggaatgttagattttcaaatgatcgtaataatacagcagcaatcctaatgatagtatgcaaattatcggcgttcagttggtgtcaatttcaactttaggtattctacctatgccatacttttatttattattgcatcaaatgcagacaggttctactctctactttgtaagatgaccataatactctcactctcttaaaatcactatctggccaggcggctgtggctcacacctgtaatcccagcactttcggaggccgaggcaggtggatcactggaggtcaagagttcgagacgagcctggccaacaccgtgaaacccccatctttactgaaaatacaaaaaaattagccgggcatggtggcgggcgcctgtaatctcagctactcaggaggctgagacaggataatcgcttgaacccgggaagtggaggttgcagtgagccgagatcgcaccactgcactccagcctgggtgacagagtgagactctgtctcaaaaaaaaaaaaaaaaaatcactgtctaacctctattctatgtattttacattgtgaagatgagtaatattaatatctgccttctgtcttttaaaaatgtctaaaagtgaaaatcaattgtgtctggctgacatttctctaaggtaactagttatggatagagctcctttttatacttccttgttctgcttcctggttttcctgtcatttcaaattgccttggtttttttcttattgcattttctttttttttttgtttttgagacggagtctggctctgtcgcccaggctggagtgcagtggcccgatctcggctcactgcaacctccgcctcccgggttcacgccattctcccacctcagcctcctgaatagctgggactacaggcaccctccaccacgcccggctaattttttatattttttagtagagacggagtttcactgtgttagccaggatggtctcgatctcctgacctcgtgatctgcccgcctcggcctcccaaagtgctgggatgacaggcgtgagccaccaagcccagccttactattgcattttcaaagttttcattttcccatccagtatatcgagtcttctgccttcctagggaattcttcagacttttctatcctgctgatctgaacttactgctttctgagtatgctgcacaactgtcttttttttcctttaattgtgttcctctttttaataaattatttaaaaatctatgaatacatatttaagtgtcttgctagtaagaaaatatgcatgtataataaactttgcctccacatatgaacatacttttcctttttaaaaaaatctggttttgtttaggattctgtttatttcattttcctccttgacactcgtggtatttctccccatctcctagatatttttttggttttggaaacttctcttaatttttactttttctctaccatctattgtacggggatgttaaatagacccttgtaaatatgtttttctgttttgggaagtgttctaattcttggataattttcactccttcatttttccctattctcttttttgggggggcatatatttatatgttggaattcttgtaacaaccttccccccgtccccaactacttgcctgatattttaggttgacattattttgcaagctttcattgaatttctgttttggtgagcatgtcttttttgagacagagtcttgctctgttgcccaggctggagtgcagtggcgcaatttcagcttacagcagcctcaacctcctgggctcaagcaatcctcccacctcacctcctgagtagctgagacctcaggcgtgcaccaccatgtctgtctaatttttgtattttttttttttttgtagagatggggttttaccctgtttcccaggctgcccatgaactcctgagctcaagcaatctggctgccttggcctcccaaagtgctgggattacaggcatgagccaccgcacccggcctgcatgtctgtcattttaagagtttcttctgattttctcacccctaatcattttctcttcttgctttatattacagtatttttatgccttctctaaagtaaaagatttcttttaaaattataaaagtagattgggcagggtggcttacaccttgtaatcgcagcattttaggaggctgaaacaggaggatagcttgagaccaagaattcagggccaacctgggcaacatagtgagaccctgacattacaaaaagtttttatttatttattttttgagacggaatcttgctgttgcccaggctggagtgcagtggcacaatctcggcttgttgcaacctctgcctcccgggttcaaatgattctcctgctttagcctcccaagtagctgggattacaggtgcatgccaccacacgtgcctactttttgtatttttagtagagacggggtttcaccatgttggccaggctgttctcaagctcctgacctcaagtgatccacctgcctcggcctcccaaagtgctgggattacaccgcgcttgtcctacaaaaatttttaaagaaagttaattaggcacagtggtgcgcacccatagtcccagctacttgggaggctgagacggtaggattgcttgagcctgggaggttaaggctgcaatggtctaggactggactactgcactccagtctgggcaacagagtaagaccctctgtcaaaaaaaaattttttttaaactgaatatttatttggactgaaagaagaaatgacaacaaattataaagttaaaagaagtcatatcaaaaaatcacaaaatccagaaaaaaacatttattaagtaccagacacatcctacttttgcttttccttcattttttggcttcatcttctttgatcacctttttatttggcagtgagtttataatactttatatatagaaaataaaaagatcatatagctttcctctagcattcaggtttttttgctatatgggtgttaataatttttattttaattgcctgctataattattttttattttggtaaaatatataacttaaaatttaccattttaaaaagtatattctatttcctgaattttttgtttctctgaggcaatttcccctttttgatgggaagagtgttttatctttgtgagttctcaagtgtgatgatctgtgggcctgctgatatttaagaatgaggcttaccattaggcaaactctgtatttagagtttgtctgtatttagagctcatagtaagcctcattacttgttaatggtcagacttcattctcaagtgaatggtcagggaacccccaaaataacagatggtaactggttttgttctgggatgttaatttgcactctaatggccctactagttgttttgatatctttagagtagaaccttaatttcctgcctacccaagggtaagcattgggtgatcattttgctgtgcgcacagaaggtgagaggcattgatttgtctgtcctacagattcttcgtttttaaaaatctcatgtctcatttctgctttactggatctcattggtttttggaggaaaggtattggttcctttctcaggtaccctccaactatattttaggctgttacttcttgggccagaatttcgccatttgtatctgctgatggctcctctctcatcctctttattgtttgcatttaatattttatttctgtaactttcttgagttatgttaatggaatctggagggaaagtgggtaacagtaaagtaagctgtttatactgtcattctgaattgtaagcccctgcagacttcttgaatgatattaatgaatgttgagtcacctttcaatatggagggacaagcctgttctttggtgtcacgtgtatcgctctttggttgtttgcttagcagcgttgaaaattgaggaggcagaggtgtatgtatgtatttggttcaggatagtatctcactagcaactcccaatataacctttttttctttgtgtgtgtgtgtgtgtgtgtgtgtgtgtgtgtgtgtgtgtagtggcacgatcacactcattgcagcctcaacctcctgggcttaagggatcctcccacctcagcctacccagtagctgggactacagccatgtgccaccatgcctgaccatttttttttttttttaagagacaaggtcttgctctgttgcccaggctggtcttgatctcctggcctcaagtggtcctcctgcctcggcctcccaaagtgctgggattataggtgtcaaccattgtgcccagcaaaccattcctattttcccactaaaattatcataaaatcaggaatgaatgaaagctccaatcattactacaaatgaaaattgacagatataaagacagaactctgggagtaagtggtactaatgatgaggcagattgaatcagagaaatacttatacatttcaatttgtacaatgtgtatttactttgttttttgagtgatgaccaccaggaggaaaaatccttgtctgtccccattgtttgttcaaaagtcagacctggagcccctgctaaccagaaaattgagcagtcatcaacttcccctcacagtttttctgcatgtaagaatattagtaaaattagggtgatggggaagagggctgtggaaatgggaaactgataatgtacatgtagtataattgggcattattatccaaaatatggtacatatacttctagaaatagtagatattttaggttgtacgtgaatgaacgttttaaagccccaaaatttcttttaataactaacagcaatactaattagttacgaggatgctaaaataggtagtaagtacctgttttatgatgttaaaaatatcaagtaaatattatagctggttattagttttggcataacattaatgacagaaacttgagaaacatttcctctagataaaaaagcttgctagaaactggcaacagtactgctttttacacgtatcacagttgtaaatatgagaagggagtttgacttccacttgtgtgtcagacagcggggtcataaacagtaggtttggaggatctatccttgttcagtatagaagttctattatgattgatatggaaatgactttgacttattgttgaagccctgatactaaacaaatctgatttcgtttgaatctttttttccctctagaagtaaaaaaggacaattaaaaaaaaaatcctttacttaattttcagtttcttctttgaataacaaagtttggaagtatagggggttggaactgatctcttgtcacagagtttaaaggttaagactggggaattttatttgtttctaaatgaaaatgttatgatttacataaatgaaactacagtgtgaagatggacagtaaatgagatagatatttttgaagcagcaactgattttctttttgtcagactctgcagccagcctgaggccacaaataaatgtagtcagaactagtttcataaagttagatggatatgttcaataaataagagacattttccatagtattcatattttgaacatgatgaacaagatttagccaaaaaatatgtgcatattcttatgactcagggacatcacacaaaaaagaaaaaagaataaaattgaagaaattaatgtgtgtattcttttttccctggattgataagcagcttctaaaagtatgctaattcaaaggttagttttatgtattgtaaactgtagttagataaataatggttactttgaaaatccacagtaaatgctgctgatttgacaaggaaatgtgtttagttgtactctaaggatggccttctttgttggggtacaaaattagttcatttttaaagatcataaacaaaatagcagaattgagcaatgtaagtacagaaataacatttatataaaaatcaaagtgcaaaacagtatagtatatcattcatgaataagtaatatgttgtaaaactataaaaatatacaatagcgtgataaataccatattccagatagtggctctggggatgtggagagaagaatagtggtattatttcatagaaaataatctaaaagaaatatggcggctgggcacagtggctcacgcctgtaatcccagcactttgggaggctgaggcgggtggatcacctgaggtcaggagttcgagactagcctggccaacatagtgaaaccctgtctactcccagctactcaggagactgaggcaggagaatcgcttgaacccaggaagcagatgttgcagtgagccgagattgtgccactgcactccagcctgtgtgacagagtgagactccatctcaaaaaataaaaataataaaaaaagaaatatggcaaaacattaagaagtgacaaatatcagagggacatatatatattccacatttctgtatgcttgaaaacatttatgtaaatttttctaatgtgtacagtgactttttaaaagtaatatgctaaaaccaatccattgagtgaaatgacaattggattaaattataacaacaatattaatgcagacaactctattttctagttacacttatcaagagattagtattgaattatttacttgctttgcaaataagaaaatgtaaaattttaaacttttctcttatttaaagacctaagatgaccaatagacactttttctcatgtacctcaagtccttaccaagtataagaagcagaacagtatctgtatcttcgaagctctcagtgtacttctccctagtaacatctccctgcctcccctgtcctgaattttacatttcattttattgtcttaagtgccaagggcaaggtttgtcaaaatcaagtaatgttcagcctttttggtagtgaaatatacataacataaatttaccattgtaaccatttacaagtaacttagaagtatacagttttgtggcattaagcacatttacaatgttgtgcaattactatcatccatatctagaactttttcagcatcccaaactgaaagttttttttttttttggcgcgatctcagctcactgcaacctatgcgtcccaggttcaagcgattctcctgcctcaccctcccgagtagctgagattacaggctcccgctgccacgcccagctaatttttgtatttttagtagaggtggggtttcaccatgttgaccatgctggtctcaaactccttacctcaggtgatccacctgccttggcctcccaaagtgttgggattacaggcgtgagccaccgtgcctggccccaaaccgaaactcttagctcttaaaaactgagtccccattgtcccctttccctggtccctggcaaccttttttctactttctgtctctgtgaatttgcatatgctagatgtacctcatgtaagtagactcagacattatttatccttttgtgtctggcttattttacctagcttaatgttctcaaggttcatttgagttgtaccatgtgtcaaaatttggtacatatttttatattttatatatataattaatattttataaatattatatatatataatataaaatataattaatattttaatattaaataatattcctttatatttatatattttgttttctgttcatttgttgatggacacttgggtcattgtaccctttgactattgtaaaaaatgctgctgttaacattggtgttcatgtatctgttggagtgcctgctttcagtttcttggggcatatacttagaagtgaagttgctgaattgtatggtaattctgtgttcaactttttgaggaactatcgtgctcttttccacattgtctataccattttacaatcacagcagtgcacgaggatttcactttgtccacatccttgccaacacttttttgcttccctactggccctttttttggggaggggcgggtaatagccatcctgattggtgtgaagtggtatcttactgctagacatgttttaaaggaaaaaaggacagttctttaatgtgacttaaattgttaaaacattgtatgtgtaaatggaaaaaatacatatacactccttgtgacttaatgatcttacacagctataacagcaaaaccaatttttagtgtaagtgctaattaaaacctactaaaattaatgtttttgacagtgcaaaccaaattgtggctgtcttcctttataaataacttagtcttatgtgagagtatctatttcagttacaaattataactgcagaaactttaactggtaaaagaattcagagtatatagttaggaaagtttgctgacattaggacgtgccaaactacctatagtcaaaattaattaacaaaattaatgattaatgtgtcaaacttataaattgtcatttaggttatcatttggttggtaatatgattcaaaaaacaaactgcctaatgaaatcttgtggtcacctacatgagccacaatatacatatatttatttttaattaattgtctaagttagaacccaaaattcttttttctgaaatttaaagaagaaaaaaaaattcttttcgccacctctgataatatcgatagtccaaaattaagaaaatgctaacttctcctgatgacttcttcaacagcctatttcagcctgtgaaacatattcaggaatacatatgggagaataaatcaatgtgaatggggtagctgccataaaaataatgttcttaatttgtgtaattattttcagttttcaaagcacacttacaatatgtcgagccctcagaataattcttagctattcaggaaagatggtgttttcattttacaggcaaggaaactaaaactcatggcagttactttagaaataggagtgcaaaagaagaaataagcatggcatgtgagaataacaagagtccttatctgtagtgggttgtttttggaaagtattgagaaataagctggatccaagggactttggaatttggatttgatgtaatggagcattttccaaacttgctggtcataagaaatcccttccttggagactggggccagggtcctagaatcctttcgtaacaagtgcccctgaagattcttgtacttcagcaaagttggttaattatgcatttactatttttgagcaaggagcttggtgtcataaaaatagtgtctgggggaatatctttatctaaagggtaggttgaagggtaaagagagtcatcaggcaatgtttattttgatatgacgtagttgtggcttttattagtttgtgaccatggaaatgagatatggggaatcatggaattatagagattgcctgggaagacaaagggaaatagggaatgagtgatttgtggagagactttataggcttggacatatattgagtctttgctcataaaatgtcgtagatatttggaaatctaatttgaattccagaattagtaaaacattacacttaagtcagaccttgccaggcataaagatattgtatatttttatgtacatgctcaatatcgtatattctcaatataaaactcagttgcaggttgcatttgttgtagaaattctgctttcaggttttgtttttcctgactcttcaaatcttctcgctgggcttctgggctagatctccctataaatttgaaatagttattccttattccccaagtaagtatggaaaagagggaaagagggatagaaaggttaagattgagctgataagaagacccttgtggcggggtggggggttggtgtggggagtgggtgggaaggtagtacacagtatttaaagttaacaagagctgggtgtggtggttaatgcctgtaatcccagcactttgggaggccaaggcagagaatcacttgaggccaggaattctagaccagcctgggcaacagagtgagaccctgtctctgttttttttttttttttttccggagattaatgagtcctccctcttttgcttttatttctttaagtgaaagccacatcaggcacactgaaaacctaactctttgtttttatgtactgggcttattttttttcttgatttctttcctgaacaaaatgaaacaattctttgagatgcttgtctttgtgatgtgcacaaccacttttgctttcctgtggtggcagattcttacaggatgacccactaagtttcagtgctaataactccatttgagcttttcagttctgttttgttggtttcccctttggcaaaccctcattaccctattcaaaaaactttgggaactgtttcttccccatttgctgcagagtaacatttgtctctgaagtgtaagatttccttccagtagggagcaataattcttttttttttttttttttttttttttgagacggaatctggctctgtggcccaggctggagtgcagtggcgcaatctcggctcactgcaagctccgcctcccgggttcacgccattctccggcctcagcctcccgagtagctgggactacaggcgcgcgccactacgcctggctaattttttgtatttttagtagagacggggtttcaccgtgttagccaggatggtctcgatctcctgacctcgtgatccgcccgcctcggcctcccaaagtgctgggattccaggcgtgagccaccgcgcccggccgggagcaataattcttctattattattctcattcacatttatctttcctttttctccccttctcagccttcttgctttcttcaggaagacctcctgcaagacctcacctatagtagtttgagtttaaccctgttagctgctttcacattcaaatcaatttaatctactttaataaaaaactttaaaaatttatgtgaatgactaggtatggttctaagttttgctatgcaatagatactgtaagtcacttagtgaaagtagtttgcctttttttttcttttttcttttggagacggggttttgctatgttgtaggctggtctcaagctcctggcctcaagcagttcttctgccctagcctcccaaagtgtgagccgccatgcccagccctagtttgccattttctgttttatttattaatgtatttttatttgttgcctttgtccacatgttctaagccattttctaatagaactaaatgtgttttttttttctttttgtggttcagctattatatgtatctgctacttttagcattaacctaaagcttcctgtatatgccaagtcccaggtattttggaatcccatgtggcttttgtgccctccaaagagaggtggagagaacctcttagactccaacttttacatactcttggcccagatttggggattaagtgaagggtgcctaatgaatagaacctatgcattcgtatacatctggcttgagaaaactgtatctctctctttttttttttttttttttgagaaggagttccactcttgttgcctaggctggaatgcaatggcgagatctcgactcactgcaatctccgcttcccaggttcaagcgattctctggcctcagcctcccaagtacctcggattacaggcgcctgccaccacgcccggctaatttttgtatttttagtagaaatggggtttcaccatcttggccagtctggtcttgaactcctgacctcaggtgatctgcccaccttggcctcccaaagtgctgggattacaggcgtgagccaccgcacctggcctcctatctctcttataagtagacttttcttcttgcttctttgaaacagaaactttttgtaaataaataaagtgtataaaggtgagccatattgggaagaaggggctgatagaggagttagaacaaccaggtaaccagatttttttttcctattcttttgaggaaaaaaaaaaaaaaaaaattttttttttttttggtctttctgaaactggtgctatttcagaatgataggtaaaagtctccatggagaagcaggggatgtgatgccatgtttacctgcccctcccccccataattatgatatcttttcacccattgaggaaagttgggctcacatagactctcttctttatgcgatagaccccaaatttcatctcgtaagagtaccagactggaaggtcataaagaaatctgcagtaggaatttaatctgtagatttggccacataaaatgcaggtgtaatttttatattatacttcaaaacaccttgaaagccatgttagtctttttgctatctttaacagttaagaatttttgcatgagaattattattttgtttctagttgtagtttttccaacctttcccaggccttcaatctctaattctgaagtttttaagaagagttagttacctacagttaatacttctgtcatctttgaattgctgttataccatataggcctatgagagagttgccagacttaaataattatttatatgcttaatttcttttaacacatagaataattctttaaaaaattgttttctctgtaaactgtaactgaaacccatgctgccctggaaagcaatgttacaaactgctgtaccctctgcctgaagacaagtttttatttctttatcctaatacccaacaacaattagtatcactttaaaagataaaatagaggccgggcacggtggctcacgtctgtaatcccagcactttgggtggctgagatgggcagatcacaaggtcaggagtcccagaccagcctgaccaacatggcgaaaccctgtctctactaaaaatacaaaaattagccaggtgtggtggcacacgcctgtaatcccagctattcaggaggctgaggcagaattgcctgaacccgggaggtggaggttgcagtgagcagagattgtgtcactgcactccagcctgtgcgacagagcaagactccgtctcaaaaaaaaaaaaggtgaaatagatgcccatgtcttgctaagtcagtgtggtgcagaaaatgataaggagggagtattccaatattgacctaaaatattttaatcaagaattccagacacttttctccacccatattttgatatgtagagttatcatgtgtggtcttaatttagcagtaaaattttgaatattgcacatatataatactagagaaatttaaatgttaataagacttgaggaccagataattttggggatacagttgttagctgtaaagtaaaaatttcaagtttaatgaatgaaaactagtctcactgctccattagcacaattggtttggaaggtttgcttctgggcgaataaagtgaacaatagcaaaggatgggattgctactttaaaaatactaaaatatgagggtaaagagagatgtctgtcagaggatgtttaaaatgaaacagcttcttaaaagcaagggacggaagatgtgcaaatggttatgaggtcattgtactaaacattagcattgtgcttctcactccagaagaaattacatcagtggataatctactgagcactgtaatttgggtagtactgagatgagcaattgttttagttgttgcctgacccccaccccacccccagcagcctggaactgtgcatgttatgaagaggtcatgtgacacggatccttggttttgctcatttatcctgtcaaaacaacttaatgtagatggaaagaaatgaacgaaatgaatagaatgggttagctgtatcagctttagtttatattgaaggtaatgaatgctgcaattgggatagtatagtatattaaggccccaggaatatccagctccataatggtgaagagaaggttctaaaaagcaacagtggctaatccattctaagtctcacttgatgttttaatgctactttttgatacggtcttttaaaattttatcattgtattcatgataatttgattgacagttggtaatatttaaacaatatatggttcctcttattttaccttcagctgtaatttagtataaagttcctatttcttttcaataattattatataataacaaacgtggatcttctgagaagaaaattattttagaagttttgcaaaatatttagggtttgtttgttgtcattgaaacatgagctttgaaccaaatcttcatttgtctcttagttctgtttttcatgtgaatttgagggagataataaaattttgtgagtcagttcgtctcacaacatttttctgaggattaaatgaagtgaagcagccaactagtaaatggcaaatacttggcaaaaattatttttaaaaccccaggtgttccttctgatctgtgtcttatgttagttttgatctactttattattgtcttaaagtcttttgggtgctaaaattatgtacttctctaagatattttatgaaatgttcctagattaaaaaaaaaacaatattcagttatagatggaacaagtagacaaactattgaaagaagccccaaattatttgtttaggtttcccccatttcctgctttgttgatgataatctgttgtcatgcatctgtatttctaacttcaaacattaagcaggggttctcagatcccttaaaataaataatacttttcagaaaggataaaaacacttagctatataaagtagcctgtatttatagtatagatgtcttctgggcaaattagagataaaatattctaaatatttctatggaatttttagattgtcattcagtgtattctcaaggaaaattaaatacggatttttgatggcaaagaagtcccccgtttttttccctctatgctttgctataaataagtagttggcagcttttttacaataagcttttacaaaccatttttaaaaatcaaaagctgggacctttgcaagttgatcattctgtatgggttgtgttggacttaactgagactcagaggcccaatttcaattctcatttttcttttaagtcacaggaattttttatccttggggaaatgctaactgcttattaaggacacacacacacacttttaaaggggtattgaggggaaaagacatttatggaattcattcaacaaatggctgttgaacaagtcactatgctaggttgtcaggtgctaaagatagaacacaaaaaggtatcttgtcactgccttttcatgacaaaaagcctctgagggcttattctatgggggataagagtcaatataatgttgcctgtgattaagtgttatgtaagaggcatgtacatagtatccattggttttaatgctattgggcagagtagaaacaggagtagtaacttggtttccttttattacattccttattgggtacttttggcgacagagtgagaaccttaaagttcaattaataattgatgtaataactgaagagaaaaattaatgaacaggaaggtagatcagaaaacattgcccagaaagtagcatacagaaggaaatggaaaatgagagagaaattaaaggatattaaggataaactaaagttatacacatactcacacacatttaaaaattgtttaaaaagaaaagaagagttggaaggggaaaaaaagagaatgagaggagacagtgtttagagagatactgagaattttcctgacttgaagacaaatacttgagtatttaagttattgcttaaaagaaaaaaaaaattaggcttcatgcagtggctcacacctgtaatcccaggctttgggatgccaaagtaggaggatcaccagaagttcaagaccagccagtgcatcatagcaagacctcatctctacaaaaaattaaaaaattagccgggcaaggtggcacatgcctgtagtcctagctactctggaggctgaggtgggaggatcccttgagcccaggatttgaggctgcagtgagctatgatagcaccgctgcattccagccttggtcacagagtgacttcctgtcttttaaacaaacaaacaaaaataaaaacaatgttttggttaaagatagattgattttaatcaaggcaaagatagaactggaatttatatttaggtctttgcctccaaagcctatgttcatttcctgacattaaattgcatgtctagcaattgatgacttatgttggatatggaaagttaactgcaccttacaaaaatgagactatatctgagttacacattaacagtaaagatactaaaatgatctcaagcatgaatgtatataatccaaatctatcatttataacttcagcatttgcattttttaaacaccatcgatcatgatttagtaatgtttaagtgtctaagattaactgtctgatttggtgttttatcattttaaaccacattctgttttggtttttgattttaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtaagttcatcagtattacaaaagctgaccaagaagtatgagagaatttgattttttaaatttcaggtctaccagtttcactttggttgttcagcctaagaagggaacagtccttccaactgttactgtattagcatatttccttgcccacaaagtcctctagtatataaagtgatttgataattatttcttggtaagtattgaaatgagaagttatggccgagtgtggtggctcatgcctgtaatcccagcactttgggaggccggggcaggcggatcacctgaggttggatcacctgaggtcaggagttcgagaccagcctggccaacgtggtgaaaccccgtctctactaaaagtacaaaaattagccgggcatggtggcgtgcacctgtaaccccagctacttgggaggctgaggcaggagaatcgcttgaacctaggaggcggaggttgcagtgagctgagatcacctcacttcattccagcctaggtgagactctgtctccaaaaaaaaaaaaaaagagtggctaaggaatcagaaatcaaatgtcaaggtagccctctagtggttaaaatgagattaaggtttattgagaaactacctatttttttcatttgtattgtgctttgctatatccctgcaacttttatatcagatgcagattatattgtgacagttatcacttaaaaaatacttttagttccatttcccataacatcagaaattaatccccaaatagctagatctatcattcctttcacagaaataggtttaatgcagaaatttcccgttacttattgtaaagagcttttggtaagtgttggagtatgcctttgtaatcccaggtttcttagagcagcagtccccaacctttttggcatcagggattggtttcatggaagacagtttttccatgaactggtgcgggggtggggctggggaagtttggaatgattcaagcacattacatttattgtgcactctatttctattattattacattaaaatatataatgaaatagttatacaactcaccataatgtagaatcagtgggagccctgagcttgttttcctgcaactcaactgtcccatctgggggtgatgggagacagggcagatcatcaggcattagattctcataacgaacgctcaacctagatcccttgcatgcacagttcacagtagggttcatggccctgtgagaaatctaatgctgctgacaggagccagagctcaggtggtaatgcgagcagtgagggagcggctgtaaatacagatgaagctttgcttgctcgcctgccactcacctcctgctgtgtggccaggttcctaaaaggccatggactgatattgatctgtggctcagtggttggggacccctggtatcttagaggatctgtttttactcagagaagaacctgtagtaagttaccttgtataaattttttatttggtgaaattggatatttttaaattatcactgtggcatatattctttattaattgttaaagttaatactgctgagctgattaattccagatcattggaatacagtgttacagcacctggatatagtcacttgcatgttttctgaaatgcttacggttagcatgttgaaacatgaacagatcatttctgtcctgcaaattctaatttctttatccaacttccactcttgtttatggcaatacctttatcctagttagtcaggcttcttgatactctcttttcttccattagaatgtgctaactagcactatatacctagtactatgaacaagtgctagatatcacattctactggaagtgtctaatactgaataataagtgtttgaatgaattaaggagaattatgtggtaataattatgtgtacatcttgagattctttccactggtttggatacttacttggttgtcaacagtttgtctggcatgcctaagattactctaaaatacaatggtttacttgttttaaaaactatattgaggagctttgggtaacatagtggggtaataagcccctgtggaatggctgtcccacaccaacaaactgaaatgtggaatataataaaagttttttccaatacgtgtctaagctttaaggaaagaaaggttaacctccagataataagcagagataactcaaagccaaaacaggaacttatactctgggattttagaccacatattggttgaggagttgatgctagttttaatgtccatgcaaggacagaaagccttagaactaggtagagaggggagctagaacttagcctgtgtcaaaaaactgaactatccgtgaaaagagagacctcagtgctctagccagtgaaagctgcaaggaattttacctgtgtgcagaagactgtggataagaggggagacctatgaaaaatagaaattcacatcaaatgctaccagtgttcttaattattctgtaaactaatcttttctttttctttttttggagacagggtctcactcggttgcccaggacagagtgcagcagcacaatcatagctcactgcagcctcaaactcctgggctcagggaatccttccacctcagcctccccactacctgggactatagttgctcaccaccatacctgtctaataaaaaaacaatttttttttttttagtagagacagtgtctattttgttgcccaggctgctctcaaactcctgagctcatcctgatttggcctcatcccgatttgacctcccaaactgctgggattacaagcatgagccacggtgcccagcctgtttggtattcttccatctcatatgtagatggcgctataacataaatttgtaccatctacttggtacaggaatcccaaaccgaagaacatacatgataattgatcaggaacggaaagaaaactcccggggacattttcacagttccttggtcagtgtccagaggcaaaactgtttccaaagaagatgacctcacaattaaattacaaatcacaccaatgaaggtgaatagacacaaccagaaaatagcactgcaacaattaaggatatcatggacaagtctgaaagtgattacaaacaattatttacataatgatgtcagtaaagatatttgtaagtgtatatgaagtgtataaagagaaaagaaggaattgaaggaaaaagacaccaaagaaaaaaaagacaggcataatttaaaagcttctgaagaacttctagaaataagaacattaaaattcaaacataaatggtctaacggttaaacagcagactgaattgaattgacaggaatattaactacgaagaaatgagcaacagaacacacaaaaaagacagaaaatatttaaagaggatgacatagtagtgagaagacccagatagatttaattatctaaaaggggtttccctgtagtcctagctactctggaggctgaggcagagaatcacttgagcccaggaggtggaggttgcaatgagccgagatcgtgcctctgcactccagcctgggtgacagagcgagactccatctcaaaaataaaaatgaaaaagtagagagaatgagaaaaagaaaaatttcagaatttaagaattctgattgagaatgtatacagattcctaagcaagtagattgaaaacattcatattcatttctggaagaatggataactaggaccattggcagcatttggagaggcagattgggaaggaatgggaattaattccaaaatgcgtgctttttggacctttcgagtttctacctttgttctctatgtatatttacattgaaacagataaaacacccatagctgaaaaataagatgggaatgtatgagtcagaaaatttggattaaggccaggcgtggtagttcacacctgtaatcccagcactttgagaggctgaggcggatggatcacctgaggtcaggatcacctgaggtcagttcgaaaccagcctgtccaacatggtgaaaccccatctctactaaaaatacgaaaaattagctgggcatgatggcgggcgcctgtaatcccagctacccgggaggctgaggcaagagaatcgcttgaccccggaagtggaggttgcagtgagccgagattgtgccactgcactctagcctgggtgacagagtgagactccatctcaaaaaaagaaaaagaaaaaaaatttggattaaaagttgagataaatttagatgtatttttttaaatagacatgaaattcaaatatcatacaattaacattttagaaagtacaattcagtggcacttagtacattcacaatgttttgtaagtaccacatctatcaagttactcaacattttaatcacctcagaacactctgtgcccattaagcagttactctgcatttcccttcctccagccaggcagcgtattttttctttaattgcacattatctaagttctttttctttttacaattaaaaagaaattttcagtttctgagcttcagaggcttatgccaacaggagggtttattaagtagaaagagcattagacttgcagtagaagttgtgactgctcccaccgctgcctctgaccaactgtgattttgggcaaatagctaaccttatttgggcttcagttccccatgtgtatgtaaaacaagtggttggactgcctgatctctgggaccagccattcgtggatgggatttttttattgtaaaaaacataacaaaatttaccatcttaaccatttttaagtgtatagttcagtagtgttaatacaaacacatttctgtgcaatttctagaatgcttttcatgtcacaaactctatgcccgtggaacaatttcccatttctcccaaccctcagctcctgacaactaccaactttttaccatctctatggatttatctaatcaggatatgtcctataaatagactcaaagtatgttatggatccttgtgtttggcgtctttcacttagcatggtgttttcgaggatcatcgtgattgcacgcatcagtacttcatccccttttatgactgaataacattccattgcatggaaatatcacagtttgtttatttatccattgatgaacatttgggctgtatccaccttttggctattatgagtactgctgctatgaatatttgtgcagaagtatttttttgagtacctgttttcatttcttttggctgtatactaggaatggaattgctgagtcatgtggaaatctttgtttaactttttgaggaggcatcctaccgggagtgacatgatacctcattatggattacatttgcatttccctaatgattaataatgtggaacatcttttcatatgcttattggctatttgtgtatctttggagaaatgtttattcaagttctttgctcattttttattggattgcttgtttttttgttgatttattagagttctttatatattttagaaattagacccttgtccagatccatgatatgcagatattttctcctataggttgccttttttgctccttgataatgttctatgatgtacagattgagtatagtatctcttatccgaaatgcttgggaccagaagggctttgaattttttcagatattggaactttgaattatacttaccagttaagcctcccaaatctgaactccaaaatgttcaaatgagcatttttgttgtgtgtcatgttggtgctcaagttcagattttctattggagcattttggatcttggattttctgatttggatgctcaagcctgtgccaagttttaaattttgataaaatccaatgtatctgctttgtcttttgatggttgggcttttggtgtcatgtaagagtccattgtcataaataaccaagggcatacagatgtatccctaagttttcttctaagagttctatcaatttaacttttctatttaggttattgttccatttttaagttaacttttgtgtatgccgtgaggtagggtctgatttcattcttttacatgttgatgtccagttatcccagcatcatttgttgaagagacttttacctattgaatggtcttggtactcttctcaaaaattatttaatcatatgtataggtttatttctggactctcaattctatttcattggcctacatgtctgttcttatgccagtaccgcattgctctgattactatagtaatttttgtaaattttgaaaattagaagtgacttctccaattttgttcttctttttcactattgtttttgacagttggggtcttcttgaaattccatgtgaatttgaggattagatttccatttctacaagaaaaggctgttggaattttgacagaaattgtgttgaatctgtagatcattttgtatagtatcaccatctttaactatattgtcttctaatccgtgaacacagggtgtctgtccatttatttatgtcttttttaatttctttcagcaatgttttgtagtttcattatacaagtctttcacatccttggttaaatttattcctagatcctttatatgctattgcaaatgaaattgttttcttaatttccttttcagattgttaattgctggtatatataaatacaactgatttttgtgtgtcagtcttgtacttttgtaactttactgaattcttgtattagctcatctgtgtgtgtgttcattctttggggttttttttttttttttttttttttaaacagatggggtttcactctgtcaccgaggctggagtgcagtggtgcagtcatagctcactacagacttgaactctaggcttaaaggatcctcccacctcagcctcctgagtagctgggactccaggtgtgtaccaccatgcctggctaatttttaaatttttcataaagatagggtctcaatatattgcttatggtagtcacaaattcctggcctcaagtgatctcccttgcctctggctcccaaagtgctgagattacaggtgtgtgccaccacacctagccattctttgggatttttatatattggatcaagtcatatgtgaatagatagttctttcagatttgaatgcctttatttctttttcttgtctaactgttttggctagagcttgaattatgattagcattgattatccttgtcatattactgattttaaggagaaagcttttggtctttcaccattgagtatatgttagctgtgagtttttcataaatgttctttatcatgttgaggaagttctctgctattcctatcctagtttcttgagtttttttttttttttttttttttttggaaaggtgttagattttgtcaaatgctcttctgcatcaagttagataatcatgaaaccacttcgttctattagtgtgatatattatactgattaattttcttatgttgaatcacccttgcatttcatagataaatagtgtataatccttttactatgcagttgggtttggcttgccaatattttgttgagagtttttacatctacattaataacggtgttagtctatagttttcttttggtatcttcagtatcagggcaatactggcctcacagaatgatttagaaagtgtttcctccacttttgctttttggaagagtaggatttgtgttaattctcctgtaaatgtttggtagaactcatcaatgaagccatccagtcctagacttttctttggagatttcttgaaggaatgttccatgtacagttgagaatatatattcacttgttgttgggcagtgtgttctaaatatgtctgttaccttttggtggtttataatattgttcaagtcttctgttttcttactcatcttttgtctagatgttttatccgttattgaaagtggaatactgaagtctccaactattactgtagtgtctactaatttcctccctttaattctgtgaatgtttgcttcattatttggtggctttattgtttgatgtatataattgttattttttatggattggcccttttatcaatacatcatgctcttctttatctcttgcatcagtatttttacttattttgcctgatattagttttgctacctcaccctcttttatttactattagcatagaatatcatttttctttcatcctttgaatttcaacctatttctgtccttggatctataatgagtctcttgtagacagtatatagttggctttttttctttctttttaaaaaatccattctgcccatctctgtttttggtaggagagtttatttacatttaattagtcaaaatgaatgatttgctattttgctgtttgttttctgtatgtcttataccttttttttttttttttttttttttgagacggagcctcgctctgttgcccagactggagtgcagtggcacagtctcagctcactgcaacccccgcctcccgggttcaagcgattctcctgcctcagcctcctgagtagctgggattataggtactcaccaccacgcccagctaatttttgtatttttagtagagacagggtttcaccacgttggtcaggctggtctcaaactcctgaccttgtggtcctgcccacctcagcctcccaaagtgctgggattacaggcgtaagccaccgcccgcagccgtaatatatcacattcctagagacagtcttgtactgttttttgctccttatctccttcattactacctttttaaatgtatttatttttcttttgtagtataccattttcattcctttctcatttccttttgtgtatatatttagatattttttcagtggttaccttgaggatcacaattaacatcataaacctccaacagtctaccctgaattgataccaacttagctttaatacagcatacaaatctctgatcctatacagcctcactcctccttcccattttatgttttcattgtctcaaattttatgtttatacattgtgtacccattagcatagttttataataattattttacatgcatttgtcttttaaatcatgtaggaaataaaaggaattataaaccaaaaatacattaatactggttttaatatttagatgtgtgatggactttaccagagatttgatttggttttatggcttcaagttattgtctagtgttcttttatttcctctaaggattctctttagcatttcttttagggaaagtgtactactgtcaaactcttccagcttttatttacctgggaatatcttaatttctctttcatttctgcagtataattttgctgatatataattcgtggttggcagtcttcaggttttttttggggttttgcttttgtttcttttagcactttaaatatgtcatcccactgctttctgccctctatggtttttgctgaaaaatcagctcataatcttattgaggatcccatggtcataagtcacttctcccttgctactttcaagattctctctttgtctttgccttttaacagtttgaatatagtgtttctcattgtggatctatttgcatttatccttagagtttgttgaactttttggatgtgtagattcatgtcttttactaagtttgggaaatttgtggccattattttcttaaatattctttctgctcttttctgtcttctttatctaggactcccattgtgtatattttgctcaacttgatggtgtcccacagatctcttagactctgctcatttctgctcctcagactgtacagtttcacttcctattttcaagtttattgcctttttcttctgtgtgttcgcatatgctgttgaaatctgttagtgaatcttcacagtatttttcagcacctcaatttctacttggttcctttttaaagtttctgtctctgttgatattctctacttcaatagaatattctttgtactcttaatatttagcagccattgttctcagcatttagtctgcaaagttttggcataggtactataattatccctatttaaccatgagttgattgtttttagtaaatatcttagtactgaagaactgattaagagctctgcttatgagagtggagcttttcagcaactgggctttgtcttcaatgtggttgggcaaaaatcagtcacaatggaagaacctgaagtgcttgatatatcagagacatctttttttttttttttttttttggagatggagtctcgctctgtgttgcccagggcggagtgcagtggcgtgatctcggctaactgcaacctctgcctcccgggttcaagcgattctccaacctcagcctcccgagtagctggggctataggcacatgccaccatgcccagctagtttttatgtttttagtagacaccatgtttcgccatattggtcaggctggtcttgaactcctgacctcaggtgatccatccacctcagcctcccaaagtgctgggagtgagccagcgtcagccactgcacctggcagagacatcttttttttttttttttttgtcctatctgcactgatggtgcctaattgtcacttttctttctcaagatgtggttggttatggtgattttaattaatattcgtatttttataaccacttttcattctcaccaaacttagcttctctgagtttagaaatgttccatttgtaatatggagcagattggattccttcttgtccttatactttccttataaacattgctataataatcatgtttgtacacaattcccaaagaataggttcttaaaatgaaatgtgaatcataatatatgtgtaattttcacttgaatagcaatttagacaaagatatgattccctcctgctagctgggataatcttgaaggtctttactaaaatgatagatataatttaagtagatcttaaaggataaacaggttttctgtaattagggaggtgctatgggaatagttaaaaaaaagagagaagtaatataaagttcatagtaggataagatacccttttgtttaaaaataggatgtttataaggaggactaacgacaaataaaatttccaatattttattataaaattctaaaaattatatagaaaaggcaaaagaaacatacagtgagcacacactcagcaccaagattctgttgttactaactttttgcatcacttgccttaccatattattaatatgtccatttattcatcctccatccatcttattcattccataataaaataaattgtaaaataaaataattcaatatgcttcacccgtaaacccttcagtatgcatttcgttagagttccagtatttgtgtactttatttttcttttacctccaaacagcatcaggatagaataaattattattgtacgattgaatgagttttgacaaggcattcattcgtgtaaccaaaactctcaagatagagaacatttccatcatatcggaaaatgcccttatgccgctttccaggcagccttttccttaccctccatccagcatgactgttttgatatattttttaaaccataaaacccacttttgctattagttttcttcaattagcccacccaaatgaagtaaaattttattttagttctgctatttgatttttagttagatctggatctctgcatgtttttcattttaagtagttgccctgaagattacatttacgttgttacttttcacaatttatttaggactaatactgtacaatttcatgtaaaatacaagacctttgcacaaataaggttttcatataacccctctaccgcttgttctgtatgctgtaattttcatatcttatacaagtacaagattacataagtaatttcatatcttatacaagtacatagataagtcattattaaatgggagtaattatagtacctattcaacaaaattggaatactaaatgcaggaaacagtgacagccaaatgttaacagtatagaaaattttacctcaacaaatagagaatatcagtaaagacatagaaattacaaaaattaaacaaattcaggaactgaaaaacaataattaatagaatatgtaagcatatcatatatatcacagtattatagattttcctttaaccaatcatgtgtgtattttaaagatactgaaaggaaaatgtagtcttttctatttaacatttttagtgctctttttttcctgaatatttccagataaaataggcattggaactcaatccccagatgtatcttttctacagtgggtagcaccagaggtctctgttcagttcttttagcatacttgggctgcttggaatctttcctacattcatgtatttcagaggtcaactagagatttgggcagagtggatacacagaatttagggctctcctttggtgcctgctttctgagatttcctcctttcctttctagatctgtgctgtccagtagaactttctgccattatggaaatgttgtataacgtacaccatccagaatggtagccatttgcctcatgtggctgttcagcacgtgaaatgtggctagtgcaactgagaaatgaaattttttattttagttaatctacatttgagtagtcacatttggctagtggcaactttattggacagaccatccttgcagaaaggtctgttagacagcactgttcttgatgctgtggtcattccaaactcagtcgccatttctgtctggggtttagcagacctgcagaatcagaacaggccctttccttaggtaaaaatgtattataaagaaggaaactcaagtagtgctttccctttttcccttccaactatgactgattttgattgctctccagagccttcaagtaatagttgttttgtatatttttgactagagtttataaatacatctgtgtctgatagaactactccactatttaacagaagcagaactctacctcttaatcatttaaatggtgacctaatgttaaggaattcatatttggtgctttgttaccataattctcttaccaatcactaattaaatatttttggctctgaaatatttagctgatatagccaacttgatctcccatttctttaagaaaaaactagttacctaatactatcattgtttagatgaaaaagcatttggaagacttatttttctgggtctcttaatagaatttttattttaaactatcatagccctgcttactaaaagtattattaacctttagtgttactgaatcttagtatgctaaatttgatattcccatctccagtcatgttagaatttaatggaattcttcaaagcaacaaactcctatcattgataacttgtttggtatactttgctttttctaggtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtatgtttcaggtgtaccttggagcctgactggctttctcacattccttttatttagaatcctggctctgtcagagttttaagtgatataaaccttaagaaattcatagcttgaactcaggaggtgatccattgtacttatgagatataggattctctatatttgtgcttcttggaatcatcttagagactattggtaacattacgttacaagaaataaagtgaactttgttgataaaacctaatgtaatagccttttttgttgttgttgttgttgttgttgttgagatggagtctctctctgtcacccaggctagagtgcagtggcacaatctcagctcactgcaacctccacccaccgggttcaagcgattcttgtgcctcagcctcccgagtagctgggattacaggcatgcatcaccatgcctggctaatttttgtatttttagtagaaatggggtttcaccgtgttggccaggctggtctcgaactcctggcctcaagtgatccacctgccttggcctcctaaagtgttgggattacaggcgtgagccaccccgcccagccagccatcttttcattacacactgttgatacttaacattatacactatttatttaatacatacagtatgtcacttcatgaaagaaatggaatttatatttagttttactttctaaaattaaaagataaaaattaaatttttaaacatataaaatgtctgttggatatatatgtatattcaagaatattggccaagcacaatggctcatgcctgtaatcccagcactttgggaggctgaggtgggagggtcacttgaggtcaggagtttgagaccagtctggctaagatggagaaaccccatctctattaaaaatacaaaaaaaaaaaaattagccgggtgtggtggcgggtgcctgtagtcccagctactcaggaggctgaggcaggagaatcacttgaacccgggaggtggaggttgcagtgagctgagattgcgccactgcactctagcctgggcaacagagcaagactccatctccaaaataaaaaaaataaaaagaataacctcctaacattttgtgaaaataaatatgacaattcattctgaaaagttggttttatcaacttttttcttagtctcactcttcagaatttatgatctatctaaaagagtgtttctcaacctcaatactactgagatttggggttggacaattctttgttgcaaggggctgtcttgtacgttgtaagactctggggcagcattcccagcctctacccactagataccagtagcacgctccctctgtacctgccttctagttgttataaccaaaagtgtgtccagacattgctatatatggcccctagaagacaaaattgccccctgttgagaatcacttatctaaagaacaaggctgtccctttcagactttatatgttagaaactcaaagctggaaaaataatttaatgcctattttgataagctttcactctatgaagaggatatcacaatttaaaaacttgaggtcttcataaacattctatttactccctccaaaaggtgacaataacaaaagaaacccattaatttttaagtgaacttggatactgagtattactaggaaaaacacagaacaccagttatttgtacatctttcaaaaacagtgttctccttggaatattatgtaactagggttaggaatgctttcacattttcttataatacattcacaagaagaatgggaaaagtgtcatttaaagctgaatttctttttttgccttcttcacaggaaacatttctttgattgtctttggcatcctgaaatctctggcccaatagagtttttattttctttgttgattaaatgatagtgtgcatgcctgtttcttggaaatgcctaataatttgaggtatgcagacctaattttctggaagcattacaaaacctagtcttgtgggatcacacactgtgctcataaatcagtctgtatttgggttctatatttgtgtgtgtgtgtttgtctttttgcctgtaggatgtccctcactacatttcttgtgtctgtagtaggcttatttgtgtactgcaggtgggatggtaagtatgtgaagaaaagggctctggtgagtggcctttggagacaattacgttttatttcattttttaaaaaatgtattgaatatcgggtttttcactgcaaggccttcttaaaaagtgaaactaattagattgagtgttaatgccaagagtgtagctgtaaatattaaccctacagctaccatacattagtgggcacacaagtattttgatctttttaaacccatcatcttatcttacagatgtaccattatatttgctttgttccttgcatagtgtctttccttttccttctatttgttttcaatatgaattatattagtttattatcttagccaaggttttattttggcatattgtataaagaaattcattttacacagtaaatcaataaatagatccttgaccttattccagtttcatataaaggccttgcagtggaagatcttttatgagatatttgatggaacagactgactgagaagatttccttcctcttttctccccctttccttttttctccccattccaatttcttctctctcacaggtcaacccctctgcttctcaccccggtgagtaacgtctgaagcttctgctcgcattgagtctgaatcgttcttttaatttaaggtaccccagagttcatggcccctgagatgtatgaggagaaatatgatgaatccgttgacgtttatgcttttgggatgtgcatgcttgagatggctacatctgaatatccttactcggagtgccaaaatgctgcacagatctaccgtcgcgtgaccagtgtaagtcttcccctaactgattgttgaacttggggcatatctaacaaagaatcccaaggtggatgacatcaaaccatgtaaaagaggacaatagtggaaggcatactgagtgaactgttggggttgggggggtggtgttgaggtatgtgtaaggctattgctcatgatacagtgaaagataaagatcaaagaaccactagtttatcctgtacccaccttgcattcatttaaatctttattatgtttaaaaacacaccctcattacctactttttaaccccctattaattcagctaaactcctgttgtctcccaccacataggtcagagttaaaagtaatgtttttaattcaagatgctttgtcaaattaatttgttcactgacttttctctgaatgacttgagttgatttattaaatcttatatattagtacctaccatatttaaggcataaataaataccttattgtagtttaaattactcatggtagttcatgtctgctgacagagatattttctacagctgtctaattgaaacctgaaaggtagttgttatgattcattttactttatcactacatgcttcattatgctactctaaaatacattttcttacataaccatattatgcctgaaaaaattaacaatcatttctgcatcatccaataccctgaacctgttcagatattctctccattgtttcaaaaatgtccgttgacagtgttcaaaataggctccatcaaggtccacaaaatatattttattgttgtagttcttaatctagaactattgcttttactttctttttctgcatgcatgtcagagatttattgagaaaattagattatttcgaggaatgttccacattctgaattttcctcgtggtgtcatttaactagtttattcttctatatttctgtaaggagaagtttaccttaaaatggttggggtaggttaacaatgtaaaaataattttgtcttttttactcgcattcacccaagagtgtacgttgttgttttccagaggctatatgatactgcacatatgatattgcagcagagtacatacagaagcatataaaagaattcatttgtagggccgggcgtggtggcttatgcctgtaatctcagcactttgggaggccgaggcaggtggatcccttgaggtcaggagtatgagactagactggccaacatggtgaaaccccatctctactaaaaatacaaaaattagccaggcgtggtggtgcacccctgtaatcctagctactttggaggctgaggcccgagaatctctggaacccgggagatggaggttgcagtgagccaagattgtgccactgcactccagcctgggtgacagagtaagactctgtctcaaaaaaaaaaaaaaattcctttgtcttccattaaaccatatatttaaaaagattacaaaaatgtaaaacaataccagtcttatcactaaatttttcttgttttggaaaatactgactttttaattttaaatatatatttgtaacataatgagttataatttttaatgaattaacatttttaaactttctcaggtttaccatctgccacggtaaatattaatagatgtaacacacatagacaaaatccctctgaggtccccaataatgttaattttaagagtataaaggggtcctgagacaaaagtttgagaaccactgttcaaaagtcttgataaaatttaggctaaacattttttgcaaggatacttaatatgtggtgctgtatatgttatattgcaccgagaagctcatagtatctcattatttcatttttagtgatgtaatttaattgaattttgatatagaagatgtaattatcaattgcttatttagattttgatagctgaacagaatggaaatgtttatttttaattttttatttatttatttattttttgagacggcgtctcgctctgtcgcccaggctggagtgcagtggcgccatctcggctcactgcaagctctgcctcctgggttcacgctattctcctgcctcagcctcccaagtagctgggactacaggtgcccgccaccacacctggctaattttttgtatttttagtagagatggggtttcactgtgttagccaggatggtctcgatctcctgaccttgtgatctgcccacctctgcctcccaaagtgctggaattacaggcatgagccagaaatgtttattattaaaaactgataggaaacattttgctttaggtagaccaaattttacctcttcataaaggcttgggagaaatctttggagtcaaagattaattataattatttattgctgtgaatattccttcaatatccttgttgtatatttgtatgtgattctgttgttgatggatatggagctactttggacaattagtttaatttcatatgaagtttgaggtttcatacccagtaaaaatgacagctattgtttatggagaaagtgtgtaactctcaagttacttctggctttgtaattgggatggtattttgtcagttattattattaggtgtatgtctacaagtgtctggcctgaggccttactgttaaatttattaacctcttcttaatactcacccagattctaatacacaatataattgtaatccctgaagcactgactctcaatttgggctgaatgggggcaggagaaatttttttatgccttcagatgattctgataagtaccctaatcattattctacatttatgcccttagaaagctcatctgctttgcctttcagagttctgtatcatcattcccagttcatgtctcttattattcccctttcttcccctgatgcgttgtaatttacattctctctttttttttttcctttgagcatagggtcgactgtttattgggtaatttcctcctttattttgtttaaaattgtagaaaacttaagaggtatatttgatttcttgttttttactcgctgcttccactacttccagtttataaggttcttgcttcagaatacctcttagatgcaagccttcttcattcccattgccacaactctgatttcacatcttccttactgcacaccttgcattatattccagaagtaatttacattgtgaatttatttttttatttcacttaaacttgttgagctttcttgctatcctttcttggtataaggaacttaagataccagtttgctgatatcagagcaagtacaaattcttaatctttgctattcttcatcttcatccaagcactctattttagttaaatcagttctcttcattatctcgcacatatgccacatcctttcctgtattcctatccatttgtaaatgttatataatactgtacctccactataagcttttctgctatccagtcaatccatatacttaacggtcttcctccatgacattttatctgattggtttcactgtataatgatctttgccttttctgagctgattcttctcaattgatatgaatgataaaattttgtttattagtggttattctacttataaattcataaattcaattaatgtacttgcttattatttttattgctttatattccttaaaatattttaatctagtacatctgtataatttcatccttatctgtagcactatcctaaatacaaaataaatctcagtgccagtaaatgcaacattttctgaatccctgctatgtcccatgcccagagcttgatactaagtaaaggtgaataatcatattccctgtcttcagaaaactacctctaatatagaagattaatatgtaaacaaagaattataattacattatggtgagtattgtaatggagacaagcactaaggagagtggaggaacaatggataaccctgctatggattagggaagatttcacaaaaagagctgttgtatgaactgtcaaaaagagaaggtagaagaatggtgagaggccattctaagaagcaggaataggatttacatgaatgctgagatgccaaacaccgtagtacaatggaaggaaaggcaaattgatcaaatagagtgaagctgttgtcttggacaaatcaatttttgatccaaggacaaatcaattgctacttagtttctcctgctcccaaatcctgtctcatctcagagcagagagtttccggttggtaattaagaggcaaacttctgactgctgatatgtgtttttactgctattatattgttgtattttaatggtgaaagagactttatctgtttataggcttttggaaggagcaagaggaagagagagagaagtagaaatcatggtgggtggtggtggatagggtagagtaatatccaggattcaatgggcttgtgacatggtataatggtaagtcttgatagggaaggttttctcctgaggtaagggaagcaagatgggttttggaagcaaagtcttgggttcacatccttgccctagttattgccatacgatcttgagcaattcacttaatttctctgtacttcaattattttgttctctgtaaaagagatactattaccctcttacagattgcttagcacagtagatagtactggtactgatagtaggctgtggttattgtctatgaaatatgagttgtcatcttcttgggggggtgtgtagaatgaaagatggcctttaaggatgataaaggcttaaaataacatctatgaaactttgaactgattaggaaataataattgtgaagcagcaccaggcatccagaatcttcctttttagtattgataaacactattatgtaaacaatgaatatattgtttgtacgcgtgtctatgtgtatgcaagtggaaaagggcaaatttttacctattacatacttctttcttgtgaataaccaataataggctgggcctgtaggctcacgcctgtaatcccagcactttgggaagccgaggtaggcagattgcttgagctcaggagttcaagactagcctgggcaacatgatgaaacattatctctacaaaaaatacaaaaattagttggccgtggtggtgcatagttggctgtggtgatgcatgcctgtagtcccagccactgggaggctgaggtagaaggatcgcctgagccggggaggtggaggttgcagtgagcctagattgtgccattgcactcgagcctggacaatagagtgaaagcctgtcttaaaaaaacaacaaaaaaacccacaatagcttagattgctaaagtagtcctcagttttctatattctgaattctgtgtatcagggtttgaagaatagaatagaagttattgacataaatgagttaggtttcataggagaaaagttaattttacttggtgtattttctactgaataagtttcatctgtgtatttgtgaatatttattaattataaactgtgaccaagcactatactaggtattggggatataccaagtcaaaaagttgtgcctcacctggagtttacattcagttttgttaaaaaaaaaaaaatgttgatagaagtcagtaagttggctgggcgtgatagctcacgcctgtaatcccagaactttgggaggccaagactgggggatcacttgaggtcaggagtttgagaccagcctggccaacatggtgaaaccccagtctctactaaaaatacaaaaattagctgggcatgatggcatgtgcctgtagttgcagctacttgggaggctgaggtaggagaatcacttgaacccaggagacagaaattgcagtgagctgagatagcgccattgcactccagcctgggtgacagcaagacttggtctaaaaaaaaaaaaaaattgataactctattagagtgataaggtttgtgtctagaatagatgggagataaagggtgagaagctgaactaggtttattgttacagcacagcaaattcaatcatttctttttgcccgaaatgtatgactaggtactaatacaatctgacttttttattaaaacatgtaatgaagtaattagggaggaaatataagccagtagattcaaaactgaggggaaaaataacaaaagttgtagtggatcaaagtagatttgtagatcaacatgctatatgagtgatactgctaaacagtaacaggtgtttctgttatgtgactcctgagccttaatttcctcatatgattatggtagtcataactgccaggcctactaaggttgcgaaaaacaaatctgttgaaattatataagaaagtacatttgaaaaagttgagaaatatatttgttgtatttgacatataactagattgactctgaaatgtcttctatctcaatagattcttgatgtttcagaagggtttgacttaggctttctgctacaaaagattgggaggatagtagcactaactggctttcttaagtgtaatgaggctcatatttgcacagaagttacaaaatctgtgattgtgatatattcaaggaattttatttttaaaaatgcctccaacttttcaataaaaaagtaaatagatggcaaattattctgtgtagagatgaatatctagatattaaaacttaaaagtatgattctgattacataatcaagtcataggctttcagtagtccttaaagtctgctttctatccttcagtgaatttttgaagtttgtttatagaatattttgtgcttatcatattaaatattagaagacctttggggacttgattgattctctgcatggcataacgtgccaagtcagagtattaatcagaaatattttttttttgtatgtgcatactaaaaatgtacatttaggtttttttctatcagtgttactgaatatattatatacctacccatctaaagtgtataattcactggttttagcatcttcacagtgttaaaagaaaaacttcagccaaattaaatttaaaggcgtttaattgagcaatgaacgattcgtgaattgagcagtccccagaatcacagcagattcagagagactccagggatgcctcatggtcagaacagatttatagataagaaaaagggatgtgacatacagaaaccagatgtgaggtacagaaacaactggattggttacagcttgctgtttgccttatttgaacactcagcaatgtatgagtggttgaaatacagccgtgagggctgggcgcagtggctcacgcctgtaattccagcactttgggaggctgaggcaggcagattacctgaggccaggagtttgagaccagcctggccgacatggtgaaaccccgtctctactaaaaatacaaaaattagccatgcgcggtggcgggcgcctgtaatcccagctactagggaggctgaggcaggagagtcacttgaacccgggaggcagaggttgcagtgagccgagatcacgccattgcactcctgcctgggtgacagagtgagaccctgtctaaaaaaaaaaaaaaaaaaaagaaaagaaaagaaaaaagatagaaatttggctgttgggattggccaagactcagcagttgttacgggcatactcctaagttaggttttcagtcttgtctacctgttaagttaggttgcaattagtccacacagactcaaattagaagtacaaagtccttctcgggccatatttagtttgctttaacaacaggtatgtgcagccatcaccacagtcaactttagaataattttatcacatgataaagatattctgcaccctgtagcaatcacttttctatacaaacattccccccactcctgtgcaacccctaatctgtttatgtcactataggtttttctattctggacatttcatctaaatagagtcatttaatatgtggtcttttattactagcttctttcactttgtatagtgttctcaaggttcgtccatgttgtagcaaatgttcatgcttcattcctctttaagtctgagtaatattccagtgtgtgtgtgtgtgtgtgtgtgtgtgtgtgtatgtataaacacaattgtttagccatttatcgattggtagacatttggactgttcctaccattggctgttgtgaatagagctgctacgaagaatattcatgtacaagtttttgtttgaatatctgtttttacttcctttagatatatacctagaagtgaaattaccatgtgtatatgctaatcctatgtttaaccatttgaagaactgccagcctattttccaatagctgtaccatattacattcccaccatcagtgtaagagaattgtgatctcttcatattcttgccaatccttgttgttattattattattattattttgagacagaatctcactctgtcacccagactggagtgcagtggcacaatctcggctcactgcagtttccatctcctgggctcaagtgattctcccgcctcagcctcctgagtatctgggaccatggacacacaccaccatgctggctaatttttttgtattttttgtagagacgaggttttgtcatgttgcccaggctggtctagaactcctcagatcaagcggtctgcctgctttggccttccaaagtgctgggattacaggtgtgagccactgtgccagcctgtgtcttctgttcttaaaaggacagcagtcattgggttaaggacccacactgctcctggatgacttcatcttaactaattacttaactaattttttttccaaaaaaattcatattgtaaggtactagagattggaaccacaacatatctttttgagggacacagttcaaccccataacaattcatgggttcattcagcaaatattcaagtctcttctatgttccagactgttttctagatcctagatattgaatattattgttatgtcaaacacagtccctgtctctaaagaacttaccaagggaaggggaacaaacaaataaagcaaacagttacaatacaatagaaaacacttattttagggataggtacttaatgaaagcatgtaagagtggtacctaatcaagtttggacaggttagggatatggtgttaaagaattagggaaagactaagatagtgttatatatgaagatgcatgattttgagtatcttgtcaagtttggaagtaggaaaaggacaaggcaagggataagggacaaaaggaaagcttagactttaatgtagagcactgaggggactgttttaaaagtgggtagctatcatgtatgtcaacacctacagacttaaattttagaaagattatttctgactgcagagtggagaatggatttctgaggaaagactaaatgttgaaaactcagttaaaaaggtattgaagtaatctaagggaaatgactaatagtctgaaataaggagttgtaagagagaaggccaaagtggatggattagagagattttgtttgtgaattagatttgagctaacctcatttgtttttttccacttaacatttatgaaaataaatgctcatgtacatatatatacttaagatcaaacaatatcaaacctgattgtgaggttaaatatataactttagatttggggactataaaatttataatttgtatatgaaatgttttatatattttatttactaacttaccaatcattactttttttgagacagagtcttactctgtctttcaggcaggagtgcatggttcagtcttgtctcactgcaacctccgcctcccaggttcaagtgattttcctgcctcaagcttcctgagtagctgggattgcaggctcccaccaccatgcctggctaattttttttttttttttttttttaagtagagatggagtttcaccatgttggccatgctgctctcgaactcctgacctcaagtgatccgcccacctcggcccccaaagtgctgggattacaggtgtgagccaccacacctggcccattctgtcgtattctaaatggagtagcaaactatgcttcttggccaaattcagcctggtgcccatttttgtacagcccatgacataagtatggtttttggttttgtttttaattttttgagagaaagtctcactctgtcaccgaggcttgagtgcagtggtacaatcatagctctctgtagccttgaacttctgggctcaagtgatcctcttgcctcagccttctgaatcgctaggactacagacatgtgccaccatgtccagctttttttttttttttttttttgtagaggtggggtctcactatgttgcccatgctggtctcaaactcctggcctcaagtgatcctcctactttagcctcccaaaatgctgggattacatttacgagtaccatgactggctggtttttatattttttaatgtttggggaaaatgtcaaaagaagagtattttgtatgatacgaaaactacatgaaattcaaatttcagtgtccataaataagtttttctggcatacagccacactcacttgcttccatattatttatggctgttttcacactataatggcagagttgaataattgcaacagactgtatgatacatacagcctacaatatttactattaggcccttaacaggaaaatttacttactcctgtgttaaacatatgtcaccagaactttgtaaaacatgttcccctgtagagtcctgtaagaaattactgatctacgaaagtagtggtgatgttcttctataagaatgcgttagcctctgtatttgtaaagacatgagaatcttggtgcaaacaagtagctacttaacaggtcagaaaatgtgtaggcagtcttttctctctgttaagagtagaactaaaactttaacatttttatttgccaaatgcaaactcaaaagctcagttgagaagaaaatcttcttaaatgaaagatgtctttgatagtaagtttaacagaacctggaaagactggtgtcactgtttctgtattctcagtatagtgtttaacctgttttcagttgttcagcagcttttgttttttattaaactgagacaaaaatcatatatcataaaattaaccattttaaccatttttaagtatactgttcactggtttttagtatatccacaatgttaatgcagttatcactactaattccagaaccttcccatcatccccaaaatgaagccccataccagttagcagtcatttcccattctcctctccaacccatcccctagcgaccactaatctgctttctgtctctggatttgattttcctattctaggtatttcatgtaaatggaattatacaataagtggcattttgtgtctggcttctttcacttagcaaaatgtttgcaaggtacatccatgtggtagcatgtatcagtactttttaatagttaaataatattctattgcatatatatactacattttgttctattcagcaggttttatttccctttagttctttagtttcttcctctttttctcaatgttaaactgcttgactctatagctgcctcttaatctggagagagattgagaacaatgttttagtccatttgggctgctatatcaaaaatgccataaactaggtggcatataaacaacaaccatttatttctcacagttctgaaggctggaaagcccaagatcaggtgccatcagatttggtatctagtgaggttctgttcctcatagaccggactttctcgtgtcattttcacatggtgaaagagtcaaaaagctccctccggactcatattataagggcagtaatccatttcacggttctgccctcatgacctgatctgctctcatgacctgatcacctcccaaagaccttcacctcttaatactgtctcattggacgttagatttcaacataaaaattttagggggacacaaacattcagactatagcatacatgaaggaggaaatatagagtgtcttaaaaggtattgtcctagagctaggtttattatatcgttgtttgtattcattgtgcacagcacaccgtaggcactcattaatattttgaagaataaatgattcaaagtaatgtcaaatatagtcaaaatcagacattatgtatatttgggagagttgtatttactctgtgaaagagaagtgaaatttgaggtgaccttcagaattatcctactaaaatgaagttgaatagcagcaagtagaaactgatgtacctataaaagcaatatattttatattaatggcaaaaaacacaattacttttgcatgaacctaatagaataggaaaaactatttggtgcaaataaagcagaaaacaataataggtagaaaggctatcccaggactagaaaggctcttctgtaggttctcaaatctcagttgtaatttctgaacaactagtttaactctttccattatggggctaggtctgtattttattttattttatttttttaggtatttccccttaatttttaccctataattactactctcactttgttctttcttccctgagacttcatagggcagaccaaattgtaatttcccttggtgtagtccgtaaaatgtttcaagacagtttttctaatgttaggagtccttttttgtcaagacccatcattgtcaatttgtaaaacttgttcctttgaatttcttgagggaaggggcttatatgcattattggaagagggagatgctcagcaactgttttcttgatcttcaggaggttacataagaaggaagagaaactgtaattgaacataagaacttggcaacattgtataatattgcagaggccttggtggtaaaggtttgagattctgtcatctgagaatttttgagaagggaccaagacagctaacagactcaagtgattttatttatttatttatttatttatttttggagacggagtctctcgctgtcgcccaggttggaatgtagtggcatgatcccagctcactgcaacctctgcctcctggattcaagcaattctcctgcctcagcctcccaggtagctgggattacaggcacccgccaccatgcccaactaatttttgtatttttagttaaaacgggggttttaccgtgttagtcaggctgttctggaactcctgaggtcaagtgatccacccaccttggcctcccaaagtgctgggattacaggtgtgagcgaccacgcctggcccaggcttgagtgattagttcagcatggtatcagtaatcctttacactctttaaagttattgaggaccccaaagagcttttatttacttgtgttctatctactttaccgtattataaattaaaatagaatttgcaaaagcatttaaaaatgataaataacataagccctgtatatgttggtatcaataacatttttatgacaaataactattttccaaaacaaaatttaaaaacttactgagaagaggggcatttccacatttttgcaaatctaatgtctagtctaaaagaagattgctaaattctcatatctgcttttctgttcagtctgttacaatatgctgtttgggttgaagtatatgaagaaaatctggcctcatgcagatatgtagttgcaaaaggaaatactttatagaccacaagaaaggatattgaggaccctgaagggtctttataccacacctttgagaaccacagttttagcaaaccaaccatgcaaagtgcagtcctcagaccaacagaatcagcatctcagggtgcttgtatttagtgtaaaattttggccccattccaggcctgttaaaatctgcattttacatagtccaagggtgattcatatgtacattaaagtttgagaagtatgagctgggtcagtaatcccttaaggtctttttcagttccatgtacctttatttggttaattaaataaaaagtaggctatatagtataataccaaaatgttatttaaataaactattgttcagtcattcatgtaaacttttaagtagcattataagtaaccaatttgacttaaaaattatattattatagcatttatatgcaattttgcattttttctgcctttttggttgttgctttttaaaaattttctttattttattttatttttttttgagacggggtcttgctctgtcgcccaggctggagtgcagtggtgcgatcttggctccctgcaacctacgcctcctgggttcaagtgattctcccgcttcaacctcccaagtaactgggagggacaataggcatgggccaccacagccggctaacatgtattttctggtagagatgggggtttcaccatgttggccaggctggtctcaaactcctgacctctagcaatccaccagccccggcctcccaaagttctgggattacaggcgtgaacgaccacgccaggcctggttgttgctttttaaaaaggaaaaccggtaaatcaagctgtagaaaatgtggaataaaaaacttgaagagtaagtccattggaactgtgctagaatccttagtttctaaggatgccgcaggtggcatgcatttgtgctttatttttcctctaagctatgaaaatttagttgtgtatgctctacagtccttaattctgcactgtccattaccatacttcttgcctaggaaatactgtctagattttaccaatctccattcccatcttctggcttctagtaaagaataaaaagggctgtggtctttgttactttcctaaaagttttcttatgttttgggtgctgagataaatgtggagggtttaaataagttcttagataatataatttatataattatataagcaatcatgatgattctgtgttgaaataggccttgaaatattgtaccttctctttttttttttttttttttttttgagacggagtctcgctctgtcacccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcagcctcccaaagtgctgggattacaggcgtgagccaccgcgcccggcctgtaccttctcttaagtcagcttgcaatttaaatttttagttagtaaatttaactaattttaaaatatgttagtgtctgtctgcttaactattgcatacttattaaagaaacatgcgtggttatccattggaagagatcgatcctagggcttcctgatacaaacacacccacagaccccagccactctagatttctggttttcatcccaggtctattgtgtataccctggctattagtaaccagtaaaccactctcccccttctgtagatttagtactaacttagaaaaaggatacaaagaagagtttgtatttaacagctcaggattgccttttcaggtggaagaaataggctctggagttggatctgcttcctttcaaattccggcaatgtcattgcctagctgtgagaccttgagcaaattatttacttctctgagcctaaagtatttgtgaagattaaatgagaaaggcaaagtgcctggcatacagttatcaatcagtacctaataggtatcaccattatcatcaacatcattattattaatacatatttagtagtgaaataaggtgtctctttttatgttaaccagtgacattcagcaaattgcattaatttaaatgtgcttcctaagtgtcacataaaatcaagctttaaatgggagaacaagctaacatttatttgtaatcttgtcgatcaccttgcaaagtgctttacatatactgttttaatcttttatatcatgataagtagataatgtcttcatttcacaggtaagaaaatagactcagagtttaagcattttgcctaaggacatgcaggagaaataatagtagtcagaaaccaaggttctgttaacatgatactaatacaaacattaacattattttcctttacctcttttttgttttgtttttaacctgttttctagaccgcaaggaaaactgagggtaaaaagtttaggagatgtgagtaacaaaagtctggtactgcagttttgagctctgagtaaaggttcattccccctatttaacagagaaaaacttattaattgtatgctatacttgtagtcttgacccagttgtcatgaaagtctatgccactgataatgagaagatccaagtaaaagtaggaatatatttagcaccactttggtgtgcttttaaaataataaaaaccgtagcaggcaatgatatcaactttttatatgaaggatagtgcgtttgaactggagcagtacacaagctttcatgtattcagagagtaacgagccttggggaatcgtgagtaagttaatttctttgatagagctagcttgatttggtagggagttcaaagaggcttgttttccaatgggatcatagggtatgttcaaattcctgtaaactaatggttcataactgtaagaatctggctgaatccagccctataacaaccaagttagaaataatggggatttttaattactttgtttgtgtaatttgactttgtcactgattccattagcttttggattgcaaggtttgaacattttgtctgggaaaaaacagaactaaagccattagggtaaaattccttttagtttttatataacagattgcaattcaccctacctttttactgaaacaagtgagactgattcctgattagatggtgtttaaaaagttgaaggaaactttgtatttatttctttagcagctagaatttgttgtgctatcagtgaaaatctattggaattagctgaactggttccttaataaattttgtttctatgtctatccagcaaatttaggttataattgtaaaagaaaagttccagtactagggggctatatcttaggaacattttgcatgattttcagaagcatttcattattctgctgtgatttaattaagattaaaggtggtagcattcccagtgttttaggtactaaataataattattaaatcattatttcagaattcctcaaaaaagctgaccttacttacctaccctgaatattgatctgtaattcacaaggcggtagactacagaataaaaacaaaggatatagaaagattgttttccatatttaaatacagcagtactgagttttctgatatactgtaaataacctaaatgctaaaggattcatatagatactttgtaattgctactttctctaatggattgtatgtatatatgatttgaggtataccctgaaagaagcataagactcagttgactgaaaaaagggggcagaataggaaaagtattcttgttggtagaagtgttcactaaagtattcagtgaacaagtaaccagtttgactgaacttactttggggagattgggtaaagatgtgggtggaagttaaattatgattttcacaccacttttaaaagcacaataacatggaccagaaataacattaaactagatgctggaaaatctggattctagtttttgttttaccattgattcggcccgtacttaactggagtataaattatatttatcttctaggtggtgaaggtggtgcagtgtatctagcagattgcctgatagctgttagactagatgagacactccatagtcaactagttgaattaatggattaattctcttttttttttttttttttttttttgagatatagtctcactctgtcgttaggctggagtgcagtggcatgatcttggctcactgcaacctccgcctcccaggtttaagtgataactcctgactcagcctcccgagtagctgggactacaggcatgtgccaacatgcccagctaatgtttgtgtttttagtagagacggggtttcaccatgttggctaggatggtctttcttgacctcctcgtgatctgcccgcttcggccctccaaagtgttgggattacaggcgtgagccaccgcgcctggctggctaatggattaattctaactttgacatagaattaacatttctgttatttgaacaaggaaggactcttaatctggtttattctagatctgtgatcctgtggtcatttagtaggtgtggagaactattaaccgtttttgagcagtgtgattatgagttaaatgataccagatgattggaaatggttaaatgtcagatgcttaaatggagtcagatggtaggagctagccacaatgtaaaacacaaattggagatgaagagaatggaaatatgaggcccatcttaaactggtctaggcttaaagagatgaggtattagaaatcagaactttgatggttacttttgtaatacaaaaacaatgacttgtgaggcagcaaagaagccagtaaaaacttttttttttttttttttttgcttggtcagagatctttggctgttggagaagagtaagaatactagtcacaaaaccatttcccagttgtttttaactttatctttgtgttaagagcccatagagaataatagtagtacttaaatattgtgggggaagaagcatccaatgatgactaaggtttcttctctggactatggaaataatgacacgattgaaagaaataggggaaatccagagaaaggcactgactttgagagaaagaggaataagtttagatatgtaaactgttatctgtgaatggtacttttgttgtaatatattgaaaactcttattttgatttatagaaaaggttgctctttatagaatctagatatttgtgcctacatcgtacctttgtctcctcaagccccccaaagccccctcagtttggtttatttgttgcctaatagagttttaaaactacccacatctttatatctgatggacctttgaggcaggacacgtggcacttgttttctagctctttcatttagccaagcatggtcctacacaggcttgctcatacagttaagttagaggtaggctgcacttttgcagcacacattgctgcatttctgagcaatacctgacatcctagactacttagtagtaacaaattgtgttgagccagagattagtggtagttgctttgagatagcttgttagaattagtagcatttctaacctttagatgtattacttccaaacagcttccaagccattatcttatgtactgttggtaattgaagccttagcattcactgtcttgatcaggattcaagcttacaaaattacaagggagagaggactttaatctgttacccattacaacaaagcaatgagcaatgctgtttctacaatctttgttaatgccctgaagaaaaactttcccttaatcactaaaattaaagtagtttttatttgggtctatgagatcttcctggcaaatggaatgtcttaattttgagacttttataggagggagaagaagaggcaaaaaatttgtaccacttgtgtacataaatactgttgatttttttttattataccttaagttttagggtacatgtgcacaacatgcaggttagttacatatgtatacatgtgccatgttggtgtgctgcacccattaactcatcatttaacattaggtatatctcctaatgctatccctcccccctacccccaccccacaacaggccccggtgtgtgatgttcctcttcctgtgtccatgtgttctcattgttcaattcccacctatgagtgagaacatgtggtgtttggttttttgtccttgcgatagtttgctgagaatgatggtttccagcttcatccatgtccctacaaaggacatgaactcatccttttttatggctgcatagtattccatggtgtatatgtgccacattttcttaatccagtctatcattgttggacatttggattagttccaagtctttgctattgtgaatactgccacaataaacatacatgtgcatgtgtctttatagcagcatgatttataatcctttgggtatatacccagtaatgggatggctgggtcaaatggtatttctagttctagatccctgaggaatcgccacactgacttccacaatggttgaactagtttacagtccctccaacagtgtaaaagtgttcctatttctccacatcctgtccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcataacctttgcccactttttgatggggttgtttgatttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggctttttttgccattgcttttggtgttttagacatgaagtccttacccatgcctatgtcctgaatggtactgcctaggttttcttctagggtttttatggttttaggtctaacatttaagtctttaatccatcttgaattaatttttgtatgaggtgtaaggaagggatccagtttcagctttctacatatggctagccagttttcccagcaccatttattagatagggaatcctttccctatttcttgtttttgtcaggtttgtcaaagatcagatggttgtagatatgtggtgttacttctgagggctctgttctgttccattggtctatatctctgttttggtaccagtaccatgctgttttggttactagccttgtagtaatactgttgatttttaaaaaatgttctgtgaaagagtagtaaagtagtctaccttaatatcactgccttttaaattaggtgaacagaggaactattatctccactttaaaaacgaatttaagggatatggtccaggtcatgcaaacatagtatgtgatggattgaactgagaacccagccccagtattgtgattccctgtccagtgttcgtttggctacatattctgagtttacactttgttcattgaactcaatcccttttttcttttaaagtacactttcaaaatgattggaggaagggagtgtttttggtaaatgggtttctagtgtacatagagttaagcatccaagaaaggttttgataggtccaggagatagaaactgtgcgcaaagtaggtggagcattgagcaagtaaaaatcccattttgcttgtctaggatctattactgttggcagagaagcagaaggaatattaacagaatagttttcctgctgttgggcatgcagttttgtccatctagaataaatctgttgttggctgagtagagcaaattcctgtctgagagttggggaagcatggctagtgttaaacaagaaactgtgtttcagtctgactttgatgtctgccttccttatgctgtgggctgatgtacatcagagacattttttccttcattttcctccaataagaaatctgttttgccttttctgatggatattaaaaagaaagatttttgctcagtatttgtcatcataaattctcattgctgctgctgccctcaaaaggattgtataaatgaggtaggtaagaatttccagtatatgtaacagtttatattgtagcctttttggtgatattggtagaaagtttccaatattgaaattgttaactttcagttaaagtattgaaattgttaacttgagaatgctttaaaaatatttagagttctgtaatttagtgaatttatggtgtattctgtgtgaggagggggtaggcttttgtaaattctgaatggttagggaaaagtttacctttattaagagttaatgttaatgttaccctacgacatttgaagcatcagcttttaagaagcaagtgctggcaattcttaggatctgaaagattgcgtcagagaattctgtgttgtgactcacttttatttttctagcagattagttggcaaaacacagtatatagaattcaaatgagaagtcagcctataaaatgtgcatatgtttttgtggggtttttttagttcaaataatacaacataaaatttgataaacatttgtcttatatcggactctcaatgtgctattatagagttacagttgttcatttttttgtaccccatttaaaattgtgcagaagtggcctttgtgttttgtaatgagtgtacaatagatattcaagaaatacttatatttaatgaagaaaaataagctactgtcccatgtcaaaaaacatatgacactactgcctaaagataactcttgtgaattagaaaagtaagagaaaaatatctgtagagccagtgagttgttggctctggaggagtggaatgagagggctgtatgtccttaacaaactctagttttgttctgtgtaagatagtaacccaatttatctagcttagttcttttttcttcttttatcatgaaaacatcttgttatcattactttgttctgtctggtgcttaaaatcgtgtttaagaataatctagttcacctttcaaaaattatcagttataaaaattacattgagttctcatgtcttaagaacgagaaacctatgagtacattttaaaaactgtaactttgtatttattttaaacagctttctattacatgtcccagatgacttttctgtgggtcacttttaggatcagtgaggtttcataatcattccatgtacacatttacttttaatatacaatacctgtatatgcttgcttcttaaatgattcagaatacctcagctaggtattttaataatcctggcttattgatggttgctgactggtaaaattccttgttatatttttcagtatttaagtgggtagcattaagcagtcttaatcttttaataccagctactggactggtaaggtgtgtctcagttttattggctaacttggcacctatggtacattttttaaggcagtagtagtatctaaatatgtggtatagcattggtatggaattttctatacaaaactcttggctgtaggttgaaaaagcagcataacctaccaaatttaaggttgtattatgcacagttattggttttgctatatcttaatatcttttgcgcagtgagtattcctatttgtaaagtcatgaattcatatatgtttgcagggataggattaacaagaggattattattaaggataatcaaggatgaaagcaggttcaagaaaagattttccttcctttattatctttggtgattgcctttatactcagaggtagccttgggtcagcaaacttaatacttcaaggagctttgaacccagatacgacatttgaattcagttggacaggtgttatcattattggctagacaggaaacctgaagctcagaactacttctacttgtccagttcacactgaatgtcttttattgttaaatgtttttgtcctttcaatgtgcctatgctagattaaaacagaagaatcagtatacatttgctttgttaaattaatacatagttttattgccagtaggctacatacattcccttgaaatgtatgtgcttatggaagaaggaacttttttttttgagacagggtctcactgtgtcacccaggcgagagtgcagtggcacaatcatggctcactgcagcctttacctcccgggctgaaatgatcctctggcccagcctcctgagtaggtggacctacaggcgtatgtgccgccacaccccactagttttttgtctctttggagagacagggtcttgctttgtgcccatgctggtctcaaacagctgggctcaaacgatcctcctgcctcagcctcccaaagtgctgggactacagctttgagccaccacacctggccctagacttttaaaatgctatcaaaataatcagaagggccaattgtgttagctcatgccagtaatcccagcactttgggaggccaaggtaggaggatcggttgaacccagcagttcaagattagcctggggaacatagcaagactttgtttctccaaaaagacaaaaaattagctgggcatggtggcacacacctgtagtcccagctacttgggaggctgaggcaggaggagtttgaggctgcagtaagccacaatcccaccactgcactccagcctgggcaacagagcaagaacttatcattatctttttttttttgttttttttgagacagaggtttgctcagtcacccaggctggagtgcagtggcactatctgggctcactgcaacctctgcctcctgggttcaagcgattctcctgcctcagcctcccaagtagctgggattacaggcacccgccatcatgcccagctaatttttgtagagacggggtttcaccatgttggccaggctgtcttgcactcctgacctcaggtgatccacctgcctcggcctcccaaagtgctgggattataggtgtgagccaccatgcctggccaagaacttatctttacaaaaagaaagtttatgcagtttttatatgtttattgtagaaaactaaaaccaaatgtaaaccagaatacagttgttcctccctgtctggggagttggttccaggaccccacactcctgtggataccaaaatttgaagatgctcaagttccagaaatataaaatgacccatagtatttacatgtaaaaattatttacaatagctaatacaccgtgagtgctatgtaagcagttgttatactgtattgtttagataataatgacagggaaaagcctgtatgtgttcagtactgtgatacagttttctcttttgaattttcaatatacagttcgttgaatccacagacgtggaaaccatgaataaggagggccaactgtgctcagttttttactatcagagaatttttagtgtgtggcattcatttttttcttgcatttcctattttcataagtcttaagtttgaaataccagcttgctcaattaaagcaggcttttgcttcagcagcattattttgtcttcactagaattatatgaagataaaaacaagctgggaaaaacttaggtggagttggaaaaataagattgaggaaaatacagatagtgatctttgtagtcattctcataaatgaagcttttaaatacatgaatttaactttagggtcagccctgctacacagttccttgctgtgaaaagttagccctgcgagtagaattctccaaattgggtcttcggaataatacaatgagtaattgagcattatccagctttggatataactcttgtacttaaaagactttagagcttatcattttatgtatttcatttatttcatttagatctatgagagattacatgcatttctgtgatttattagtcactaattttgttttaccatatctgtcattgacactatagataatcagaatttatgtatatttaataacttaacttttctgaccaccccaccccaactccattccctttgttttatgtgtctgttgacttacagtgccacttgaacagcatatcagtgcttcaactcttgatccgtgtggtgacttagatgaggtcagaatagatgagatctttttctctttcaccccacctcttagacagtagcattttgttcttacatcttatgtatattttccacacattgctgttttgtttttgtttttgtttttgttttttttaaagatggagtcttgctctgtcaccaggctggagtgcagtggcttgatctcagctcactgcaacctctgcctcccgggttcaagagattctcctgcctcagcctcccgagtagctgggactacaggcatgcgccaccacgcccatctaatttttgtatttttagtagagacggggtttcaccatgttggccaggatggtctcgatctcttgacctcgtgatctgcccacctcagcctccccaaagtgctgggattacaggtgtgagccacggcgcccaacctgaaaatttatttttaaagaatttattggctgggtatggtggctcacgcctgtaatcccggcactttgggaggccgaggagggcggatcacctgaggtcaggtgttcgagaccagcctggccaacatggagaaacccccatcccatctgtactaaaaatacaaaaattagctgggcatggtggcgtatacctgtattcccggctactcaggaggctgaggcaggagaatcacgtgaacccaggaggcagaggttgtagtgagccaaggtcacaccactgcactccatactgggcaacagagcaagactccatctcgagggaaaaaaaaaaataagaaagaatttatttatactttataaagattttaaactattactgtgatgactactatgtagtatcacatgtgatagtggtaatgagttttcttctgagattaattgcagagcttgtctttcgtatgggtccaatatattacttttcattgtgttttatttgtgcaggacaatttgctcttcagttatcataccaaaacaatataaatcctcaactcctttgagtttgttaaagattactataataatataatccctgccaaactaagcatgtgaattcatgcccacacatgggttcagtgttcaaaatagttaaatgctgtattgatttatgtgtttagggaacaaggttgaacaaaagatcttctaaccaattagaacatttagctttcttttttaggcaataaattcctttacttgaaacacagcagaagatattaacatctgcctaaattttttcattgtcacatatggaagtaagtgaccctgctgtcactgttccatgttttcttgtgaagagctaagttgtcactacccaactgtgacactgcatggaccaactcctgcaggcgagtcagaaaaaaagccgggatagtaagaaaggaacctaaaagaaccttaattggaaatttaaaaaacaaagttcaaaggccctgcttttattaatgtatttctgtttatggttttcagggggtgaagccagccagttttgacaaagtagcaattcctgaagtgaaggaaattattgaaggatgcatacgacaaaacaaagatgaaaggtaagttgcctcttttgatctgggtgatacttgaacaaaacctaaaaagtaatgtgctttgagtacaacacacattctacggtgtatttaatatttgtgattggtttctctatttgtgcctgtaacatttttaaaggtagggttttgttcattgtggttattcagatttgatatactggaacactgtaaaaatatggtttggtagagtttcagtaaaccagaaccaccataaacatagctacattccatgagaactgcttacttaaaacatcagcatgatttataaaactcaaaaaagagtttaatatctaacacaggaaatcttttcttagtcctttaccattgaattctaagtggtgaaataaaactttggctctttaaagtcagctcagctattacaggtctgatttgccgtccttacgccagaattgaagaagagcaaaacatcaaaattccttgagtaaaaagagaagacttggcccaggggttggaaggagatgtggcttagtcatttgtactaacagagggcttctcttagaggagtggcaagtatctgatctgccatgtagctgattcatcacccgtcaggcatggcgaaggtccagtgtctgtttctgaaaaacagtctatctttgccacccccttccatcctccaaaaaagaaaaaggagaccagctagtacaaatacaaattgcaaattgagcataatctaccacttgaagaatgagagctatcagatgtatcaaccgaattaaagaattccatcttttcacctctccagtctcgttctttttataacatcgttatttagaagagcttaacttcatggtttttaagcctttattaagtaaaaatttagtttgagttttcatttttatatatgctgggtacttaaatctctttaagaactttttactataaacaaaggaatgtttgtttcaactcttttttttttttttggacacagtcttgtcacgtcgcctaggctggagtacagtggcatagtctcagcttactgcaacctctgccttccaggttcaagcaattctcctgtctcagcctcctgagtagctgggactacagacgcacatcaccgcacctggctaatttttgtatttttagtagagacagggtttcaccatattggtcaggcgggttgcagactcctgacctgaggtgaaccacccaccttggcctcccaaagtactgggattacaggtgtgagccactgggcccagcctgtttcaactcttgttggagcagtttattagatgattggcatattgaaaccattttatcttaagattgtttcacaatcagacttctgcttgcccagtacacaaattattgaacaaggaattaagagaacttactggtgtaaataaagcttgctgtggtagaaagtaccaaactagaaacaaaaatatttattttctagtttctatttcagcatttacagcttttataactgtgagcaagattctcaacctttctgggcctccatttcctaataatcaggagatgatatcaaattgggtgttggtcagacaagatcataaatatgaagatttgtgttacttataaaatgctatataaatgatcatgtggtattttgaagctttaatagagccaattgtgttagcccaccattactagtatactattactaataagatcattggatttaaaaattatgttacaattgtgttagctcgccattactagtatactattactaatgagatcattggatttaaaaattatcactgtcagctcttattcatgaatgagattgttatgatgttttataacttcagagtaaacctctgtaggcacccttcaaattcagcaatgtaaaaatgagttatactttcccctgtattttttcccatttttttcttctgcgaataacaataattggccacatttgaaaattattttttcaaactaatggtgttttatttttgttccttttcttttccctctgtttggaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtaaattgacattagccattttaaaattgatttagacttatatatatcaatactatcattaagcaaaaaagcagttgatgaagtgccgtgtgtggcatatcccattgacataaaattgtgatggccctaaaagttatctttgattagtgggattttcgtgtgtgtgtgttttttttttttttaaacttctttgtattgcttttataatgggtgttagattttatagtcctttttaaaagtaaattttttttttttttgatggagagagagacagggtcttgctctgtcaccaggctggagtgcagtggcctgataatcatagcttactgcagccttaaactcctgaactcaagcaatccttctgccttagcctgccgagaagctgggaccatagggacgtgccaccacacctgactaatttttgtatttttagtatagacagggtttcaccatgttggccaggcttgtctcgaactccttatgtcaagtgatcatcccacctcagcctcccaaagtgctgggagtacaggtgtgagccacttcgcccggccaaaagttatttttgagaaaatatgtagatatatatatacatagggatagatagatgagatagataggtagaactagtagaatgcattccgaagtcattttgaaaagtctgtaagattgagtgactcccagtttgtataagcatcattcattaagaatgacaagttatgtttctacatattggtacattagcctttgatcagttatctggatgaactctataaacagacataggaccatgaattgtttttactttgaagagagttttcctgatcaaatactagtaggaagcctttgatgtattattatttgaagtatgtctaaaagatcactcttccataaggaaacccttccccaaatttatgcttgccatagtgcccaaaatagctgattattatggaaagataactcagaatatctctactcggatttatcagaaccattcaaaagtggtagttgcctctgagaggagatcaggtatgagttacttatgtttaattgttagctgtttgtattgtctgagcttttttgcttttttggaggggaggagcagtgttaaatcttcatattcgtaccacagttgttttagcagattaagtagttgccttgtaaaagaaagtgaaatcaacacaggttaatgttagtggttacgtgtgagggggaaatacagtgaatagaacagagtaccttacttggtttaggaactgaggttttagttgccctattgtttcgttgtttgttataaggagtgaaggtatacctacccttcgagtttctgcaaaaatggtggtacccacccctcaagtatctacaaagatggtagggaaatgcataatgcagattttacagttcggttaaggccagtcctgagagaattctttcttcctcctcttctctactttttttacaatgccttttttttttttggcggggggtggtggtggggggtgttgttttctttcaatatactactgcttaatttacccttttattctgtaggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatgtacgtatcttgggaagtggacagataggctaatgattctcctaattggtttttttagcttcttgttattttgcactggctttttggttttgaattatgaatcctactattatacaaaatttgaaatggttgtcgtctagcttctctttattcttatatctgtgactaggagaatagaaggatggggtggtaaggaaatgtgattaggatacaaaataattttataagcttcaacatcttggaggtttcaatttgtagatttctacttttcacaatttatttaaataaaacagatttaataatgaagaatgaacaagcttggctactaaaattgaacccatcagtctggttgagctcttttagcaaagctgaatggtatatagactaaaaactaatgagaacactggttattaatttaattacttgtttaatactgagaacctcctggcctccataattaagactttgaaagctgtgtcaaatttaaggcttatagtgtttcatgctgtttcccttactcctcaggtggtaagattctgtgatagccatatggattcctcatttaaatatagaaatctactgaatatggctacaattcattttttatttagttcaaatctgtgcaaggaataactagttacccctaatataatgggtctaaatatgagaaaatgtgaacctccattttgtgatttgtctttctctctctcttttttttggcgattcatttttccttcagctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtggtaagtaaatgcttaagagcatgtaatactacaatgagagccaatggatagtctgctaaattaaaattctttgtacaaaccaagtaacagtatgagtctgaagtagaaaatataaaatgctgtgtctctaaagccttattatagagtaggatatagacattaatgtgtgggcattagctgaactgcctacatgaagcagctatgtgcaagatttagattagtctgcatttttactaaagggaacgctctctttagcacttaagatgttgaaactattcacagcaacaaaagctggacatacaaatgttttgcgggtggggcgagaagagtttttcaaaagcttgttaaaatgattactaagtatttcctgtaagattccctattgtacaaaacacaggtaagaccttcaaaccattatagaatgctgcatgtgagtactctagattgagggaatcctttatttgaatgactgtttaatttagcgcttgtgttgagttaatcatcagttgctgtgtgtgttcctgccttttaaagtctgtgttggacacaagttccttccccagtatatgttcttttgctttttccctttagttggtaactgttttattactgatttattttcagaatcaacttatagaaattatttcctgaaacattttatgcttgtatacacatacacacacacaattatcctgtgttttacattagacactcttgtttctcatatagagaatgttaaagtagatcatcagataataccccatttcttttgttgacctcagaggaaaataaaatacgtcatctgcctctgaaaggtattagaaaataagtaacttgtcactgtacagcacttgtttagtgagatctttaagcagacagattttccccttctcagaaagcttttaatctaaactttgtggaattcttgctcttctttaaatgaaaatctttctctgttaagaaaatacttctgcttgttcgattttttatcctacagcttggaataaaagatgttcatttgtttcagagtccgtttaatcctgctttggctaggtctcaaaatgaatggccacagtaacacaaataaaaaactaatatactaactttttaaaacaatctactttctgtctttaaaataattgagggtagaatagaagaactttataaagactgcacagaaaatatatttctgtgttctgacaaatattacttgtcagcatttcttgtcagtttctacctttaattgttttttttctggattattataactagattttgctaagactttttttttaaaattttctcttgtctatactcatcatgggggagcattaggtctctattttagaaagcaagtagaatgacatgaagatattatttgagccattaatctagctatatttattgatgctctaaaagcagacgttcttgctttttaatgacagtattctatggaggtattatgaagaattattaaatattgagaatttaaaaatttgtctaattctattcttgtctcatttcaggaatgtggcttacaataatatggacaaattataagtgaaattttagaaattagaataaaagaaataaggctagagagaaatcaaaacaggaatgaaactaaacaatcatatgatgatatgtaaatacttggtattggtgggccacagatttggcccaaagcattctacacagccaagttttggaaatgaaaacatagtttcatagttcacaacatctaaaaggaaaataacagtcttattcaagacaacctttatggtattgatcatactgccttatagccatattaaaccctgtgcctgaacatttttttaagtttttttttttttttttgacagcgtctcactctgtctcccaggtgggaatacagtggcgtgatcttggctcactgcaactttcacctcctgggttcaagtgattctcctgcctcagcctccccagtagctaagattacaggcacccatcaccacgcccagctaatttttgtattttttttagtagagacacagtttcaccgtgttggctaggctggtcttgaactcttgacctcaagtgatccacctgcctcggcctcccaaagtgccaggattacaggtgtgagccaccatgcccggcctaaattattatttagagattcagattgaagatattctcccattgattactttgtaaaagtacaaaatatttcctatatccagttgtgaatttcttctagaaagctaaactttttcctagtagatcatgacttttttacctttacaaataaagagtggcaagtataagaaatactgtgagccaacaactttccatctcatgtcttctaaaatagaaatgagaatctttttctgaggtttccagagctcttgcaaaataatccaatcttaaaattctctgtatcttttaatgtactttaaactaatagaattcattcttgttgaatcttaagtttgccaaagttgcaagctaatattcattgttttccctgtctgcacccttcagtcagttggtcattcttaaattcatacacttgtaacacttggtgttatttcagaatatttagcatgataactgatcattatcatgatcattcattaaacctgtccttgactgacaacgcagaatagttgtgaatagttgtgatctgtcagatgtgctatgttgagttatagctctcctcaaaaaaaaaactgactttgtggaattgggagaggatggaacatttcttcatgcaactatgccctgttatcattgtacttttgtttattttgttttcacagtactgtgtttttcatgtgtgtgtttgttttgtgttgagcctcgtcgtggccgtagcatgtcggtttgtgttcccatctttctgctgttgcctctgtgtcccgcatctctcccagtgctcttccaccccaccgccagtactgtctgcacctctttctccttccctcctccggactgccccgaggaaacttttgccgaaaagctttctaaagcattggagagtgtcctgcctatgcactctgcctctcagcgcaagcaccgacgctccagcctgccttccctctttgtcagtactgtatgtaactgtaaacttctgacaaatgaacaattattaccaatgaatacatccaggcaacaagaattttaattaaaattgaataaagaacaggactaaacttggttatattatgcttctaggataccagttattcctgtaggaaacttttttgtaataaggctttaagggggaataaaaagcaaggaggtaatgagagagaatacctataatgtccttggcacataccagcatgtgtccaataaaatttacctttcattatatcttcctgtttcctatcgacataaaattctttcattttcatattctagttttaaaaggattaattttaaagttattgccttaatcaaaagcaaattttatcaaacattacccaaacattttttctcctcactttattctaaggagacactaataaaactggatgagtcctttttttttttaataaccttagtcagcaaagaataaccttggagtgaacatttattttaatttaatcatttatgtaagatgatgtatcagcaaaccaaagaactacataatgttcccccatggaagtattttttccttaggtttcaacctaaggtgggactgtagctctaatgaatgcattagatgcatatatagtatgtatgactttctttggctccattaatgtttataaaagatctatcttataaaattattttaagcatgtgggtccttgctgcttttccaaataaagaatatagttaactttctgaactagcaaccccagaattttcagatttttacttaggagaatgaagaactatacagtgttattatggctttgagacataccatgagtaaataacaataaaatgagcattctgactgaaaatagaaatccttatttagctattgtgaacagttgatctactttgccagctcgataaggatcttccctatggaagaatgaaactgaattcttttaaaaagcgggggaggctgtgatagtgaattcttactattatttacttatttatttatgttttggagatggaatctcgctctgtcgccaggctggagtgcagtggcacgatctcgactcacggcaacctctgcctcctgggttcaagtgattctcctgcctcagcctcccgagtagctaggactacaggcgcatgccaccacacccagctaatttttgtattttagtagagatgggtttcaccatgtttggccaggatggtcttgatctcctgacattgtgatccacccccttcagcctcccacagtgctgggattacaggcgtgagccaccgcgcccagcgggtaatgaattattatagtgtatattgtttgcatttggcaagctgtgtttctaaatttagtcttaaatctagaactgcttctagaataaaaagtgctatcaaataaaattggctgtcatttatattacccttttcagttgattagaacaccaggatgtcagaatcagaaaattcatggttacggccgggctcagtggctcacgcctgtaatcctagcactttgggaggccgaagtgagcagatcacctgaggtcaggagttcgagaccagcctggccaacatggcgaaatgtgtctctactaaaaatacaaaaattagctgggcgtggtggcgcacgcgtgtagtcccagctacttgggaggctgaggcagaagaatcccttgaacccaggaggcggaggttgcagtaagccaagattgtcactgcactccagcctgggcgaaagaggaagactccatctcaaaaaaaagaaaaaagaaatttcatggttatgcaactcttatttatgatcagaaaaatggacattttgtgatttaactctgtaacatgtttcatgtagtaaaaatataataaaactattaatcatctagcttgggagagataggagaaagacattactgtcactagtcaaattatatatcttttactatccaccaaaaatctcttctgatttctggttagaaggcatactattaattgataagaaaataaaactgaaggcctctaacatatcacagggtaataagaatatagggaaagttagttcaatagtttaaattaaagcacacttcttacagtatagaactagtcgggcttttatgccttgttttagttcttactcttcctttaactctttttctgttgatgtaatttacattaatgcttaagagtgaactttttaagtgtgggtaaaaacgaaataattacttacaaagtttaattcttccatttcctttgagagaggaaagttatggaaaagcagctcttatctaaagcaaagagcccacagattgatttcattggccctggatgtatttaatggatttttactatgcacataatttccagaagcattgttatttatttattaattataaatttagtgtaaccatttcatagggttacacagaactacccagttgtgcatgtctgatgtaatttcacatatgaatgtatgaattacttgtcttattcatgttgatacagcctcagtccatggcgcatccgtgtggggggaccccaacatacccagaatcacagatatttttcccaactattcatgaacgtccagtttctttttcaccacctcccacctgcccaccgaaagtagccatttcccagcggcgtaagagcacctccttcctggaagcccaaactcaccacttccaacccctgctgaggactgttggccaaagtcttcttccacctggtggcagcccaactaactggacaccagaggccgtagttatgttgggtactacagccagtagagtaactggagagtcatgtgagatacaggtccatcctatgtttgaaccatctcaagtttacagtgactatagacctggactagtacttccagaagaagctcactattttattcctcaggaagcagtgtatgtagctggggtacattaccaggcccgggtggcagaacagtatgagggcattccatacaactcatcagtactgtcaagtcctatgaaacagatacctgaacagaagccagtacaagggggccctacttcaagttctgtctttgaatttccatctggacaggctttcctggtaggacaccttcagaatctaagattagattctggattgggtccgggatctcccctctctagtatttctgcacctatcagtacagatgctacacgtttgaaatttcaccctgtctttgttcctcattctgcgcctgctgtgttaactcataacaatgagagcagaagcaactgtgtatttgaatttcatgttcacacaccaagctcctcttcaggagaaggaggtggaattttacctcagcgtgtttaccgaaatcggcaggttgcagtggacttgaatcaagaagaactgcctcctcaatcagttggattacatggctacttgcagcctgtgactgaagaaaagcataattaccatgccccagaattgaccgtttctgtggtagagcctatcggacagaactggccaataggaagcccagaatattccagtgattcctcacaaatcacttcttcagaccccagtgattttcagtcacctccccctacagggggagcagctgcaccttttggctctgacgtctcaatgccctttatccatctgcctcagacagtgttacaagaatccccacttttcttctgtttcccccaaggaaccacatctcagcaggtcttaactgcctcattttcttcaggaggatctgcacttcatccacaggttataggaaaacttccacaattattttaaactaccctactttgcaccataacatttaaattttctattccttatttccctgaatcatggattttggagaaatattgtttaattttatcagtagagtttccccatctttggggggttgtgaactacatatatgcatttaaaaacaaaatgtgagagaagctacctgatttacctattatatgtgaaaaccagtggaaaaaacacaaaaactagaattttagtcattcttcacaatcacgacttctatgcacgttattttcaaccagtagtgaaaatgcaagtgtatgtaatgtatggttgacccagcattatttaggaatacaaatcttaagtattactttcttcctccaaacaagtttttaaaaaataggataaattttttttctataaaatataaaacatggaaaatagggaatgctgtttttgaggtaatattaataatacacagaattttcattagtgtcgaaggatctaaaaagacaaagtatatcatgggaataaaaaaagatagaaaaggaaacagtttaggaatttgccttaacaaatgaaaatgcctttttaaaatggcatcagtcaagcaagttgctgtgcattattatatgtccaaataaaatgctaattcataaaattaaggactgattctaatttttagcaactaacaatctagtgagtggtgggctttttttttttgttataagaatttgtgatatgttgcaagctaaggaacagtagacatcttaggccttgtattttcctcaacaaatttaattttagttatttatgtgtatgagcatatacacacttagcaaataaagacaatgtaatgaatgtaatagaattcaaaagtacagtcagtgtttactgtttcatatattcatttggtatattttatcaaatgtgtacatcttataaaatctacatagaagactatgcagttatatattgaagacatttggatatcctacataaagtactatgtgttgttcttcctactttcttcctatgttcttccctcatcaggagcataaacaactcccaaaatgtgcacaaattatcaattatttagtgctgtactaagacacaaaaagatccagaagcttgacagctatacatgggcatgcagtatattcacatcagtattcaagttgcagcccctattataaatattaatgtattgccagtaattatcctttagactttccaaagtaaaaaataccaggtagttaatttatagacatactacagaaggaatcaatatttataatagttaagctgcagtggaatgtgatattatatccatgtaagctttaaggaaccccttgtaaactgaaatggaatgacaaaagtggtagccttttcatttcgttaacatacctatatatagtcctgcatcatttctcactttctagtgagaaacactgtagttggggtttctcagactcaacactgttgacatctgaggttggataattctttgttgtggtgggctgttctatgtattgtaggctatttagaacatccttggtttatacctcctaaatactagtagcagcaatctccctcagttgtgacaaccagaaatgtctccacatattgccaagtgcccccctgggggtggcaggattgctcctggatagcaatgatcgccctaggtacttggcagttgatgataacagattttttgatacttttgataaaagtcattgtggcactacaagaagtattaccaaattagcattaccaaatacctttctttaattcttcagataaatttcagattgatagtattaatactttgttcctgattattgtatttctaataacaaattttattatgaatctgacgattctagccagctaaaattacagcctgagcagcattgacagcttaggttttcactgtcagtgggttttgcatgggttgggatcagaacatgttgtgtggtatgatccttttctaaatttttcttacaaaagttgacccagaggcctctcccatacataatcaggttaatgtttcattttgatcaagcaaactctgaggagattaaatattcattgcaaaagcctgacctctatacacttactttaggccttctctaatttgttgtgttcacttctttccttcaggcacaggggcagagccagggtcagccatcctcaagtagcttaacaggggtttcatcttcccaacccatacaacatcctcagcaggtgagaacaatgcattgcaacattttatgaattagcagtggccagaacactattttaacttttgtgatttgttatataaatggcctgctaagtttttgaaaggaaaattaagaggcataccatgtcttgtgttcagtaacaaagaaaaaaaagagacttttctgtgtttcagaaaaatctcttttgtttaatatacttttgaacaatttagtagacatacattattactgatataattatctttttaaaagaggattctacaccttttttttgagacaaagtctcactctgtcacccaggctggagtgcagtggtgcaatcttagctcactgcaaccaccgcctcccaggttcaagcagtcctcctgcctcagctttccacgtagctgggactacaggtgcctgccaccacactcagctaatttttgtatttttagtagagacggggtttcaccatgctggccaggctggtctcaaactcctgacctcaggtaatccaccctcctcggcttcccaaagtgctgggattacaggcatgcgccacctcacccagcctggattctacacataatttacggtacaaagagtatgtcattccttttctctttttttccactgcttgcagcagtgatttgtcattaccttcattgtgcttgcctctactaatcctgcacttctttttaattatttctaatctgtagaatgatgtgtcagattttacgctaagaagcatctaatgaaaacctaagaacaattacttcaagaacatttatttatttatttatttttatttattttgagacagccttgctctgttgcccaggctggagtgcagtggtgcaatcttggctcactgcaacttccatctcccaggttcaagctattctcacgcctcagccgcccgagtagctgggactacaggcgcgtgccactatgcccagctaatttttgtattacgttctacttatgcctggctaatttagtagagatggcgtttcaccatgttggccaggctggtcttgaactcctgacctcaagtgatccacccgctttggcctcccaaagtgctgggagccactgtgcccagccaaaatattttaacttttgttttggggggcttgttccagaaagttcaaggaattcaagagattagtgtcatcctgatacatccaacagtaaaactggtaattctaaaattaaatatttatagtgcatcactgatattagttaatagtaattatttgcaagggaataatgcatttttggcataattgaatacttattagctattctacataaaatttgtagccactatgtatgtaatgcaaacttcctaatgttagttccccatgtgggttttttaatcagcaaactctaaactggcttctgtttctattagtttttggttttgaaacaaagttttcggttcttaattacaaatggccctttttcagtccaacatatggtcatgtagtcattcgatactggtttaagatcaggagttgcttgtacaagatgaaaatcacttaaaggcactttctacagaaacagttgattagtttgtttatacatgcattcactccgtgaactgaaggactgggacttatatgctttgttttgcacctgtcctttcttccaaacaagactggttaaattcaagtaaacatatttttgccaaccttaacaaaatctgttttattctattaacagttcctaattagaatgcaaattacaagtcacataaagctggttgagaatggaagtactgagtactaatctcctaacttgcttatctttggatgtagacgaacaccaatgaactgagcaaattgtatgtgctctgttttttcttttccaaaggaattggttatctgtcttgtatttggggatatgtatgtatacttactatcaaatgaagaagataataaaataattcattgagtttcatgttaagaaagagtgtgagaaaagaagagagcagtaccataaatgtcagattaaaagaattaggtagctacctctccaggagaaaaaaatatggctaaatgctatctctacagcagaaacaaaaattaatttttgtttcagtgatgtttttgttttagatacttttatagcatgtgttgtagaatcacaaaattgagccctcgatatatataggaagtgtattcggtctagaataattaacttctccaaagtcacttagataataagggagctacaaattataacccagaattcaagattcctagaatagtattgtttcttccattttaaataaagttctgcagggacttaatgattctgcaaatgtacctcagaagctgtctttatttgttttaattattggagttccacgtttgaaaaaagaaaggttgaaaactttttgtactatatggatagtctatttttagacatgatttttgttttacgtactttcaggtcccaatcccaccttagagaaccatatctcttgttttattttagtgaggaaagaaatatacttttgctaaaatttactttatttcatgcgtttcttgaacatagtaaatgaggaattgcttttttgtgtgtttttgtagggtctcgtatagtgatatactagatcttagcaaggtaccaaaaatagctgcctcctgctgaaaagctttgtgaccacaaacaaagttgtgaactttgtcagacacagtgccagctacttggaaggctgaggcaggaagatcacttgagcccaggagttcaaggctacagtgaactatgatattgccaccatactccagcctgggcaacagagcatgactcatctcaaaaaaaaaaaagcaccgaagttgtgaactacctaccctactatccataaagtctgtttgaactggtttcatgaggcaagcttgggcagagcatgatgctaaactgttaagctagaccacccctgcctggctgaagtgctgattattagtcagtgggactgcgcacagcagatcatcatgtacttctggcatatccagaggtgacacttctccccagatgctctaagatgtaacattaaccgttagccattgtaaacaactggtttagagatctctttaagatgttaatacaagggtcactgtcatagatgcctctcagttgtcttaagcaaagaaataatttgtccataaaactgctcatttttgacagtcctttcagctttttttcctaattgagttcagatactgaaggtctaccgagctggaccaggtatgactactttgaaagagtctaaataatatagtaaatatatatgtaaatttctaaaaaacaaataaggataatagctaatattaaagtgctttgtacattgtacctacattctcatttaatcgttttaagaaccctataagtatagatgctataattatttccattttactgatgggaaagctgagatctggagaaggtgagtagtttacccaaacttacagcttataagaggtaaaaacagaatttaaatccaaataatctaattccacagctcaccatttgactactacccaattatgtccaaaaaaagggaagaaattaacatctctcccaagcaggaaagggaatatcaggaagactttaggaaaaaggaggcatttgaaatggactttgattataagttagactcagatgtagaaataaagaatattccaggccagaagataaaaaaattatactgtgagcaatgtgaaaggccctaagatagaaaaatagggtacaaaaacaaatgtgcctttagtttggtttaactagagcatagatatgtgaaggtataagttcaggaaagagttgatagagtctaaattttgatatgagcataattttgaattaaggaggatgtattgggggctgggagcatatgattaccatatgcccaaagataacatgggaattcttcctcaaatttatccgttagaaaagaggggaataaccatgtattcagacctttatcgtactctcatattacagggttttcactgtcctttactttgaacaacaacaaaccaaaaaaggttaatgaaataaaatgaaacaggtgagaacaaatgtgcctgcaaagacttcagctcatgtagttagaaatgttcattgagaacatcagacagaatatttttaaggaataaacataaatttagtccttattctcagcaatatgacttcactattctgaggactgtatgtgattttaaacaactggcttaaagatctctttaagatgtcaatataagggttacatgaataaaaacctataagagaaaggaaaaaaaaatctagttttattttaatgttatgtaaataggtgcttttcactgcacattttacctgaagatacaacttagatggaatgtgttatgttatgccagaaaactgcaggagcgttcataatttagcttcagtgaaggtaaagatgctggtgtctttacctatgtagagtttgggggagagggagcagtatttctgaattaatatatttaatatgcaatcttatttacgtgtgtaaattaatgagttagataattatagatatctcattcacattccttaaagtttaaatttgttcaagttggcaaataaaaaaggttttctggttttttagttcctttttctcaggtgggaaattaacaaatttgtcttatattcagagcacctttagaattggctacatgtggtttatcttagtttgcagaaaataaatttcatgtaattcagcagccatttctgcttctttaaaagttaaaataagaatacattatcagaggccggggcgcggtggctcacgcctgtaatcctagcactttgggaggccgaggtgcacggatcacaaggtcaggagatcaagaccatcctggctaacatggtgaaaacccgtctctactaaaaacacaaaaaattagccgggcgtggtggcaggcgcctgtagtcccagctgctcaggaggctgaggcaggagaatggcatgaacctgggaggcggaacttgcagtgagccaagatcgcgccactgcactccagcctgggcaacggagcgagactccgtgtcaaaaaaaaagaatacattatcagaaataattaaataggaataaaccaaacatgactgctgttgccattatattttagcattcttttggtgattttaattgacataaatataagaagagcaaaaatattatttgtagattatcacctaacaaaatctaagacacttatcaaggtggcaagatacataataaatgtacaaataaatagcttatctttataccagcagtaaccaattagtcgtatgggtataccagcacatacgtaaaaggctgttggttgcagcattattttaagtagcaaaaatgaaacaaccaaagtgtttatcattaggagactgatgccatttagaaattaaagtagtatgctatagaacactatgtataggaaaggcatgtttttgttttgtttattttaacaaaaaaagaaaactatgtgaaaatggccacttacgcatagaaaaaaatccatgaaggttatgcaccaaacgactaatagtggttacctctggagaataggattaggggtattttcattaactttataatatgatgtactagttaaaatttttattacaagcagatgttgtattaaagaaaaaatataaattaggtattagaagatcttgaaagtcagccctaaacttcatttttttttttttttttttttttttttggagacagagtttcgatcttgttgcccatgctggagtgcaatggtgcaatctcggctcactgcaacctccgcctcccaggttcaagcaattttcctgcctcagcctcctgagtagctgggattatagatatgtgccaccacgcccggctaattttttgcaattttagtagcgatggggtttctccatgttggtcaggctggtcttgaactctggaccgcaggtgatctgcccacctcagcctcccaaagtgctgggattacaggcgtgagccaccgcgcccagcctcaagtttttatttgttagacagaaggggcagtactctaggggtcatagtcctgttttgtttggttttgtttgcttgatttattacagaatttagtattcgagtacagttatgttccatgcattaaattaggtgtataattacgcaccatgcattaaattatacttgagtccctagtacatagtagattcccaggtgtcattccctttgccccactttgagttaaaaaataatgtccttgtttcaaaaagagaaacttcatttttttaataaaataagcaatctaaggcattaacagctagtaaatattaaagctaaaatttgaaaatgtctgttattccaaatccagtgctttcctccctattttgtagctataatcaaagctattcttcaagcatattaattatacagttgataaaatagggtaaggaaaaaagattaaaggaagctattggatctatctgatataggtgccaaagagagagctgatgccaagagatagggaaaagggaatggcagggatgggatggggaaaggaactgtctggatatgttatgtaaatgtctttgtaaagacctattgttggggtgagggagataattgggtgaagagccaatggtaacttgagtattaaaagattggttaatttttcctggtggcaccatcacaaagaacatcagagggaaaacaaatatataatggaaattgatgaatttgggtttgtgcatgtcttgattactaaaatcatcattatttacagacactgaaggctttaggtaaacatgcttccttagaaacatgctgttattgatttgaaataaaactgaatcattgtattttattcttagcagcagggaatacagcagacagcccctcctcaacagacagtgcagtattcactttcacagacatcaacctccagtgaggccactactgcacagccagtgagtcagcctcaagctccacaagtcttgcctcaagtatcagctggaaaacaggtaaactttttttttttttttaaacaggtaaactcttaatttctgaaagggtgctaaaagggatttccatgtaacttgtcctttcatgtggatagacttctaccttttcttctaagggtaaccaacccttgaagtaggttaatctcattgcagaaatgaagtgaagatcacctcattggtgcatatgcattatttaatgtaaatgggtacgttactgacagcagtgacaatccaaagtttcacttctagtcttaccagtccaaaattgatgtaacaggtattagaaataacaggttaaataaaggtgctctggtaactgaacctatgacattccctagaattgtgtcagctatgtctgatattctaggtttgaaactatgctttattttcatgtagatttctgcactgtttactgtgtggaatgtttttttttcttaagtagtcctcctaatcacttgagaagtaccctgtagaaggtatgcttttctgaatgaccttttttcaactttatttttgagtactgttgtgcatgtatgtgcacagtgtattgttaccctaatatttcatcacatctgagatgctatcaactttaaaatgtaccatattttatgtaccacattatcagttataaagtagatcccaatttctcacatgttaaaatgatcaggtagtggagagggatgattgcatcctagaatgagtgaaatatgtgaattataccaatttttattgagccatgttggacttaagaattttagaaataatacgaatgaaatcttaattccactgggaaggaattcatttgaatttcagtaactactgtaacagcagtcgtaactttagtgatagcattatggtatataaaatatattccaataaagctgttaaaaaaaaaagccaaccccttgtctatggaagggtcctcttctattgccaaatgctgaagcattagcaaatatttctatgacaaaaggtgtagaacagtaatagtctatttagcctctttctctcctgctctcctttccatattcttatgtggcatattaacttaacactaatgtatgcagggttttgttggtttggtgtttttttttttgtttgttttttccttctttttggctaatacataaatcttgcttttggcagccttgcttttttttttttttttttttttttaagcctgtctgttttgtttttctttaccttcccagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccaggtattgtgttagttagcaaaagagggcaccacagagtttgatcctagtagatcatcaggaacatggaaatctaatagttgagtgtcagaataactagcaataacatgtcaactagagaagcaaaatagtaaaattctgagaaaggattggataatgatgttcagtgattcctgatccatttttctcaagacacttcttcagagaaaaatggttctctcagtattcactgtaagctgattgaatgctagatgtggttaatagtacacctggcaacttttacatatatgggtagaataaatagaatagccaacatggtatcaacaaaaagcttcggggtttagactgggaaaattagcatttcatgatatgactgttatgtggaagaatttttgcatttttccatttaagattggctaggaagaaattgtgttcctcctatttaaatcatctctaggtgaagataaccgacaataaagtagtattgtagagtcctgtctcttctgttggaaccagtctactacttcatttcaagaatgtggtctttatatgccctttagattattagaaagagattggctactattcttctttgctgtgtgcttcttttttttttttttgcatgtcttgctgttttgctaatttattgacccccaacctgctctaactcaccttcctcatttctgtcacagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggaggtaaatagaattactgcatgtttatatgtaaaacgtatatatgtaattggacaacaatgataaaggagaaagaaacaggctcccctggtttagaacttatttggagaccatgtcaaactaacttctgcatgactttttcttacagcagaatgaaatgccaatgtggggtccttgtttccactggctgttctgttgggaagtgagtgtgccttggagaagatgaaccctattagcacttcacttctctagctagtactttagccattattcttgtcctttcacaaactttttccattggcagtcataagagtatcttaccctcctgtgctctcagcaatcatttttgccctgctaggagaagatctgaattcatctttgtactatgctctgtctgcgctattgcacactcttggtaagatgctggctgcatggcaagttgtaggttcacactgcctagcagatatgttggctgacctcataccatgcagtctataccagagactagctttagcaacttcctttggaattttaagaccattatctctagatgctgaatattgagaatttactagtaaatttagtgcttctaggacgtagtggggagggataaggaaaaaaataagtagattattggggatagtgaatgataaatctattactaccgagatttgagttatcttttcgattcacagagtactcagggagtctctcaggttgctcctgcagagccagttgcagtagcacagacccaagctacccagccgaccactttggcttcctctgtagacaggtacgtaaaactagaattctccttccttgactggtaaataagacggtatgaaacgccaaactgtcagacctttaaatctcatattataaactgcacttttttttctttttaaatttcaaagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtaagtattcctaatttgtgagtttcatgttgttaaaggaatttgacactgaaaaagattttagaggtcatcaaatccaaaccactcacttcataaaataaagataactatctgtgtgtgacagataattttttttttttttagacggagtctcgctctgtcgcccaggctggagtgcagtggcatgatctcttctcactgtgattgcagtgcctcctgggttcaagcgattctcctgcctcagcctcccaagtagctgggactacagacacgtgccaccacgcacggctagtttttgtatttttagtagagacagggtttcaccatattggtcaggctggtttcaaactcctgacctcaggtgactcacctgcctcagcctcccaaaccactgggattacaggcacccagccagataatttatatagtactcttctcatttcatgcccacagtctctttgacttaaatatcacatttttagaaaaatgaaaaggtagttcataaagctatgatagggccagcagttaatatcatttaaatatttcttaaggcttagatgaattgatgaatgtataggatcttataattagccaaatgatattcttacattccatatttctatgataaagcactacttatcttttagaaaaagaatagagagttttagtaagtagctcaaaggctaacgtcttctcaaagatttttcttgctaccagtttaagagacaaagtactagtgctccaaggaacagcgataacactatgcttccttagacataaagtcaagtgctaatctgcattgcttttctgaaattcagtaataaagctgaatatggtctttggagatgatgtaccttttttctttttaggtttcaaataaaggagaccgagtagtagaatgtcaattagagactcataataggaaaatggttacattcaaatttgacctagatggtgacaaccccgaggagatagcaacaattatggtacgtctgcatttggagttctaggtttttccttagtacttgatcttaatagccattgctctaggcaaatatgccatattttataatccatgtttttttaaagttatgcatttacttcaatgtgaataaaactatcacacccaacctgtgatttagtgatgtttttgtctaggctatgtctaactagatattgaagttcttaaaaagagaagagctaacttgagtacaaaataaataaaaatataggtaagtatgcagataggacagaagtcataaaagtgacataaagtttgagaaatgacactaattagactgacatcacatttcttttacaggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcaggtaggttcaccactcccatagtgaaactttgttgatttaaaatattttcatagttctaaatttgctatgcaaaatgtccagtgatatcacctgacacccatgaccgacaacaaacttttatgttctcttcacatgtggcagtttgctttgcctagtcattgagattgcatttgagaatgtatttaatcacttttgtttgttgtagaaattggaaggagagttcaaacaaccaattcctgcgtcttccatgccacagcaaataggtgaatttattttctttccttgtttttacctttgacttaagaagccattagccgagggtggtggcaggcttctgtagtcccagctactcaggaggccgaggcacgagaatcgcttgaacccaggaggcggaggttgcagtgagctgagatcgcgccactgcactccagcctgggtgagagaatgagaccgtgcctcaaaaaaagcagttgtatgtgccaataatgaagtctaacaatatttataataataatgctattaagttacgtttgtttgtttgtttttgaccaggcattcctaccagttctttaactcaagttgttcattctgcgggaaggcggtttatagtgagtcctgtgccagaaagccgattacgagaatcaaaagttttccccagtgaaataacagatacaggtaagggattgattctgccacattgttatgtaaattctacagtgcctctgctatgttgaaagcttaatcataaagcagtaatttatgatgacacagataataaaaaagaatagaaaactgaagttataaccaacagataaacatatgggagagggaaatagatgaagaatacagagaattacagaaaaagccaagaagcacggccataccaagatatagtctgtataatagatattgtagtatgtgtttatttctgcacttagtactgttgtctatgttttaagattactccatattttttatcaaaaacagatatttataggagctgacttaggctagcagacaatcttttgaatccatccttttaaaatcagctgattcttatctttttgtattcctttgcagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtgcattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtaaaattattgttataaaataattagataaatatgatcagttttttttctccctaatgagtacatttttcacttcagccttgtaagttagaaacatatttataaaggtacctggcttatagtatttattaaattgacagcagtttgagggtatatctacaatgaacatgagatttttttttcaagtgtggcaggattttagggttaattatgctgcacagttttccaagatggtataattatcgggtaaaatacaggtatttcttctgaattggtacaaactgaagaagtctgtatcccaaaagggagctaaatgcatctgtcagcaaaatgtacgtaaataatagcagttcatagtctttgtttcagtgagaatgaagcaaatttttggttttgttgtagattccacagttgtacagtttgggggttataaaaaattggaagttagtaaggaaattgatacagaggagaaataaataatctaatcctaggactgaagtaactaaaatttattatctaattatgctgtggtggatttcctcttgttctgccaccttctccaaataacaaggctgtgttacgtctactgtattgtatgcttcagcctctttctgcattgccattgatgtgaggttctttttatagtaggataatgcagaatcttcactcagataaaatagaaattcttgataatagtattagatttctgatgccttttgttatcagacctgcccattggttatttcttaaccagttactgttttcttttctcagaaaatcttgttttacatggcgaaagtctgatacatactgtaccaaataagtagctcaagaatatctggacactgccacttatgtacatatagcctttgttctgttctccctaggggacaactttttactgtattttactattcattttataggtatatcgtagtaacccctataataacaacattagttgtcacaccgtttttttaagacagataccagagagtaacctcagtgataaacatgtcttaactatatatattttattcttatgtttgtgcattcaaattagttgatttgctcttcagtacgcagtctttatatttagcgtctcacggacttgattttccctttgttgtctgtaggtgctgccagtgggtactgaacttccagcaggtactctacccagcgagcagctgccaccttttccaggaccttctctaacccaggtgcctcaagacttgacaaatttcttcctgtgccctactttctttgacaaagcttgctgaagttctccactacgtggtcttggcttttgcctatttgtctttgacttagtaacacctttcttttaaaatgttataaccaatgacccagttcctacttaagtaagaagcttcatagctcttttgtttgtaatgttgcttccggttatccaaaaacacttgatactaattttttttttatatcttatgaaggaagaaaacagcaaagcaaacattttgtcagacccatatagctccctttatcactcacacttctgtagaatagcgaaattgcgtatataatcaaaattaactttgagagtgccctagaaaggagaagcacaatatggcaactgagaaactttttccgcgagtccagagcaaccagtctcttcttgaatgttgatcatttctttcactagccacctaatgaaggaattagcttacttataggtaggtataggggtgatgtttcatgaaaactatgtgtgctgtctcttttaaaataaaagccaccgagctcagtgagatgctaacattatgagatcactcatggaggaactgagaccagcctcatgaacttgagattcccatctcacacagttctgctcacttgagtgcagtggtggacagaattacctgtaatatttattatttctctttcccaccgcagtccaccgccaacacatttgttgaatttccataagaaaagtactaattgtgaatctgttgtgaccaggaaaaatcttctgacatgagacaagccagtaaacttttaaactaaattaggaatttatttttgaatcatatataagaaataagaaaaacatggtaaattgcttacttgagaagctgagttggaatttatccctatttctttggtcccaatgtacaggggaacactatttgaggaacttgccacaatgaagtaaaaaccccaacagagaaagcactccatcagccaccacatttgggggaaagtgcattgtgaaagtccgtaaatcaggagttagaaaattagttttaaacttattttctcatttaaaaacatggattcagatttctaagggagtataaagtgtgacaaaaaatagcaagtgagacatgtggaggggtaagggtaaatagctagtgcctagatagagggaaaggcctaagcaaagactgtgcaagaatagattgatagaagccaagacagatgtaggattagactgtggaagggtagaaggaagctgtgtgcttgcggtggatggaatggttaacaggatggaatacccagacctccttgccaccatctgtagggaagaagtatacatgtaagaaagaggaaaataataccctgtgatagtgacagaatatgttaatgccatcttttattcataggggcaccttcccagaaagatgtataaaactgagaaagaaaagagggaacatgagatacagtgaatctaccagtagatctttgtacatttttcacaatatattttaaaggtcgcacaaataaataactctttctaccgttttgagtaacatcaaacatagaatgtaataagacttctcttaaactgcaaaaacatgaactactctgagccttgagagtctgacatacaatcttgagaaactggcaaaataatcaaagcagtacactaaatttgagtatagttttgtatgttccataaagacaaatgttatgttgtgccaatataaagcataaaacagtgtgtcctatctaaattggctatatatcgtgactctgaaggtgccacggaactgtatttactgtgattgttttcattcagtcccagcaacctctagaggatcttgatgctcaattgagaagaacacttagtccagagatgatcacagtgacttctgcggttggtgtaagttttgaaaatcttgataaaatctcctcataaccctaatatattatatgcctgggacacaaactgtaacctaaaccattattaatacctttaacatgtattcagagttcctgcttattctagccaaaagaaatgagactgattaatgaaagattcatgctgactcaggagtatcactatggaaaagattttatttgaaaggtgcttttttagttgtacgtctggtcagattgtgccatagatcaattctatggatttcgtatttttgtttcagaggaggctaaattttgtcagataaaataatgttttgggctaggtgcagtggctcacgcctgtaatcccagcactttgggaggccgaggcgggcggatcacaaggtcaggagatcgagaccgtcctggctaacacggtgaaaccccatctctagtaaaaatacaaaaaattatccaggtgtggtggtgcacgcctgtagtcccagctactcgggaggctgaggcaggacaatggcgtaaaacccaggaggcagagcttgcagtgagccgagattgcaccactgcagtccagcctgtgtgacagagcgagactccatctcaaaaataataataatgttttgattgaaactgtttttctgtgaatatccaagttatacccttaagcatcctatgagaaaaattaagaaagcaatcaagaattaagagtagaaattcattcttttaaaatgtaccttttttttttttttttttgagacaggagtcttgcgctgttacccaggctgtagtgcagtggcacgatcttggctcactgcaaccatcacctcccaggttcaagtgattcttctacctcagcctcccgagtagctgggattacaggtgcccgccaccacacccggctaatttttgtgtttttattagaggcggggtttcgccatgttggccaggccggtctcgaactcctgacctcaaatgatctgcccaccttgacctcccaaaatgctgggattacaggtgtgagccaccatgcctggccctaaaaggtgcctttctttacatcagacttttagactttaaaagaaaaaggaaagaagataaaatgttctcagacataagtgtttcatcacatatactgtctttctgcccttttacaaagaccataggaaaggcaacgaggcaaaagtttgagtgactgaagctaaagatttgtggtgtctgtctgtgtgtgttttacagcctgtgtccatggcggctccaacagcaatcacagaagcaggaacacagcctcagaagggtggtgagaaacatccttcctccttttatattactaattccagccctacccgtagttgattcaggaggtttaccgtttcaaagacacatttccacgtatttgataactgaggagcattggtagtaatatctaaagcttgaaagattagcaaattaataaatctgttccgttattatttgtcagaggaaaggttatacaggaggtaatgataagacccttcattattagctatgccagatccttgctattagagattaggaaattaaagcatactgtatttagaaaagtaaatttactgataacctcttagcttttgtgacactggatatatagggatagaagcttgaatagtctggacatatatttgtattgaaatacaaatgtaagatttcagttaatcaatttaaacatttttattttcaaggcaattatattctcaattggctctcattttaaaagtgatttgcaaatcattagaatggtctagaaatggaaaaatgaaaggggaatgtagattatcaaaatatgtagagtatcaagtatgtacaatgaaaataataaagattactaccaataaaaagagaatgtagaatatgaaaaaggtagcttttcaaatcattggaagatggaatatttctttttttttgaagtggagtttgctcttgttgcccaggctggagtgcagtggcatcatctcgactcattgcaacctccacctcccaggttcaagcgattttcctgcctcagcctcccaagtatctgggattacaggcatgcaccaccacacctggataattttgtatttttagtagagacagggtttctccctgttggtcaggctggtcgcaaactcctgacctcaggtgatctgcccgcctcggcctcccagagtgctgggattacaggcgtgagccaccgcgcctggctgaaagatggaatatttttataagtggtttagaacaacttgaaagccatctggaaaaaagcaaaggtggatcactagcctagacataagtaaagtccaagtggaccaaagatgaaatattatatcataaaatagtactatatgaaatcataaggggattttttttctttttttttttttttttagttttttaatttattagtaataacaacttgagaattgcatagtattaaggcatcagttcttggagtgtgggctgaggacccttttggggtgcctatgagggcaacactattttacagtaaaactaagacattattttcctttttcactatagacaaaaatttagccagctgtggtggtgtatgcctgtagtcctagctaatcgggaggctgagacgaggattgcctgagcccaggagttccaggctacagtgagctatggttttgccactgcactccatcctaggtggcagagtgagaccctgtctcaaaaaaaaaatcatgcatgaacaaaaaaatgtataggtcaatggattttaatggccacagttatgaatatcttattactattatttcagatcccacattataactaacttttttttttttttgtggcttggaaatcttttttttttttaattttattattattatacttttaagttttagggtacatgtgcacaacgtgcaggtttgttacatatgtatacatgtgccatgttggtgtgctgcacccattaactcgtcatttagcattaggtatatctcctaatgccatccctcccccgtcccaaggggatttttttcaactatctagagcagggttcacaaactctttttctgtaaagggcgagatggtacaaattttaggctttctagaccatatagtctcttgcaacttactcagatctcacaagtagcaatggacaatacataaataaatgagtttgtgtttcaatagaatttatttacaaaaacaggcagtaggctgaatttggtccatggatcagtttggagttctcagataagtttaatagaggtgttaagttcaatgtctaatccagaagcaagtagtaatagatataaaattttcttcatggaagaaaagtgccaccgattgcaaatataaatgaaaaactggggaaatatatatatttgtgggagggggaggggtatgtgtagtcatatcacaaaaagaactcgttttgctaatacaaagagttcctaaaattcaacatgaaccaaaaaacaatcaaaagataacagaaaaggaaacttagacatgaaaatatttaatgtccgtaatgatagaaacacaaagtaaggctacaagtgatagcaattcccacctctcattggtaaattcaggggtctaatagccaccagtgacttggtacagcctctggggggatcagtttataatagtgatgtctactacagtcttaaatggaaataattcagcactttcattgtggtatatttattgtacagatctataagagaatatttatttctaaaatagcaagaaattctgggccgggcatggtggctcacacctctaatcccagcactttgggaggccaaagcaggtggattgcttgagcccaggatttcgagaccagcctgggcaatatagtgagacccccatctctgcaagaaattttaaaaattagccggatgtggtggtgtgcacctgttgttctagcttctcaggaggctgaggaggaaggatcacctgagcctgggaggttgagattgtggtgagctgtgatggcatcactgtactccagcctgggtgacagagtgagaccctgtctcagggaaaaaagaaaagaaattctgaataatttaaatgcccatcagtagaagcctgattaaatatgaaatatatatatggtatatacatagggtatgacactatgcaatcattaaaaagaatgaggcattgatatggaatgatctcaaagatatagaattacatgaaaacataaaaatcgctcaatgttctactagctgtataaaataaatatatctctagaaagaaactcaaagcattgttccccggaaaggtttttaaattgcccaaaactaaataattctgagggctgggtgcagtggctcacgcctgtaatcccagcactttgggaggctgaggcgggcagatcacgaggtcaggagatcgagaccatcctgactaagacggtgaaaccccgtctctactaaaaatacaaaaaattagtcgggtgtggtggtgggcgcctgtggtcccagctactcgagaggctgaggcaggagaatggcatgaacctgggaggtgtagcttgcagtgagccaagatcgcaccactgcactgcaacctgggcaacagagtgagactccatctcaaataataataataataataataattctgagaactgtactatcctattctagaatttgccagtgttacattgagaaaataaaattagctggttttcatttaacaatggatcttggctggacatggtgattcacacctgtaatcccagcactttgggaggctgaggcaggcatattacctgaggtcaggagttcaagaccagcctggacaacgtggtgaaactccgtctctactaaaaatataaaaattagccgggtgtggtggcacacgcctgtaatcccagctactcaggaggctgaggcaggaggatcacctgaacccagtaggtggaggttgcaatgagctgagatcgcaccactgcactccagcctggccaacagagcgaaactccatctcaataaaataaagatgggtccttaatgtcctcagtaaaatctcatccttcatttcacttacttatatatctgaattaaagaatgagtaattgagtttttaaagcctgttaacctttgtttttatagtatatgttaatgttgtagttggtatctagtagtagagcaaacaataactcttttcccctgttggacagagcctcatggagggaggagataaggaagttctctttgcctctaacagctttcctcatgtgtagtttgattttgctgtatttctagctaaagggaaaagaagttaactggaaggagacacttatgttttcctcatccatgtatttgtttcagtttctcaagtcaaagaaggccctgtcctagcaactagttcaggagctggtgtttttaagatgggacgatttcaggtaagacagtcactttgtgttgccttgattccttcctttggaggagttgtctatataataaaattactgcctacctatttgggacacaattgccagtctagtgatttctgtcacatagtactttatagctctttttagcattttcctaataaaagtaatatatactaaataaaatatagaaatacttagaacagtagagacacggtagatagtcgtactatctatccacccacctcccaagattactttttggggtgtatttccttccactccttgttttctgtacaagtgtttatctaaaattaactaccatttctcctgttccaaatgttacagctttttttcccatccagtaattggtttacctaaccagtctctatcatcatttctcatttttccaacataataagttaagtaacagcaaacatctttgtgtataaaaatgttttccacgtttaaaataattgtcctaagattaattctttaaattaaaacacatgataccatatcactttattttaccaggttgtccaacatgtgagcattttctggctggggagagtaggtgatatttttctcatttgtaaacaggtcctgaacctttataggtgggctgagtttgtatttgtaaatacatggacaaaccagaacaaggatctggatcctcttttttagttaccagttagttgtgttgattcttgaggcataccaggcatttaacatttaccttgtagtttttcttattcacaggcaaccctaaaaattctacaatgccttgctaatttattttatttatttacttttattttatttttttatttttatctatttatttatttttgagacggagtctcactctgtcacccaggctggaatgcagtggcatgatctcagcccactgcagcctctgcctcccgggtttaagtgattctcctgcctcagcctcccaagtagctgggattacaggcacacgctaccatgcctggctaatttttgtatttttagtagagacagggtttcaccacgttggccaggctgatctgaaactcctgacctcaagtgatccacctgcttcagcctcccaaaatggtgggcttacaggcatgagccactatgcctggccctgaccttttgttatgtatatgttgactaagacataaatctgaattctgtgtatgacatcaaatacgaaagtaaattatttactttataagcgtagccagccacacagaatctgcatctcagtacccatgtgttctctatgatggtattcaatttttcttcctagtcaaaagtggaggcgctatgtaaagagacaatcagcctactctttgacagggaaataaagtgattctttttttccttttttaaattgtctgtgatagaaattggatattgagaacttaagtttttaatctttgtccttttttatcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataagtaagtatattttctcttgtgaaagaatgtcagataaggttttcagacctagatcccagggccaagattaataatatttttcgccacaatatgctaatgtctcatttcttttaaagagacagtgccacagaagccccaccccatacctccccaccacacacacacacacacacacacacacacacacacacacacacacacacacacgattcccaaccactgactcacaggcacaggcagcttctcttgcactcatacagacccatagcatttctagttctagaacttcttcattgttactatattattactgtattattgttactgtattgtattattatttttattaatagcatattgtatcactattaactgctctttatttattagtccactaaatgaatctggcactgggatgtatgattatttggcacgttttgtttggcagattgggtcagagtagcaaattcagctattgtgtgcgtggcctcaaaagtcaggaaatgtttttctcctaaaacattatcaaccatttgttgttggctaggagcttgttggaacatggcttgggtaatgcaggccagcaaggtgagttgacaaactagaatctcgtggtagtacatttggggaaaaggttcattagtaactactacatacttgaaagcaggtttaggaatatgctgttaattcttgtctgaatgaagaggattatggtattttgaattatgtttggttatctttcacagacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaaaaagccctggactaggtcagccacagctgtcctatcttttgtttctgtctccagctgtatgtgacctgctgaacatttgttgtttttgttaaatttcaaaggaatttggctctcctgatatttttgcttccttgactgctgtacttacatttattgtacctctttttgagtctatagaagtagacttagtgaatacaatggcttattccattgtaatccatattgctatctactggtaatctttatttatagttattcttaaggatagacatttagctttgcctgttaactcgtataactcacatttaaccaaactcttgggcagttggaagaaaatacattattctctgtttagtaaaacttgggtagattctttgttttaatggatgacttagtcataattgcaacttagatgaatgtaatcgtcatatagatatttgtgtgtatgtctaagtggtaacttcttgattaaggtttttatttcatttatattgggttaaagaacttgctagtcattggttaggcacggtggctcacgcctgtaatcccagaactttgggaggctgaggcaggcagatcacgaggtcaggagatcaagaccatcctgactaacacggtgaaaccctgtctctactaaaaataaaaaaattaggtgggcatggtggcaggcgcctatagtcccagctactcaggaggctgaggcaggagaatggcatgagcccgggaggcggagcttgcagtgagctgagattgcaccactgcactccagcctcggtgacagagcaagactctgtctcaaaaaaaaaaaaaaaaagaagaacttgctagtcattaaaatcaaagaaatagttaagtgatactcttttgtaatgtagtatatatatatatttatttattttaagagacagggcctcactctgttgcccagactggagtgcagtggtgtgatcatagcacacaacacaacagcctcaaactcctaggctcaggtggtcctcctaccttagcttcctgggtagctgggattacaggcacacactaccatgccctgctaactttgaattttttttttgagacagaatcccgctctgttgcccaggctggagtgcagtggcacgatctcggctcactgcattctccgcctcccagtttcaagtgatcctcctgcctcagccccgcatagtagctgggattacaggcacatgtcaccatgcctggctaatttttgtatttttagtagagatggggtttcactatgttggccaggctggtctcaaactcctggctcaggtgatccacccaccttggcctcccaaagtgctgggattacaggcgtgagccaccgtgcccggccctggactatattttaattgggatagatagagagtttctaatcctttggtgaaattatggtagtgttaacacaattagttgaaaagtaaaagaaggttaaaatatgttaaaaagcagttgcaaacttcttagcagttccattctctggaaaggttcacagatatccaaatgtagcacattagggccagttcatgcagcccattagtagagatgtgattgtaagagaaatcagctaatttctgatctgatcccaatcagatcttttttgtttttgtttttgtttttttgaggcagagtcggcagtggctcaacctccaactcccaggttcaagcaattctcatgccccagcctcccaagtagctgggattacaagcatgtaatcccaaaccaaatgtataagaacacctggctaatttttgtatttttgtatttttagttgcactatgttggccagactggtctgaaacttctggcctcaggtgatccgcccgcctcagcctcccaaagtgcggattacaggcatgagccactatgcccagctatgatcctaatcaaattctaatcctaattttgacatactttttgagtggacttgaattcaactgggaaccggggagcagagagtcaattttaggacaaccgacctattgaaagcaacctaccaaaaataattttaaacacccattgctctgtagtgacctccatcatttttgaacacctcttttgtatttgctctgatgcacgtttataggaaagtctaagcagagactgcctagcaaacctttttgtataatgattcaacacattttctaatagggtaaaaaaaaaagcaatcatggaattgcagaatggaatctgggtatccactaggtactctggtcttcttacgctgctcagacatgtggcccatctaggttttctaaagctaaaaagctctggaatagtacatatggccctattacctatggattcttttctttttttttttttttttttgagtgcagtggcatgatgtcggctcactgcagcctctgcctctgggttcaagcaattctccttcctcagcctcctgagtagctgggattataggcaccctccaccacgcctggctaatttttatatttttagtagagacagggtttcatcatgttggccaggctggtctcgaactcctgacctcaggtgatccgcccaccttggcctcccaaagtgctgggatattataggcgtgagccacaacacccagcctatctattgagtcttagtgtcattcctcacttctcccgttagtgaggactttgttcttctcatcagtttgtagcttttgacccatcattcatcactcagtggaacaaaccaaatgtataagaacagtgcctgatgagtgcatgggaagagctggacatgtttcctcatgccactttatcttttggcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggtaataaagcaaccatcatcgtccaaaaacaataaaatggagatgttgccatacctgggacaaaagcctgttaaggcgggttgggagactagctgaccagaacacagcctgtgtgttgtacactgaagaatctgggtgaaaagggaagtggagtgataatgagaatcggtgggctcactgctcccattaggtgaaattactttttttcaaggaattacagtgaaaagttacatctgtgtggcctatatgacttgctcatttgggatttggaacttaggctttaatattaggctgagatttcctggatgaaattctaaggtgttttagcagtttctgaagctaatacattttcttagccattgtagaattttgttacttttaagtatgggagtggcatactaaaatgaataaccttacaattcagttttttatccataatctactttccaaatatagctctgtttattagtgattgctgaaaaaattcccacagaggaaagagcttttagtcatattagaacaagaattgaaaagacttgggcatctgggtgagaagaatgaaaaaaatataggtactggcttatgtgcctttgccacagtttcacagaaattagagatcagtctcttcacaggaagaatgcacttgattggtaaggagggcaaactagctagcattattcgaactaagaaaagcttccgcattttgcagatgggtagaattaagacctaatatttcatctcttacatatctgaccttccccccagaagcttgttcttctgtgtgccatcttagtgcatttcaccactccagcctcaagtttctaacatcttgtagttgtgttctgtctcttctcctctctctgttctaccctgtttttcccctctcacaggctgtgcgaagtttaactgtgcatctgaacaggtgacattcaaacctggtggcaggaggacccgatttctgagtacgccctgcttggctctttgtgtgtaacacctttactccttccttgtccttgtgtttctgctgcttggatctgatgtttcacgcagtccattttcatttgtctctttttgtatatcatctactcagtggcttggctgaattactgttaccctcagaagtttgggcccccacattaattatgataaaaaatgtcaaaataacaagttatctacaaatttcaatgtaactttctggtagaagtgcttcttcatggatctgtgacagagagtggatatggtatctaggcaatagattgctgggtcatttagaataatgaagactgaactccacagtcgtagtcagtgctgtctgtctgccctagcattagaaatgagagaaatcagccagacacggtggcgtacacctgtaatcccagcactttgggaggccgaggcgggaagattgcttgaggccaggagctcgagaccaaccctgggcaacatggtgataccccatctctaaaaaaaaaaaaaaagttagcctggcatggtggtgtgcacctatagtcccagctgcccaggaggctgaggcgggaggattaccaccttaagaccaggaggttgagactgcagtgagccatgattgcaccactgcaccccagcctgagcgacagagtgagactctatctcaaaaaaaagaaacgaaatgaagaaagcattttgaccaatgatgctcttagatcctggcagcaggtaaaaattatgtaccatttttttccattctttgtcagagtagattgaaatcttatttttcttctctattaagcctaagcagctaccagttgaaaagatgctaggatctcttcattggatcattccaccactactgtcctctaaccccataaaatcaaaagcggtttttagtttggttattctgataaagcacttagtctaataaagatcaaagcccagcatctgcaagtgaaaattctccttctaacatgatttctgggattttgcagctttctacttaaaaacaaggcacaatagcaagtcaccccatcttccccatatgtgaaatggagatgatgccagtgtcctagggccatcgtacaaatcaagctaagatcatgtacagagaaacaggtagcgcttgaaaagcactcatggtttctctctgatgagtcagtgcctacctggcacagaacaggtagtcaataactgttcgtggaagaacagtttaaaacaaacaaaaacatagttcaagtagaaaaacctttgttataatttgaataaagatcttctctgttaaggcctcaaacttctgatgtgattattgaagtgctttttacatgcatgtgctcaggccatcactgtttctgagtatgggtcagaggcccttgggcctcttcacggtgggaagaatttacaacctccctttgttctctgtagtgactagatttaaagcgaagcatatgacacgtttaactgccatttccctcacacatacccctgttatttttacctgcattagaaatggattggctccttccagcacccctattatttgtacctgtattagtaatgagttagctgtacttgagaggcagtctttactgactttccccacatgcactagtcccaggctgtttaacaaagaagcgggtggaaggcattacccaattcgatcgttttccaggcttgtgtgattttttttttgaggactcagatcaataatttttctggtcagactttcctggactgtgcatattagcactttgacagttgaataagcatttaatttgcatgtccacctagaaagttgcaaggggggtgtttttgaagtagaatgtgacatgtcaggcctatggtctacagcctgaagtgtctgagagggaagaaagagaaccaaagcttctgtttctgaaatataatgtgacaaataccactttaattaaattccataaattctcatcccacttttaaaggtaggtggtattacccctgttgttcaaatgaaagtggtcagaaatattgaatcttgtcacttccctttgggtgcaaaatgaaaggccctacatccttagaagtcacatcaggatacatcatgtaagcctggtaaacaaatcccaagagacatacttgaaatatggaaaggaaacaggtacttgaaagagtagggcaccttactagcttgagatgtattattctatgctctcaaaatagataatggtttggaagcacggcttggcttactgctatatttatgttcagaggttgcttgttttccacgtacttttaaaaactattctggaagggaaggggttagtatatatatgtgggatgtggaaatataatagccaatttaaatgaacttaaagctgtaacagtgatactatcagtctactgtggtggggttgctaatgcatttaactgagtgctttttaacagcccagctggagaaacaggaagtgggacaggatcagtggaaacgctgcttgggtatttgaaattcaagcagtgagacctgagagactggagttcctcgccaattccagaacctcagtgcagggcattactcttttagatacaaagattgggtgtagaaactccacatctgtcagccacgtaacacagcccatcagataatcatgttaaggctaacagccagttcgaaacattctgtagaactatatctgttcaagggctaccaggtcctacctatctgtctcacctcctgctttctcttgctgggcgtttgtgtgctgtttggagattctaaatattttacactgatgtttctttatctttaacacattgcttctctctttgtgcttcagggaagatggtgaaaaaagtctgtccttgcaaccagctctgtagtaattatcttttctgttatttttggtccttgattgcaaagcctgttaaccatgagttctttcaactctgcagtctcatagctccctgattcctaacttccatctatctctgtatcctattctaataaatatttaacatgcttaattgagaaatcatctcctagtcggtgccctcagtgataaccccatgtgagcctagcttgtgacagacatggattggtaatggccatgggtatatatagggaggtcagggatgcctagttcctatgggagagcgatcctttggtcagcaaatatgtgccgggcagtgttattaccccaactggaaactcagcagtgacgaaagcatacaaaagtccatgccctcccacgttcacactgaagtgggagatgtgtgctagattgacgaggagaaaaacaccactttctagagtttgtcttcttagactgtggcttctcatactttaatgagaaggccacttacagtgttgtaggtagggtcaacagggaaattctgtacttgggatgttgggctgtaagttatggttcataataggttattgttagtaggatctggtgatgtgggaataggggaaatgtattataatggcaggaggaaatttaaaaatgaatcttgggggtaagtctatactacttattagggcttttcagaagaactaaaaaaggttaagaagttagcatattctctcaaaggcctttctacatcttttatagtcaagtctccttttcttaggagttaatttctggtcagaaaatgataggtttgtttcattctttaatgggaggcctgtatacagaagccagaacgtgaaggtttagctgtatggttgactcttcctcatggtttctctttcctcatagagaatcctgtattaggtaatgtagggtaaaatgaaaagtgaaatttcgttctaaaggggcctcgcagcatcaggggcgacagactagagaggtgtgtctcccagcatgagctctgtggataagcaatggtcacgcctcctgagcttcttgtatttagcttttgacagctctgctcccctgtgattatttctgttttttgttttgattgtctctcacatcaagctcaccaagcaataattgttcaaacaggatgacaatccccatgcatgtgatatgcttgctttctagattgagtcactcactgtcatgactgcccatcctcattgcctgtgcttcccacttcaccactctctcacattggctgttcatggaaggctgttttctgtgctctcatgcttctcccctcgcgtttcctgtactgtagggagcttactcttcccttcacactgtatgtgcaatagcaatccccttgtggctccagcagacaccaagaaatgagctgacactcacactgcagtagttccgtgtcttgccatagcggtaagaagcatgtgaccttcctcactgcagcttcacctcagaattagctgttactgcagcacagacctgcttgtgtgtgccattccccaggtggtaggatataagcttgacttgagaccagcgatggtcagtaacaggctttgaagtggcaggattgcgttaggtgtgctgctgtgatctggtgctgctttgaccttgaaagcaggataacgcatgcacttacttacccccgcattacttgggtaccttaaggactagtggttcacaacttactttaggagcttttatttattctgtaacacgtgagatctggtaagacagtggggggtaaggaaaacagacaagaccatgactcttctttccctcttccccaaaacgtgcctcttggaataatcttcagtgtgccctccagcagagccgaaatcaggcaggcatagactccctcctctctcatcaaaccgcagaaatagagttccttcatcataaccgcaaagcttcctcctcccctttgcaccctgcctcagctgcattttcttgtcgcttctacatgggagtgcttgctgttctgggaagagtggggagaagcggtgggaatccttgagccaattgaaactgaggtcatcttcaggaaaaccatgtcttcctgaagttgaaagattcaggcacaccatacagtcctttcctcatgaataatcttgttctttactcatgggaaattgggagaggttaacccctcccaagtttatgtttgcaaattcatgtttatgggtccaggtgaaaaacttttctgaacacagcatgctacttctcttattacctctctctatttaaagaatggctaggctgagcatggtggctcacacctgtaatcccagcactttgggaggctgacatggcaggattgcctgagcccagcagttcatgactaagcaacatatggagattctgtctatataaaaaagtaaaaaattaactgggtgtggaagtgcatacgtctagtcccaagctacttgggaggctgaggcaggaggagttggaggctgcagtgagacgtgattgtgccgctgtatccagcctgggtgacagaaaaagaagagacccttcctttaaaaaaaaaaaaaagccgggcgtggtggctcacgtctgtaatcccagcactttgggaggccaaggcgggcggatcacctgaggtcaggagttcttgagaccagcctggccaacacggcaaaaccctgtctctactaaaatacaaaaattaactgggcatggtggtgcacacctacaatcccagctactctggaggctgagacaggagaatcgcttgaacccaggaggcaggggttgcagttaggtaggatcgtaccactgcactccagcctgagtaatagagtgagactccatctcaaaaaaaaaaaaaaaggctaaagaatgtggcagtgtccaatggtttggaaacccaccttctccttatccttagccaagcatcttttcctactcctactttaaccgtgcccaatgcacaagaaaacctctttttccctgcattctgcaaaattccagagcaactagccttgctgattgtatcacacctccatcagcaacgtgatgctgggaatagcgtactggcgagcagttccaatactcttaggtgctttgtgaatggactgaaagaggcccctgcctgtgtacctaccgtcatcctgagttgttcagccttagcagcagctactgaagagaaactgttttcatcaccctattataccaaaacaaatggctaaacaaaaccttggaatcttccctcttgcatggcttcccagttcatcctcttctcattctgtggcttgccattcatcatcccgtgaagttttccctcttcctgaaattgtaacctaggcttcttttaatgctcgtattctgttgcttataataggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattacgaggtaagtctctcttttgccgcagagaatccgtaacacacatctgagtcaaggtgatagaaacaactaagctgctgcttaacgtcttacgccacgaccttcttcaattttaatactttagaaaaacaaggcaaaaatcccccaggtacccttttatttttccttccctgaattcctaacctcttgttggtcagctcaactttttcttcttcgtttttccttcgtcatcctcaactacacacacacagacacacacgcacatgacatccctccctctcatgaggattattttcacccttacttggtaaatataaagagccaataaatactacagaagactgttctgctgtatcttacaggattatactagaagtatatgttagcgccacacattttataccatggcccacaccagacttgacacgtggtggttttgttttcagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttagtaagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 335 - DNA, 158530 bp, Homo sapiens; identical to SEQ ID NO: 334

SEQ ID NO: 336 - DNA, 158530 bp, Homo sapiens; identical to SEQ ID NO: 334

SEQ ID NO: 337 - DNA, 158530 bp, Homo sapiens; identical to SEQ ID NO: 334

SEQ ID NO: 338 - DNA, 129661 bp, Homo sapiens
ttctttcaagtggtaaatagccatttattgagtattcttgctttgattgtctacgtaagcatgtaagactacaacattacgacccatctcttcaagaggaagtctggtattatggaaaaacattttgtcattcagatttttttttcttacagtatgcccatcacaaaccaggcagcaagcaaggtattgggtgctactcaatccagtgaagtcttgagggtcccttccctctgtgaagcatataatctagtggggtagactgctagctactaactatgaaaacaacatagtctgacttgagagtggggaaagtggaacaagggagtaatttttatatttttcttcacatttaaaaatattttctaaacaatccaatataatcttttctataatttccaatacaatcaacatgtattacttgtaaaataatagcatacatatatcgacagactgaagaaggtatactattagagaacatttgcagaaaagaattccacatcttttttttgagacagagttctgctgtcacccaggctggagtgcagtggcagcaatctaggctcactgcaacctccacctcttgggttcaagcaattctcctgcctcagcctcctgagtagctgggcctacaggcacgcgccaccacacccagataatttttgtatttttagtagagacggggtttcaccatgttggccaggctggtcttgaactcctgacctcagatgatccacccaccttggcctcccaaagtgatggaattacaggcgtgagccactgcacctggccgagaattccacattttaagaatatggtaaaagagttttattctcttcagtaagatgaggttgagaataaaaaattaaaaagattaagcaaatgacactttcacatcatagggtagtaataatgaactttaataatcttaaaaaaatacttattggggataagaaatgtggtttacaagtaaactgttactttctagacttaacccaagaagttaatggagtaggtgtgtttcagtaaagtaacaggaaatggtacagaaaccaccaatggtcatcatgcttgagagtcaatacagcacataattcacagcacagatgaggctgggtgcagcaattcatgcctgcaattctaccactttgggaagctcaggcgagaggatcacttgagcccaggaatttgagaccagcgtgggcaacaaggctagaccccatctctacaaaatatatatttaaaattagttgggtgttacccaggcatggtggctcacacctataatcccagtactttgggtagccgggggaggtggatcacttgaggtcaggagtttgagatcagcctggccaacaaggtgaaaccttgtctctacgaaaaatacaaaaatcagccaggcattatggtgggtacctgtaatctcagctactttggaggctgaagcacgagaattgcttgatcttgggaggcagaggttgcagtgagccaagattgtgccactgtactccggcctgggcaacagagtgagacttcaactcaaaaaaacaaaaataaataaaaatgaaaaataaaaaaatatatatataaaattaggtacgtgtggtggtgcatgcctgtggttccacctaatcaagaggcagtggcaggaggattgcttgagcccaggagtttacggctgcagtgagctatgatcacgctactacactccagcctgggcaacagagcaagaggttgtcttttttttttttttctttctgagacaggatctcactctgttgcccaggttggaaagcagtggcatgatctcagctcactgctgcctcagtctcccaggctcaagtgatcctcccacctcagtctcccaagtagctggaactacaggtgcacaccatcacatccagttatttttttttttttgacggagtctcgcactgttgcccaggctggagcgcaatggcacgatctcagctcactgcaacctccacctcccaggttcaagcaattctcctgcctcagactcctgagtagctgggattacaggcactcaccgccatgcccagctaattttttgtatttttagtagagacggggtttcactatgttggtcaggctggtctcgaactcctgaccttgtgatccgcccaccttggcctcccaaagtgctgggattacaggcatgagccactgcacctggcctaatttttgtatttttttttttagcagagataggattttgccatgttgcccaggctggtctcaaactcctgagcccaagtgatccacctgccttggcctcccgaagtgctgggattacaggcatgagccaccatgccccaccaagacaaacaaaacaaaacaaaacaaaacaaaacaaaacaaaaacagtatagatgaaaggcagccagcctgggttcaaatcctaccgttgctacttattattaaataaacgtaagaatcttatggacgttactttacctctctagcaccttgactttcaaatctgcaaaacaggataataacacctatttctttataacattgttataaggattaagtaggttaatatatgtgaaatacttagagtaatgtctggtacacagtaggcactaaataagtgttagcagccaggtgcggtggctcacaaggtcaggagtttgtgaccacactggccaacatagtgaaaccctgtctctactaaaaatataaaaattagctgggcatggtggcgtgtgcctgtagtcccagctactcgggaggctgaggcaggagaatcacttaaacccggaaggcggcggttgtggtgagctgagatcgcaccactgcactccagcccaagcaacagagcgagactccgtctcaaaaaaaaaaaaaaaaaaaaaagtatagctactattataatcctgtgaaaataatcaatataaaattaaaaatcaacagacagcccatattgcccttttttggcctaacaaaaaacagatttctaagaagacagtaagaaatcagtattaatttaaacattgtacaggacaggagatcaaaagcacaggtatacaaatggttcatttaaaaaaactgatactcaaattgacaccctgaaaatgtcagataatttttcagaatgattaaactcactaaacatctgtaaacaataaatttatttcatttcttttaaagatttaatgatatacaaaacgtatatagtatctttaagtaatacactttttctttctccccacccccaatcaatattaaacactatttaaacagcttatcatctcttgccttgtctgtatctatgagatacactactaaatacaaataagctttatactgctcccttccaaataaaaattaaaattagtaccaaggaaacaaaagaaaaagaaaaaaaaagaaaaaaaattaaagcataaaacttagatgaaaagcttttcttgttattgttgaatattcaacaatatctggggctgttaaattacattttattggcataaggttgcactgcaatctgccagtatcacataatgataatccaactgaattaatttcttaagtaccacaaacagcattcatgttcaaatgttccaacacaattttaaatatatgcaagagttcatgtttacattctgatttgatataacaatcaataaaatctttggagaagtttgtaagttctgggttgttgctatagatacagatagggaaaaaagtactttaactttcctcaaaaggtaacttcccttgacgagtgagttaggtttctgcttttataatttaggttatgtatcagtttaccatggctttcttctacttaacagtgacttgataaaacaatgtttaaaaaacccaattaacatttttacacaatttgggttctatttaaaaaaaaaaactggctctatctttaaatatggagcctaaccctgattcataaataccgtccctcttgaaaatggtcttcagttcaggcttctcatacctctgtgaacctagaattagaacaagtcatttcccttcccgtggccaacaagcatctagttgggaaccagtgatatcatcactgaacacactaaatacactgaggaaaattttgactgccatttaaccaaaaggctgcgtgatttcttcatttccctagttgaatggcaataaaacagctgccaataaaatctgcatggacacctacctttggttaatggtattgtaccacataagagagagcatcaccctcatcaaaacaaagtcaaatgagatcctctgctatacaaagagccctttaaaaagttataaatactaattatcaattacctttaaaatttctcagctgccagctctatcctatagggactttctgactgattaatcaggtcaaaagaatattgaccttttaactgtgctggagtcagcaaattcaacttgcatacacctttctatattaccaaacaatttcctcccgagggaaaagtgacacagtaacatttctgtgaggtgcaggcaaaaccaatgattcagtaatattaatattataacatcagacgaacagaattagttgattctgattctttggtggaatttccaggctgaagattcaaatctgaaggctcatcctgaggaaatataattttatcaggcgtataatcattcctcttcagatctacattgaacacccacaacaattaaaaaaaaaaaagaaagagaaaagaaaaaagttagtatttcttagaaatggagaattaggaaccttttattttcttttcaagacggagtttcgctcttgttgcccaagctggagtgcaatggcgcgatctcggttcactgcaacctccacctcccgggttcaagcgattctcctacctcagcctcccaaatagctgggattacaggcatgcaccaccatgcccggctaattttttgtatttttagtagagacagggtttcaccatgttggtcaggctggtcttgaactcccgtcctcaggtgatccacctgcctcggcctcccaaagtgctgggattataggtgtgagccaccatgcccggctgaattaggatcatttctaatcaatttttctccaaacatgtcagacttgttttccatcaggttgttataaattcagtagtcaccaaatttatacacataaaaatgaagtcattcattcattcaacaaataattacatattgaccatgagtcagaaactcatgtaggcgtgggaatgtagcagtgaacaaaccagacaagctcactggtctcagtgagcttatattctagtgggtgacaaaaaataagcaaacagaaaaatgacagaattataagcagtaaaaagtgccttgaaggcagggtgcagtggctcatgcctgtaatctcagcactttgaaaggccaaggtgagagaatcatttgaggtcaggagttcaagagcagcctggccaacatggtgaagtctcttgtctctacaaaaaatacaaaaattagccaggtgtggtgatgtgcgcctgtagtcccagctactcagaaggccgaggtgggaggactgtttgagccccagtaggcagagattgcaatgacccaagatcatgccactgtacttcaacctgggcgacagagtgagatcctgtctcaaaaaaaaaaaaaaaagtgctttgaagagaagagtgtagtgaattataatgagggacagatggaagatggtatagggtgattgtttcaaacaggtctgggcaggaaagccagaggaagagatttgagtaaataccttaatattgagaagtgaactatcaaagctctaggaggagtgttctaggcagagggagggttaactgcaaagactgtcagaaggaatggacttagtgtgctttgcgaatggtaagaagacagtgtggcttctacatagtgaatgagaggaaaactagtagaaattgagctcaagcagcagttaatggcccaagattgtcaactacagattgtgggccaaatctggtctgttgcctgtttttgtaagtagttttactggaatgcagtcacactcatttgttcacagtctgtggttatttccacaccacgacggtagaactgtgtagctgggacagaccacatggtctacaaagcctaaaatatttgctaccttgccctttacagaagtttgctgatcttcatttatacatcatagatacaagctatgatgagaagtacagatacaatacaaatccactggaaggttttaagcagtctcaagagaggaacatcatcagatttgtttcaagaactattctgatgactatgaaaactcttgtgagaggatgggtggcagcagtccaggaaacaaggtggtagccatgaagacagagaagagcagatgaattctagggagatttcaaaattagaacagacagaatttgatgaattggctatgaagggcaagggaaaagaagaattggatagttttaggttttggacttgagcaactgggtaaccattaataagatagggaaacagagttctatgtagggtgggagatataaatcaagaattttggattggacacgttactaaagatgctttatagcaagcctgcccgaccctcggcccacaggccacatgcaacccaacacaaattcataaactttcttaaaacatgatggcatttttttgcatttttttaagctcatcagctatggtagtgacagtgtattttatgtgtagcccaagacaattcttcttttttttttgagacaaggtcttgttgttgcccaggctgaagtgcagtggcacgatctcggctcactgaaacccctacctctgtggttcaagcgattcttgtgactcagcctccccaagtagctgggattacaggcctgtgacaccacacatggccaatttttatatttttagtagagactggtttttgccataattggcaaagctgctcttgaactcctggcctcaagtgatctgcccacttcggcctcccaaagtgctgagattacaggcatgagccatggtgcctgcccaacaatttttcttccaatgtggcccagggaagccaaaaggatggacccctctgcttcagcctgggtgacagagtgagactgtctcaaaaaataaaataaaataaaataaaataaaataaaataaaataaaataaaataaaataaaataaaatagtatccaagtagaaatataggtagctgaacagaaacaggagcttgggaaatatgtcaagtcttcagacagatttgctatgataagtacataaacatatttataggtatgggacaagaagaaatcacttaagaagttacagacatagatgaaaatagttgcagaactggaaacaatgcagtaatatcaacattataaactaaccaagtcatgcattaacatatatatatgtatgtttttatttttttaaaaaaaaggatacacgtgcagaacatgcaggtttgttatataggtatatgtgtgtcatggcgtaaacccttatatttttatctccatataaaatataactgatactcagaatatgaactaatttattttttaaaaaataaaaatatttgacctcactgaatcataaactgttaattttaatctaagaaacagcctatattaaacaatccaaacatatttgcaactatattaattatttttgataaattttaaattcaagactatgtcagtatggctttagggatataagctaatctgcgattactgtacaaagaacagtggagagaaacacaattatagctcaccttaattatattgttaactagtaagtgtatcaatgagcaaatcatctcaactttaattatattatctagaaaatgaaggatctgggccagattgctttttttttttgagatggagtctcactctgtctcacagtggtgcaatctctcctcactgcaacctgtgcctctcgggttcaagcaattcgcctgcctcagcctcccaagtagctgggattacaggcacccaccaccacgcccagctaatttttgtatttttagtagagataggttttcaccatgttggccaggctggtctcgaactcctgacctcaaatgatctgccctccttagcctcccaaagtgctgggattacaggggtaccgtgctggcttaaaaaatggaaactgtttaaatttaaaacaaaatcaagaacctcagtatatgctgtctacaagaaacccaccttaaatataattatatatagatgtgtgtgtgtatgttttgaaaaaaagactggcaaaaggtatatgatgaaaacattaatcaaaagatagctggagtggttatgttaatattagaaaaagtatacgtcaaaataaggaaaattaccatgatattattaatacacaatgataaaataatcaattcgccaagaagacattaacaatagtatatgtgtatgcatctaagaacaacgcctcaaaacacatgaaggaaaaactgacagaactgaaaagcaagacagacaaatccaattatatttggagacttcctttctagttaatcaatagaactaatacacagaaaaccagcaaggatacaagaactccgaacactagcaacaaactttaattaatatttacagaatactccatccaacaatagcagaatatacattactttccaaagcacatggaatgctcagagaccataaactctttttgtttttttttttttgagacggagtcttgctctgtcgcccaggccagagtgcagtggcgcaatcttggctcattgcaacctctgcctcccaggtcccagtgattctcctgccttggcttactgagtagctgggattacaggcacccactgccacacccagctaatttttgtattttttagtagagatggggtttcactatgttggccaggttggtatcgacctcctgacttcaggtgatccacctgcctcggcctcccaaagtgctgggattacaggtgtgagccactgaacccagctccataaacttgtacttcaattaaaaaaaatttaattgaaatagtacaaagtatgtttcttttataatagaattaagcaagaaatcaattaaagacatttgtaaaattttaaactatttaagaactaaacaagacaatccatacatcaaagaggaataacaactgaaattataattattttaaagtaaataaaaatgaaaataaaatatactcaaatttgagggatggagctaaaacaatgcttagagggaaaattatagcactcaatctcttgttagaaataaacatctgaggccgggcgcagtggcttacacctgtaatcccagcactttgggaggccgagtcgggtagatcacgaggtcaagagatcaagacaatcctggccaacatggtgaaaccctgactctactaaaagtaacaaaattagctgggtgtggtggcacgtacctgtagtgccagttactcaagaggctgaagcaggagaatcgtttgaacctgggaggtggagggtgcagtgagcagagattacgccactgcactccagcctggtgacagagtgagactccatctcaaaataaataaataaaataaagatccgagaatcaataatctaagtttctactttaataaactagaaaaagaacaaactacacctaaagcgagtataaacatggaaaaataaaaagaataaatcaaataaattgaaaacagaaaagcaagagtaaaacaatgacaacgaaaactgattctttgaaggtatcaataaaattgataaacctctagccaggctgatcaagaaacaaagagcacagaccaaactgccataaggaaaaaggggatttgccacagacctaacggatattaaaaagatagtaaggtaacagcataaataactttatgcccccaaatttgacaattaaaaaaaaaaatggaccaattccttaaaagacacaaactaccaaaactcactcaaaaacaatttgataatcaacagtcctatctctattaaagaaattaaatgcttagtttatttttttattttttatttttaaaattattttttattattatactttaagttttagggtacatgtgcacaatgtgcaggtttgttacacatgtatacatgtgccatgttggtgtgctgcacccatcaactcgtcatttagcattaggtatatctcccaatgctacccctgtcccctccccactaaatgcttagtttaaaaccatgtgacaaagaaaacttcaggccaagatggtttgactggaaaatcctatcaaacattcatggtagggacaatatcaattctatacaatctattcccgaaaataaaacttattttataagtattatcctaatactaaaagaaaacaaacatagtgccccataaaacaaacctaccacagaccaatattcttcatgaacacagatgcaaaatcctcaacctattattgaaaactgaatctaacaataaataaaaaagatatgtatcacaacaaagtgtggtttgtcctaggaatgcaatactggctcaacattaaaaaaatcaatcgatgtaatacactatattaacctattaaaggagaaaaaccacatgatcataccaaaagatgcagaaaaaaaaatctgacaaaattcaatatccattcaagataaatattctcaagaaacaaggagtaggccgggcacggtggctcatgcctgtaatcccagcactttgggaggccgaggcaggcggatcacaaggtcaggagatcgagaccatggtgaaaccccacctctactaaaaatacaaaaaaaaattagccgggcgcggtggcaggcgcctgtagtcccagctactcgggaggctgaggccggagaatggcgtgaacccgggaggtggagcttgcagtgagcggagaccacaccactgcactctagcctgggcaacagagcgagactccgtctcaaaaaaaaaaaaaaaagagcgagactctgtctcaaaaaaaaaaaaaaaaaaaaacaaggagtagaaggaaatttcttcagcctcataaagtgcatctacaaaatccttaaagttaacatcatcttaatggtgaaaagacagaatgccttccccttaacatcagaaacaaagcaaattatgtttactctcactacactcattctatactgtgctggaaatccttgccagtgcaaaaagtcaagaaaaaaaaaaagatacacagaaagaaactgtctttattgtctatacaaaaaaaatcctgagaagtctattacaaaaagctcctaaaaaagagttaagtaaggttgcagggacatatgctcaaaaaaatcaatggcatttctgtataccagcaataataaaaaacaaattttaaaaactagtaccatttacatacctaataatgcttattatatggctggtactaagtatctcacaaaaccaactcattaagtcctcaaaaactccttggtgatgtaggtattctctggagccatgcatcctggctcttgagtctaagctcttaactattacaatactgggcatacgaagtgggactttcaaaaatacacaagggctgggcgtggtggctcacgcctgtaatcctagcactttgggaggctgacgcaggtggatcacttgagcccaggaattcgagagcagcctgggtgacatggcaaaaccccatctctacaaaaaaaaaaccaaaacaacaattagccaggtgttgtggcacgtgcctgtagtcccagctacttgggaggctgaggtgggaggatcacttgagcctgggaggtggaagctgcagtgagctgagatcgcaccactgcactccagcctgagcaacagagtgagaccctgtctcaaaaacaaacaaataaacaaacaaacaaacagctcaagggtgggccccagacatgtgtaattttttttttaaatttaatttttaaaagagacagggtctcactatgttgcccaaactgaagtaggcactacagctttgaactcctgagctcaagcgatcctctggtatcagcctcctgagtagctgggactacaggcatgtgtcactgctcctggtaggggaatttttttttaaagttccacaggggactatgatgcacatcaaagagagacaaccacaggtttgtgctttaactaacaattaaataataacttgtaattctctgcatacaaagatgatgttaatatcatgagacaatatatttacagttcctgttcctgcttgatcaaatagccttttctcaattcttctgcaaggctaacttgaaggtctattcattctccaagtaaaggcaaatacgttagtttcccaggatcattcccggacctgggtttgagttaagggacctgcttacatgttctatagcactctgttctgttttttcctctctcttggcatttatcagtcctgtaactccctgctaatcttgtcaatattcaacatgaggctaaactccatgagggcagagacatagctgtctggttcaatattctactttcaacactgagcacaattcctggcattctgcagacacataatatattaaattaatgaactttgtataaagaaagaaggaaaacacagattcatttataaccaacaatatgtatttgcaaaagagctgctgaagctggcacaattagagaccattacattaaacatttgtacctctggccttatgaggtattgtagtaaccaagtttcgtaacaatttatatactatactgattaagaaattttttacctggaagtttaagctttctacagcaagaattacagtgatgttttgctctgaagtttttaattgcatcttctcctagatttgctgggccaaaaaccatatcacaggatctgtagaattggtaattttaaaaaaaacaacaaaaaaaagggggcagtttatacaggtacaaatataaaatgtgaaattatgccttaatgaaatagttaaaacttattacctcttttcttctgcttttatcacagatgggtcagtcaaattttcaccaacacctttatatgtgtatataaaaaagacaaataatttatattatataattgacataaatactgacatctgcataataaaaatcatcttaagagatgttatagtatcatcaatcattacaatgttaaactattcaaaggagtgtagttcttctcttttgatatttcataacttgatttatgactctggcattctaccagggagaggcatatctccttgtaatgtgaacaagagttaaacgtcagagttggtaggtaggcattaagttccttatcctacagcaccaaggatgcaaatacctccttacttgtaaaaggtctggtcaatctgcccttgtttcatcttagttagcaaagaacaatttggtacatgaaggaataatccataggactttaaaagtgtttgggattggccaggcgcagtggctcacgcctgtaatcccagcactttgggcggccaaggcggatggatcacctgaggtcaggagttcgagaccagcctgaccaacatggtgaaacttcattcctaaaaaaaaaaaaaaaaaaaaaaaaagttagccggacatggtggggggcgcctgtagtcccagctactttcgggaggctgagacgggagaatcgcttgaacctgggaggcggaggttgcagtgagccaaaatcgtactactgcactctagcctgggcaacagagtgaaattcgtctcaaaaaaaaaacaaaaacaaaaacaaaaaacaagtgtttgggatttaagggaaaaaaaccacacacattaacacatatcacattttcttgcaaaacattcatgtaacacagagtaagattgtgaaaatctttcttcacctccagccctctccagaagtattatgattaaatccttccagtctcttacatattcatgtgtgtatatataaacacatacacacacacacttaacacctactgatattttgaataatcacaaatatttaacccattagagcaaaatctaataaaatggttcaatttcacaaaaggaaaaaccagaattaaaacacgatactattttccatccaacagaatggcaaacattaagaatattccatactggaaagactgtagagaagcaggaacttccgtagaaggctgagtatgatttctgataagcttttgggaaagtactctggcagttgttattaaaattaaaattgtactaatctcttttctacaccaatttaggaacttactttaaggaaataaaagtagcagtgcatgagaatggtttgctgcaagcactgtttgtagaagcaaaaaactaaaagtagagtgaatgtttatcaacacagatgtaaatcatgctatagctgctacactatagactatcacgcagcttactaaagaaataactctagaaaatgcctatgatatatcgttaggcagaaaaaaaaagtggaaaaaaaaaaatctcatgatcccagttggggtaaaaccaacacaacaaaacaaaataataaaaaagagggaaaaaagtctccgtttgtgtatatgtcttcacagaagtagagaaataaaaaagatgggaacactttgttctttatatattgctacattgtttaacttgtaatcatctaagatattcctatgtaaaaattgttcaataaacattatgttgagatggaatctactcggtgaagataccgtgaacattgttcaaatcacaagggatttagaatatacataaactttgttgataaagcagcagggtttgagaaggttcactccaattttgaaagaagttccactgtgggtaaaatgttatcaaatggcactgcgtgctacagaagtccttcatgaaaggaagaatcaatccatgtggcaaacttcactgtggccagagagtggctcatgcccgtaatcctagcactgtgggaggactgcttgaggccaggagttcaagactagcctgacccacctagttagacacccatctctacaaaaatttttaaaaattagctgcatgcagtgacgtgagcctgtagtcccagctatgcaggaggctgaggcaggaggatggcttgagccgaaggagtttgaggttgcagtgagttgtgattgagctactgcactccagcctgggcaacagaaagagaccctgcctctattttttaaaaaagaaagaaaaagaaattgctgcagtcatcgcaaacttcagcaactatcagttagcagtcatcaacatggaggccagatccttcaccaggaaaaagactacaacttgatgaaggcttagataattcttactattttttaacaataaggtatttttaaattaaggtatgtacactgttcttcatacacaatgctatcacacactttagactacagtatagtgtaaatttaacttttatatgtactgcaaatccaaaaaattcatgtgatatgctttattgcaatatttgcttcgttgcagtagtctggaactgagcctgcagtatctctaatgtatgcttgtaatttttaaacttaactggattggcctaactcataatggacatcagagagtttttcacaacatacaccaccataatcatttttataaaggtatgaactactgaaaaaagtatagttgtttttacatagattttcattcttgagctgaaacctgtttgcttttcaacaaatcttttatatttatacctgtacactaaagagtcactgagtaataaacattctaaacaattgttctcatgtgatttaaaatctggtctgtgtttacatttgaaattaagtctgctcttcagggagaaaaattatggaagccataatgaagagaagagctggcaacttgctcaatttaacttcctttgactcactgtgaagctcagcagacattactccaagcaaacctgccctcttgcagtcaccatttcttttttttctttcatatatatgaaagtcttttttcttttatatgtatgaaacacagtctatctgctaagatggctatgagcaatttttccctctatagatgcatatcgttctacccatcaactgctgaatctacttcgcctccccttgaatgtgggctacccttgtaagttgccttgatcagtaaaatgtggcagaaggcatctcaatcctgggcctagccttaagaggttctgctttctctctagaagaagccagctgctatgtaagaagtctaaatacctgaaactaccatgctgtgagcaagcccaagctagctagccatgtagacagagaacactgaagaactgaggaatttagttgacagtgaacagagacctcagacatttgactccagtcaagctgttcaatgtctccagccattccagtcttttgaggtgacagcagagagagacattcccactatgtcccatccaaatttctgaatgaaagaactataaggaaataaaatggcagttgttttaaatccactaaatttttaggtagtttagttcacaataacaggttaacataaacaccaggaacaatagaggtatttgttatttttaaagaaacggtctttatacttttgaaatactagactgcatatcttagaatagggaatttttacatgtttttgcttatcaaaacatctgtattatcttaaccataatttagatagccaggccgggtgtggtggctcactcctgtaatcccagcactttgggaggctgaggcgggcagatcacaaggtcagaagctcaagaccagcctggccaacatggtgaaaccttgtctactaaaaatacaaaaattagctgggcgtggtggcaggtgcctgtaatcccaactactcgggaggctgaggcaagagaattgcttgaatccgggaggcggaagttgcagtgagctgagattgcaccactacactccagcctgggtgactgagcaagactccctctgggggtgggggagggggcgggggaacaaaaaaagatagccagattctattactcaaggccctgatggctatatgctatgactgtgattaacttgcttttttatagcttctattggcctaagattttatttatctataaattagcagattctgtataacatatgaataggtgagaacctactgcagaatttcaccttagcaatattttaataaatttaccttgcaaatcaagtaccagtaactcccctcttgtatattcgtaagtccagtggctaaaggctagcatgatctcttccagagtattagttggaataatctcatctccattattattgttgtattttctaaattctccagtcatacattcttccacagcaaaccactgtcctgctgaatggcaatacagcaggaaaacttcaaggaaccttataaaaaatagttataaatattactagcagttttgttaataaaattctaattgatctacaaaatggataattaaatattcaacatcaaaaatgaaggtcaaaagggactgctatccatataataaaagatcccagaaaaaaattaaagatttaccttggagaatatggtatggatttgggtttcatttgattaaaggcaaacgtaagcttttgtgctgctctctgttgttgaatttcctataaaagggagggtggggagaacccttgtttaatatttaaactaagattatatttggcttattgatatttcagaagttaaaatataaagcttaaattatgttccactattaaatattcactgacacttactctcagacagagatgcagaactgtatcttctttgtaaatacttgaccatgtattaaccacctctggaagaaaagatttgataatataaagatgccctgatttgaggatatcatgttctgaccaggtacactgtactttgacagctcttcgtaaacctcctcccatctcctctttgcttaaaaactctattttggcacagaggcctagttgtgaccaagaagacatgctgttatttagtatgttgggtgaactctcttccaaacgatacactgtgacaggctcccctgcaacacaaatggaaaaagtttaagattaaattgtgactttttaaaaacgacaaagtaaaataaaaattagcaggcatctttgattaaggaacagaagataaaatggaccaagatgtagttttatacaaagaaatttaatagcaataggtaagaaatcaaggatactttcataatatctttgaattcatgtgtaatgttaggcatttttgaaattctggcattttagagaaaacctttaaaaaagcaactaaaattctacacacttctgaattaaacttagaagttagagctgtttcatggacactgtgatgtcagtttatataaattactagatagtggatcaagaactttttagaattagaatatattgttgcttctgaatatgccagtaatggagaaactcaatatttctgatgcttcccttcttctattcaaacatacctcacccttgtggtagtcagattaatcaagaatttatttgaaattgatacttcttaatgtaatcccacccacattctatattatagctaaaaatcattaaagggttaattttcacttatttatttctttaatttttggatttacctcttggaggcacaggtgtaaatggaatgctctgtgataacctcatcaagttatttctttccacagctgcataaaaatgagagagaaataattaaatctgtaaaggtccaaaatgctattaaattttgtttttaatattactgacctgaataatagtaatttgtatccatagctggcttaaatggagaagtgagacctagaatggcaaataaacaaacgagaccatttaaaaagtactagtacagcaaaaattttaacccggataatctcataaaatcattttgaatttccatagtgtaactgttcctcacaaaaacagaaaaattagggataaaatatgtccactgtgctatattaccctatttcattatgccagattagtgacagctgtgcatttagacacctacaagtgaagagcacattatgctgcacactatcctaactcctgccataaactcactcctcccatacctcccattcagaaagaaaaatctctctttgattctgatgtttgggggttggggactgtagccatgtaaatattttagcaggtctaccatgagaagatgaacttctggaatgtgaaacatacccatcaaaagcccttcccccatctttttgtgtgtgtgtgtggaattgacctttaaatgttgcaagaagacaaagacaagtcaaatctgctatgtgctaagtttctagaacacaaataaaaagaaacctactgtcttgcaggaaaaggaagttagccaacagttttaatactgtataaaaatatactttaaaaatgtgtatatacacatacatgtgtgcacatactgtacgactatataggagtacctaatgccttttggttgagaagacgtcaaagctatctcagagtaagagaagggggaagattgacctatagtgctttttggacatacatccacccagatgtcactccaaaatattctaattctgtaggtatgtgtcatcatagaaatgattctctacaaatgatttgaatatgcagctaagactacaaattaatgggcaagagtacagggataactgcaggaggtgaagctacagaaacagggaatatcaaattgttaagaggaggccaggcacagtggctcacacctatcatcattaacactttgggaggctgaggtggaaagactgctttggggccaggagttcaagaccagcctggataacatggcaaggccccattatcaacaaaaaagatttttaaaattagctgagcaaggtggcacccacctgtagtcctagccactcagaaggcagaggtgggaggaatgcttgagcctaggaggttgaggctgcagtgagcaaagtctgtgccactgcactccaacctggtgacagagagatcctgtctttggcaggggagggggcgggaggcgtggaattaagagcctaaagtgtgtgtgggggggtaattaaaagcctaatatgtcatgttaaggaagaacactggatttcattaaacaacaatggggaaaaaatgtaaagtggaggagtgacctttagaaaaatcaggccaggtgcggtggctctcgcctgtaatctcagcactttgggaggtggaggtgggcagatcatgaggtcaggagttagagaccagcctggccaacgtggtgaaatctcgtctctacagaaacacagaaattagccggatgtggtggtgcatgcctgtaatcccagctactcgggaggctgaggcaggagaactgcttgaacctgggaggcggaggttgcagtgagccaagatcacaccactatactccctactccagcctggacgacagagcaagactccttctcacccgggggcagggaagggtggcagaatagaacattgatgagaagcaaaactacaggcagggaccccaaactggtataaccactctgaaaacctatttggtagtaattaccaaatgtgaacacatgctaactctgactcagcaattccactcctaggcatatgccaataataaataaatacatatgtttatcaaacaacatgaacaagaatgcttgtagcagcaagtcataatagccatacagtggaagctactgaaatgaccaccaaatagcagaatggaagtaaattcaatatatttacataagaaaattttatatagtagtgagaatgcacaaattaccactatccacagcaatattgatgaattttataacaatatgttaagaagaagaagcaagacacagaacagtatatactgtacaatttcatttatatagccaatatgcacatacatgcaaacactcacacacgcacatacaccccaaaataggtgaaactattgttttaggggcagggactataagaagtagaaacaaaggaatggagatataggcaaaattgtttttaggtgctgattacatggctatacttactttgaaagaattcactgaattctgcactattctgtatgcactatacacttcgataaaaggttgacaaagtaatggtctaagctgaaagcagcagtgggatgtatagtggaggatggattttagagacatgtaggaagtaaatgcaataggactttgtgagtacaaagtcaaggtggtcaagaataactcagctgactaaaagtttcatttgttaaaacagatggaatattagaaaaggagcaggctgtatagcagagaccaagtagcagggaggaagtgtgacagtaaagatatcatcattcacagggtgattcgtgtgtttgtgaaacatctacagtaaggagaaagtatatgagggaagaactcttcaataccttggctttttctagcttgaagtctaaaatatcttacctagaataatgtggtgtttgctgtaacagatcatgtaagattctcatttttttcacgttcaatctaccacacagactcaccatttaatgttccttcttcagatggcctaaagaaacaccaaaaaatatagtataagctgtgctatgatttaagttttggctatcatttaattttttgattttatacaattattatataaaaaatattattaaggaaattctgaaattgattccctttgaatatttgccatttcccttaagccaatcccaatccatatatagatatatatatctatatatatatatccatatgtatctacttattaataacttgtatctccaatttatgcataaatattattagcagtttggtgccaaattgaaggctctatactaataaactatttcataacttctgtattcgtggagattcattccagtactgtaacaatacattgagatgactttgcaggatgctagaaatatttcaatagaattgatggacaaagaactgagagaaaagtaagtagatgtcattttgcctcttagtttctaatgttgaaaaatatttctcccaatgttaactgtatttatttataacaacatacactggcaccaaatgcaggttcttttacttccaaggattccagtgtcaactagacacacaggtagagtggaaaagagaacagaatgagaataaaggaaaacgggttagaggcttagcactttcattacacagctatgtagccttgctcaggaatgaaaggaccagatccagaaaggaccttgggagtagataacctgtctctttccagctcctacattctatctgaccctgttgtttcctgttgattttcaccttaatagaaacattttcttacaaaaagtattttgaacctaacatcattcctttgcctgctgctaatcaatcactcttttctcagcactcaaagggctgccaatcagctccacctttatgggtaattctcagggtcagcattctgcaagacaatgttctgttgttagacaccggaattaacaccaacttgaagtgcctattttgtacttacatcccatggctttggttataaaagaaaatattccttgaagaggtctgactataggtgggccttccaaatgccattccagggtcaggaaactcaatttgagcagctgcttatcctgtggcccaggtttattttcttctttatatattcagatttatttattttcttttttaaaaaaaattatttgttttgagactaggtctcgctgttgcccaggctggagtgaagtggtgcaatcatggctcactactcctgcgctcaaacaatccttctgcctcaagcctcctgagtagctaggaccacaagcgcacaccactatacccagctaatttagagatggggtctcactatgtttctcaggctggtccccaacacctgggctcaagcgatccacccaccttggcctcccaaagtgctgggatcacaggtgtgaagcaccatgcctggcccagatttatttctgattcacagaaggggaaaaacactgcagaataataatttcccccaaattggcttctctgctcaagtaatccatatgacagaataactctaccatgcttccagtatcaggtgggtgtcaaaacaagacttttttttttatttttttgcatatcctttggaattctacaatactaattcctaggatggaaacacagagattatcttagatttgtctttacccttatgtctaatatgtactaaaaagttttactttctggggacaataacctgtcagattgcctatagtttccacttttggttttggattaccacatcagctttctagtggatcttcctgtatgcaggctttctaatgcatactgtgtattactgctctaatcatcaaagtgcttaccaaaagcagatgcaaggttttgactagaatgatggatagagaaatcaagcaagtacaaaactaaagtctcaaactaggtctctcaacaaatttattcaggaataagttagaaacaggactaaataataaaatcagaattgtatcactattaggaagaccttagtagagttgtaattatggtacaactatatgaaaataataaattttaacttttatattaattcataataaacttgttcccctaatctcatctatgtgaagagaggagatgctagaataaataatcatcactcataaagaaatgttaaagagatgatgtaaagagcaggaaaaaagacaacattcaataactatgatacttcgcaagctaatggtaagaaaaagcttacttacatttctctgtttgatggtctatcttgtaaccaatccttcagtaaaaaaaaaacacacacacacaaaaaccttaaagacaaaaatctctagatgaagcataacggtttaactttttttcttatattttaagaatgaaaggccaaaaaactaacatacagttcttgtttcataaaacaataaatttatttattataactgtatttactgtaaatgtaactaccataagactattcaacaaggtggaataaaaaattctgttatttcccacaacattgtctttctattctttatgaatttttatattgtttgaagacaattctattctcttaaaatatatatttgtggccgggtacggtggctcacacctataatcccagcactttgggaggccgaggtgggtggatcacctgaggtcaggagttcgagaccagcctggccaatctggtgaaacctcgtctctactaaaaatacaaaaattagctgggcgtggtggcgggcgcctataatcccagctacttgggaggctgaggcaggagaatcacttgaatctgggaggtggaggttgcagtgagccaagatcgtgccattgcactccagcctaggcgacagagcgagactccatctcgaaaaaaaaaataataaatatatatatgtatatatacatatacatataaacatcaaaatacaaacagaaaaattaaaatcatgtaagctgtgaatgctcatgacatttaggcatatttcactgcagcctttgttgtgtatatgtgcatatggtttttattctgcagttgtataatgttcctaggtgtgggtttatttttacttccccagtttgagactcattctgcccgaatttgaatcttcacatattttatcattttgtaaaattctaaaccatttctaatctcttcaaattttgtctactctctcaaggccagttagatatgtcttccatgtctctttacctttaatatattttccatctgactatgtagtttatctttttttttttactttaatctgttgcattctgatccagtttagtaattttcccttcagatgtgcctaatctgttaattaactcccactgagtggggtttttttgagatggagtttcactctgaagcccaggctggagtgcagtggcgcaatctcggctcactgcaacctccacctccctggttcaggagactctcctgcttcagcctcccgagtagctgaattacaggcatgtgccaccacacccagataagttttgatttttagtagagacagggttttgtcaggttggccaggctgcttgaactcctgatctcaagtgatccacccgcttcggcctcccaaaatgctgggattacaggcatgagccactgcacacagcccccaccgagttttttttttatttctagtttttcaaatttgccagtctttttgaatagtatctccttcttttctcatgttttatatttaaaacttttttatgtccatcatcactttaaacatacttattttgtcatctataaccaataattccactatcttatcagaaatcaaataccgtttatgtaagttgactcccatgagttctaaattgccattgtgaggtcatcttcggttaggctttaatttgttgcaaagttgtgcagctcagggtcaggaagagtccctccagaaaggaggatttgttactgtgaatctctttgttaactaacctctttccccactgaaataacttttttcaataacatgattttaacaacataatctctctatgccagaacagatatattttgaatgtaagtcaatattttcttgagcaaaattatgagcactgacttatatataatacttgattataaaggagtaatttttctgccttttcctgagctttttgtcttgtcagtgtgtgcttttaaagggaatttgcaaaatcaatcattatcgcagttagctggaaatgagttcatataattagcttcaattcaaacaaaaagagattcctgcctttattctgcataaatttttctttaaaattcctgactattcactgtaagaaacttttctgtaactgctactatgctaaagtcagttttcttaagaaaaatttttttgaatttttgatatagtcccaaatatcaccactttgtagatcttatctaaaaaagtttaatgtatttaataatatatatctgtttagttgaaatctacaaaccggtattaaagctgctttggaatctacttcatgagtgtcttcggtagatggccttctactgattttttctgctaaaagaaaattaaaaaatataaaaaagctacacaactgaagttttatgaataccaactaaccaaacacaaagtattctaggcacagtataaccttcataagataactcaacctttcctcaacacgctgaacacaagagttacatgaggcccataaattattcaatttattttgagtaaactattcaatttattgtgaaaaggcaacaataaatgagagtatgaagtaaaaaaaaatttctccccctcctgttcccaatcaccctgactggggacagtaaaggtaattcatttcttgcatattcttcctgggatatttgtatgtgtatacacatacccccgccaatatttaacataaatggtagagaaacatatatgtctggagggttttgttattttaaactttaagcttagagttttgtttttttttttttgagacagagtttcactcttgttgcccaggctggagagcagtggcacaatctcagctcaccacaacctctgcctcctgagttcaagcgattctcctgcctcagcctccctagtagctggcattacaggcatgtgccaccatgcccggctaattttgttttcagtagagactgggtttctccttgttgttcaggctggtctcaaactcctgacctcaggtgatccacccgcctcaacctcccaaagtactgggattacaggtgtgagccactgcgcctagccagcttagagattttctacagaacagagaagatttcccaattatctttcgatgctctctttatttcatattggatacacattaatgtatttaaacaaactcctactgatggaaatttgatctgtttccaatctcttcctatgataaacagtgccgcaatgaataatccttttccccaatttatgataatacctttgttgtcatatcttatttatccgaaatgaactttagaattaagcctacttccaaaaaaagtcaggtcattaagttacaaatcaacttagagaaagcttacaattttacagtacaacaaaggataacctcagaatgaagaaaggaaaatctcagaacaaaatttgtattccaggtgtagaggacaaaaagaccagactgagatatattagaagactctgggcaaaatgttttcaatatgatgaaactgacagaatacattatattctgaatatcatgaagaaatctggttaaataccagagaacctagagtgttgatttaaccaaaactgtaactatacttggtggaaaagggtgaacaggtgtgtgtgtgtatgttcgttctgggaatacagagtgagaaaagagagttcaattcttgtcttctttagtggaaggtcaacagatacggcctaaaactgaaatatgaggatgctgcaatacaggtaggtttgagtatttctagtgatcacttactagaaatgcttgggatcagaagtgtttcagatttctgtttttttttttttttttaaattttggaatatttgcattatactcacccaggtgagcatctgaaaatctgaaatctgaaacgctccaatgagcatttcctttcagtcagtactcaaaaattttggatttaggagcattttagattttgggatgttcaatccatataagcatactaacttaggaataacatctatgttaacttaaatactgagaattctttttcttccctcctaatccttctaccatttctttctctttttcttttttgtttgagatggagtctcgctcccattcccattgcacaggctggagtgcagtcgcgctatcttggctcactgcaacctccatctcctgggttcaagcgattcttcttcctcagcctcccgagtagctgggattacagacgtgcgccaccacatctagctaatttttgtattttttttttttttttttttttgagacggagtctcgctctgtcgcccaggccggactgcagactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttaaccaggatggtcttgaactcctgacctcaggtgatccacctgcctcggcctcccaaagtgctaggattacaggcgtaagccacctggcccactctaccatttattttacttgctttactgctctggctagaatgtaaaacagaaacagtaacagtcaaaatccttgtcttgctccccatcttgggctttcaatagttcactatgaagtttgatgctttgtgataattttttgttgatatcctttttgagattaagaatgaatactgaatgttaaccaaatcagctgttaagatgatctcatgatttttctcctttaatctgctactatcatgcattatcacaattatatttttgaatgttaagacaacttttattcctggaataaacccaatttggtcataatatgcattgctgaattcagtatgccaaaggaaaatgaaagtgatggtgagatggacaatgtagtactatttttcttaaggaacctttataattattcaacttttcaacgatgtgcatatataatcttgacttataaaaaattatgatatggaaacatcaccacaatatagtaaatgagaaattaatggtacaaggcaacatgtattgtctgtgaccttttgtgtaaaaaatgagaggtataagattgtactgtcatacatgactgtataagcatgaaactctaaagggtagacaaatagtggtaaatgtgggaacagagtgagagagaaaattttcagagtgtgtgtattttaattttgaaccaaaaatgtatgatttttaaaagttaaactagaaaaatatgttgaataagtgatgatacagattaaaacatgatacagatgaacagatacatttgcaaaagctaaaagcagcagatttacaaaaagtttttctattccatctttacagaataaacaatttgtaaaacatattctaataaaacattctaatgaatgctaggattacgacttattcaaggttacagtcactatggcagatcagaattttcgtcttctgactcctgcaccattcactgctcatgtgtttgacaaacataaaatacatttaaagtgtaaatgagtatgttttctgacactattcatatggtcaaaatactcaccttgttttgaatgaacaggaatggaagttctgtgacagtcagtaaatccagcaagagaactcactcgtttcaaagtgttttcagaagtattgttattctgcaaatattgtgcagacatataatttgaaaataattgaactaaatttcaacccattactctaagtagtattagagtcccttgatctatttagctcaatatgctttattctacctggacaccaatgggtgtattatagattatggttattttcttcaatgccaatttcaaaagctgcaccaaaacaccttattttcctactgttcataaatccatccaaatgaattttttataataataaaaactcagactgggcatggtgactcacacctgtaatcccagcactttgggaggtcgaggcgggcggatcatgatgtcaagagatcgagaccatcttggccaacatggtgaaaccccatctctactaaaaatacaaaatcagctggttgtggtggcgcatgcctgtagtcccagctactcaggaggctgaggcaggagaatcacttgaacccgggaggcgtagggtgcagtgagccaagatcaagccactgcactccagcctgctggcagaacgagactccgtctcaagaaaaaaacaaaaacaaaagaaaacaaaaaacctcacaaaaaagttggaaaaatatacaaaactgtggagaaaaaacgcaatcattatgaattcacctcacccccaaagaagctattatcttacatgtatcttgacacactgataacattaatggtgggggaactatttccttttggggatcttggtaactttcttattgctttgtatgagctatttatacaacaaggttatctatatgctcactattttgtcagatttcaatttgtatttcaaatttcttttgactatgttttttaggtacttaaatctctacattttcccttaatatttttctattatttatgtgtttggaaagccctgaaggctttactggctcaataaatactgctttttttttttttttttttgagatggagtcttgctccatctcaaaaaaaaagttgtttaaatcaaaacacagctactgcttttctgctaactcacagaaacttgcaatgtcttgtttttatcaaggagtacctgccacttaaaaattttcagcacgttttttctttaagttcattattaaaaaggtgaaatctgtgggaaaactctgatgctttaccttttcccattaagaaatgtccatttatcctaaattttatgtcttacttctatcaagtgcttcgcaatagcaaaatgataccaccagagtgtggcaatatgacaataatttgtgtaaagaaaaagaaaatgtgatgaacttaggtttaaataattctacattataaacagctttactaaaacttatgaaagtccataaaacatttcatttacctataaaatctacttcaaccctatatggaatacagatattccatatgtcatatggcaataattataaaaccaatttggtagacagcagtctgttctttcttctttctagcactttttctcattcccgcttttcttctttctctttttatcgtgtgtcagctaaggctacctaagtgaacttgatccatttatttagctctcagtctaaatatgccataattaaaatggttagaaaacactgcaaattatagtcttatgataggtccgctgaacctacacctatttcctccatctaaaagcacatgggtatattttaagctgactttctgacttctgcatatactaaagagactttacctcatatttaggcatctctgtatactccataatcacatttcttacatcattctgctgctcctatttgaggtaagaaaattatgcaactattctcaaacttaaaggcaaatacagaaaggaaaaaacccaggtaatcattacacctcaatttgcatataataaccaattaaataccaagttatcaatatctagttaatagatattaaattaagttaattgatttagtacaatactttaatcaaaatatgataataaaaatacaaaatgttacaatataaaaatgcatttgagtctactttttatatgtagggtagtaagtaatatggcctgacagcaattacataattcacctggatcacataaaaagtaatcattcatagaaactcctacgtcattatcatttccttggttctagctttaggaaaggtcctgttttcactgtgtatgtcacttaacatttctataatgtaagttctttaagggctagagaagcttaacacctttctaggtgtttttaattatcttgttgtagccacattaccactccaaaggctctaaatagccacaagtaatatatgagagcaacatttaagaaataaaaccaactttgcaggcaagaatacaccttttttgccagctgttctacatattttgaaacttatttaacaaacatttatcaaattatcttgcacttgtacataatatacagcttctcactgctagacaataggtttctaagagtcagggtcatgttcaaataaaacttttggatctgggaagagtgagctcattaagtatttaatcagtggaaaacatatggggagaagaaatttttaaaaaagaaatgtaggccgggcacagtggctcacgcctataatcccagcaccttgggaagccgaggcaggcggatcgcttgaggtcaggaatttgaggccagcctggacaacatggtaaaacctcatctctactaaaaatacagaaattagccaggcatggtgatgcgcacctgtaatcccagctactcaagaggctgaggcaggagaatcacttgaacccgggaggtggaggttgcagtaagcggagatcacaccactgtactccagcccaggtgacagcgagactccgtctcaaaaaaaaaaaaaaaaaaaaaagagagaaatgttaaatagctgatgttttttatttagtgagtataattacgcaagctgtttgtaccttttcatgttcctcaattgttcattttttcaaactgaggacagcttcaaatatttggtatcagcatgttaatgatatctgctaaaactgtatttttgctgaaaaaatgtttaattaaattttgaactaaacatcaagacagtaaaataaatagaactgtgggtgttttaataaggatttacttacggatagtatttttatcttgtttgatgtttctttaaacctctgtaaatccatgctatctctgtgtcctttaatagaaaaaaagatgttgcaatgagaaatttttatttttcttcaccgaaataatggcactgcttaaagtttataaaaacaataggtttatgctgtttttcaagtacacttgatggctctgcagtctcctttagctcttttgataaataaaattgaaaattgccaagaagctggtgaaggttacagttttttttgttttttgtttttttaaatttgagaacaagtctcgttctgttgcccaggctggagtgcagtggtgtgaccttggctcacttcaacctctgcctcccgggttcaagcaattctcctgcctcagcctcctgagtagctgggactacaggcacgtgccaccatgcctgactaatttttgtatttttagtagagacagggtttcaccatgttagccaggctggtcttgaactcctgaactcaagatctgcctgtcttggcctcccaaagtgctgggattacaggcctgagccaccgcacctggccaagattatagttaagtttacagtaacgttaaaagccaaagtccttataaaacaaaccaacatgtgatatgaataaatagctcgaaatttaaaagaaaaaaggggaccaagcatttttactattaataaaaaaaaaagcattacatatatacggataatcactcaaaaaggaatgatttattcttatgcctataacttaaacaaaaacagaacaaaaatattttggcaataacactttaatgaccttaatgaaaactgttccacacatagagattgttcagacaacatgttaataagcccatgtataatctccacattaagaccagtctagcaagttattcaggcactgaacatgctgatacttactgctaggctatatggaattcactctagatatacagatatgtaacttttcctatataatatacatgtagagaaaatatatatgatatatacatacaccccactggtaatacattaacaaataggctaaaatgcatttttaaaaataaattggaaattagccaggtgtggtggcgtgtgcctgtaatctcagctactcaggaggctgaggcaggagaatcacttgaatctgggaggcagaggttgcagcgagccgagattgtgccactgcactcccgcctgggcgacagagggagactccgtcttttaaaaaaaaaaaaaaaagggggaatatatttaacgtaggaaaagttatatctatgtatctagagtgaatcccatatagcctagaagtaatatcaacatgtttagtgcctagataacttcctaggctggccttaatgtggcaattttccatgggcttattaacatactgtctgaataatctctatgcatgaaagttttcactaaggtctttaatgtgttactgccaaaataaacatttttttttgttcttatcttatttaagctatcataggtataagaataagtcattcctttttgaaatgttctctgtgaatatataaataggtacaccataagtactaattttcccagtagattcctagatttccattgttgttctgatataattattaatagtgcaccctttcacttttaaagtgtcttggtttgggtaaaaaaattatatggtcatctatttatagggcactgttcttttccagttgattctaacctcccctatgaggttctccaagtacttaagaatcacttaggttttcaacaagagttgatgaaacccaattgaagatattcaaattcaaaagacagaacctaaaattccatcaaagaggttatgtgccaatataactcttatagcctaattcagtctatttcccctacttctgatttttttttttttttcatttcatttctagagacagggtctcattctgtcacacaggctatggtgcagttgtgtgatcacagcccactgcagctttcagcttctgggtgcaagcagttcgcctgcctcagcctcctgagtagctgggacttcaggcacatgccactgcgcctggctacttccaaaaattttttgtagagatggggtcttgctatgttgctcaggctggtcctcaactcctgggctcaagcaatcctccccactcagcctcccaaagtaccagaatcacaggtgtctgattctttttaaaaattttataattatactctatgaaaagataatgacttgtaacagtacatatttctattatttctaaggtgaaaagtaaataatattgatatacaaatacgaatttgccaaacttacctacaaatgctccaaattctgtattatctccttctgtagctttagagcaaacagtttcttgatctttggttccagtttccaagtggcttttgcaacttggctgagatggtgtactaacaaaaaatttggttggtggggatgacagatgtggtatgctagtagatgaactgcctaatttttgatttttattaaatatttttaagagttctaccccatgtagtctctgtcgcagttctggaggggaaacagcacttgggaataaggcaccagaagaggaaccagcctctggaaaattaaattcttttctctggggtactgcaggtaagtcttgaccaaatatattacactggggatctttgtcatctttcattaaaatattacaatgaaaaggattattactttcaagatcaccttgaggaagagaggagctaagtgtatttacaacaccatgctttttccatacagaaggtcttacaggaccatcatcaataaggttttgagccaagtgtttggaaatgctcagttctcgtgtgatttcattatgaactttgctagcttccgacgctttctgggcagtgagtgtttttaatgtatctaccgtcagggctgaaagatcttgcaaatggccaatttgagaatctaatgattgtaatgatctttttatgtagttgacacgatctccaacttctttaatctgaatgcacatctgttccactctgtaggagagaaataagctttttttacaaatgtgaaaaaataatgtagaattttattttgtagcctcaaataataatgataaaaagagaaaaatttcacatgcatttaaacaagatataaaataaggtacagttatttaattatacaaggcctaccttatgtttaagaaggatccagtgctaatcttatattaaaatgcaagatttcaaaaaacgtttttgttccacaggctacttattccaattaccccacatcaaagtaacacaaaataatgtatatacagctacatatatacagaactaccattactgttactgtaactgttaccaaacaccatatgcttccagaatgtagtgaagccaacagaaaaaaagaaatgctggccaggcacagtggctcacgtctgtaatcccagaactttgggaggctgaggcgggcagatcacgaggtcaggagttcgagaccagcttggccaacatgttgaaaccctgtctctactaaaaatataaaaatcagctgggtgtggtggtgcacgccggtaatcctagctactcaggaaactgaggcaggagaatcacttgaacctgggaggcggaagttgcagtgagtggagattgtgccactgtactccagccggggcaaaagaggagactctgtctcaaaaaaataaaaataaaataaataataataataatgatgataataaaaaatgctgtaaaatagtgaggacagttttacttttctccctccaaacagtaaagaacagtaaactcttctatcttctgtaactagggtaaaaaaataagagactgaccaactgacttatatgaagtattaatagaactgaacgatctttccaatacatcatgtaaaactgtaactatgcttattgtttgacaaaataaatttaacaatgaccatgtataagaaatataacgaatagatcccattttgacatataaccgattttaactaaagggcttctgaacctttcaaaagtgacacgaattctctcttcactcccagaatgaaatttgtcatctttttcattgaaatacatttcaacacactgctcttcaaaatcatgaagtttcttttgatcttcttctgttaagaaaagttctatgggaggaaaaggagaagaaaatcaaggaagagctatcaaggtttcaactttagctcataattcttacgaattattcagggtttctaagactacatccatcatctgcactttttaaacttttactactatgcttctaaagcactagacaattatctttcttttttgcttcaccagtgtgatgtcagcagaatacaatcaggtacttcctcctcctcttctgatttccttttcctatacaacatccctccgctatctctctcatacctctccctcacgtatctactcagagaaatttaagaactaatttgaaagtccctgtaaaattttaagcataatttgacacagtatgattagtctcatgtacacagaatgtactaaaattgttattgtttacagagctgtaaaaatggtttgtagaacaacaaagaagttcggtttacattaccattttaacagaaacagagacgccattctcataacgaagtttaatgctaaatccatttttatagatatcatattgcacttaaaaattcctttatgtacaggcatatttaacaaaaatctaccataacattaatccactaagtcatttttgaataaaatcaatatatagcctttggtgtaaaaatgagaagtgataaaatgaaaacatttgccttaatatagtttacttacttggtccatcggaagtcttatctttctttcttctcttacatatgcagcaaaacagagaaactatatggctaagaatgataagtggaggaggcagaactggtttctcatgataagccataataaaatgataacgctggtacttccatacaatattggaaattgccttcacttgtaaatacacattgctagagaaataatgaataaaaataaaataaactttgttaatcatctcttaaagttttaaatactgatgatttcattgtaattctgtactaaataataattcaaaaaatatccttctgtaaacaaaactaatagcaaatgagaaactagaaaagatacaggcagtaagtataaggcaaagactaacattcagcagaaaaaaataatttaaaaaaatttaaaatattgtatgtaaatgggtaagacataagaaaatactcagacttattagtaatcaagtaagtgcaaattttaaaaaacaaaatcctggctgggcatggtggttcatgtctataatcttagcactttggaaggccaagaggcaggaggagtgcttgaggcctggagttcaagacgagcctgggcaccatagtgagaccctgtctatttaaaaacaaaaaagttagccaggcgtgatggtgtatgcctatagtcccagctactctggaggtgagacaggagggactacttgagcccagatggaagaggctacagtgagctgtgatagtgccactgcactccagcctgggcaacaggctgtctcaaaaaataaaataaaataattttatttactatcaaattggcaaccattaaaaaaaaaatactcagtgtgggccgagttgaggaaacaggcctatttagacttaagtgcaaaagccctaaaagtacatatactgaacagccctgcttttagaaaaacattctaaacaagcaagtattgctcacagatttaactacaatgtggtgtttaggagcaagaattacaatctaattgaccaatacaacatactagattgaaaaattatggtctatatcatggagtatcaggtagccattaaaaatagactggagaagaatatttgtttatctgaaataatgttcatgatgctttgcttagttataaaacagtacataaaatataaaaataggctaggcactgtggctcatgcctgtaatcccagcacttggggaagctgaagtggatggatcacatgaggccaggagtttgagtccagcccggccaacatggtgaaacctcatctctactaaaaatacaaaaaaaatcagccaggcgttgtggtgcacacctgtaatcccagctactcaagaggctgaggcatgagaatcccttgaaccctgaaaactaaggttgcagtgagccaagattgtgccactccaacctgggtgacagagggagactgtgtctcaaaaataaataaattaaataaaaatactatttctgaaaagaaaaatggtttacatatatttgcaaaaaaaatgatagaaaggtgtacacccaaatattaacagtggaattactgatgaattttctatattgaatgcgtatttgttggcaaccgaggaaaaatcccagataacgattaaatttataaagaaaactgcaggttgaaagataatcaaacttaaaatttagaactcatttgattagaaaaagcatctcctatttgtaatttttcaaatataattttagtagtttaagcctcaataaaatttttagattttaagttctataaatttccttcaaaatatgtagaattgcatattaaatcatcttataacaaacaattgaacaaaattcttacttgaaaaatgcaataagaagattaaccataatgatatactgtacaaagaggtagactgcttgaagaaatggagtcaaccacgtcccaggaccacagatttgagggataacagaatcatttgcacacactttagagagaaaaaaagaaaaaaacaaaaacaacttaaaaatagtaattcatcagtaactgctattcatgagtgtttctggttatttatttacttaaagtaagtttcgattatgtacaaatctgtttcacagattccagcaaaagcatctgggcaaggagacataggaaccccagcttaagagtgttcaaacacaaaaagatgttgtgagaaatgtgggtgctatctgttttacaactctattccagaaaagaaagtatatttaggtgttatatttacccttcgaggcagggtttaacctgacgagcactaaagagggtaaaattcctggatcaaccatatgataatatttctgtaagaaaaatgtccaaactttttttttcccctgagacggagtcttgctctgtcacccaggctggagtgcagtggcgcgatctcggctcactgcaacctccggctcctgggttaaagcaattctcctgcctcagccgcccgaatagctgggacaacaggcatgcgccaccatgcccagctaattttgcatttttagtagagaccggatttcatcatgttggccaggctggtctcgaactcctgacctcgtgatctgtcagcctcagcctcccaaagtgctgggattatacgcatgactcaactttaagagtatggttgactcatagcaaaacatatacatttaataaagaatattgagtttatcttattatgtcacaaaaatggggctgaagaaatagctaaaagtgcttctcaattataccgtgattagatttgaattccttgtttttcattacccctaactgaaaaatttctgaagccagaacatagctaattacaaacaaggaaaggaagagctttaatacccccaacagcattacaaggaataaagtaaattaggcagggcgaggattagaattaaataatgatgaattagtgataagttctagctaaatatttatagtacacttagcatttagtatttggtaatttttaaaaagtatatgcatcaatgacattcatacggttctatgattcctttaaatggttttacgggcaaattaatggtaaggtcttttcactcttaaataattttatgaatctatttccattctattcagattagtttgcggaagcaaatacccaagaaagagaatgcaggaaactaaaaaactatactcaatgctttataacaactacacaattagagtcatatcattagaaaaatagcagacagccaggcgtgatggctcacgtttgtaatcccagaactttgggaggccaaagcaggccaatcacttgaggtcaggagttcaagaccagcctggccaacatggtgaaactttgtctctacttaaaaaaacaaaaacaaaaaactagccaggcatgatggtatgcagctgtaatcccagctactccagaggctgaggcatgggaatcacttgaacctggaagacagaggttgcagtgagccaagaccacaccactgcactccagcctgggtgacacggtgagactcggtctcaaaaagaaaaaaaaaaagtagcagacaatgaaaccctggaaataacaccaaacagaagccattaaacacaaaatttgaccaggctggtaaaacaacattagtttaactaccgcccaagaacaaataatgaccacaaattttctatgtggccacccttggacctaaccacaatcctctcactacatggccaacccttgacctaatcacccataaatacgtaggaagggagtaacacagatattgggggaggtaagaatgaaggaagaagaaagaataagagtgagagagaatcaacaaaataaagattctatatctcaaatgtggaagtcagcagaatatcactgaaagctgacagcatcacttatgttcacaggttatctagtctcactgactaagacaatgtaagagtcaaaatgtgaatagtaacaaaattgaacaacaaacttaatattctaagaacagggttgaatcagtgggagttacgtcattgattatccagagaatgtactcacaagctgcaacaaaaatcttgagtatctgtcatctgtaaaactcaacatgctgtaagctttcagtattcacacaggatcattatttttgtaattaacgttgtgcttgacttctcaatatcgaatctacctgaatgatctacgctaatcatggtaatcccatcccccttgtctgtaaccattttagagataggcaggctgaagccaactcaagctaatgaaatgaaaggacaggttcaaaagggaatttctatgaaagggacattttcctctaaagagaaccatcgataaacagtgtctctttcctcctgttgctaatgacagtcttagaatcataagggaaacttatagagttggcagccggaagaaaaagaacaagtgtccttagctatgaattaaccaaccctaaagaccactagacctagctcaatattgttatgtgagttaataaatgcccttattgtgtcctaggacagtttagactagacttctaatacctgccactaaaaaaattctaaaatattttttcttccaattaatttgtatgtttcttctggagttcactaacgcctttgtgtggggcttaggttggtaatagtttgacttctgaaaatatgcaatattactataattcaatattggttttaaaacacaaaataaccaaaagataaatctgtaaatatacaattcttaccatcaatttcgtatgcataaacttcaccaaaaatcatccagtatgggtgaaaaactatatctttagcaagagtccaagatggtgcttcatgaggataaagtattgcctttctgggaacaccaaaactaagtaatacaagagccataatcactacaatgtagaacatattggccacctgttaaaaaatgaacactgttaaaatacaaggaagtttaaacactatgacaaatctttctaaaagcttctaatgttctaatagaccaaaaaaatccattaaacacaaaaaatctttgagattctttttgttcctagtgatagctttcagaagaatttcatcactatataaatcttaacatctaggagattacgtaaaaaaaaatctattaagctaagcaagtcatgggcatctttatctacataatgaattgtatcactggttcaaactgaagtgtacctatctctgtggtacgtgaagattttcaagaagtacagagacacagacagatttagggaatcaatttccacaactgccctttcctaaagcttctctgttcttataatggaagcacagactctctcttttccatgttgcctctggtaattgtactttgcccacttcacacaaaaaaagaacacttcccacccaccctgaatccatgggtgccttgtcctgggatatgaaaacttcctaggagccaaacaaaacaatctgaattattagcatgggtgttgaaaaactaaaagacaccaatgtctgggaaacaaatacttttgtaagtcatgtagtttgtaattctttaatttcaataaaattcaaaaagggcctaattgagctaaaacctagtaattcattgaaaaattattttcattgttaaattacaatgtacattttgacataattatttaaggattcaaagaattaagcagaatgctataataaaacttcacctcccatctacttatttaggtatataagttctccagcctgcactacttactgtctagcctagacaatataaaaaagtgaatatacgaccaggaacagtgactcaagcctgtaatcccagcacttcgggaggccgaggcaggtggatcacttgaggtcaggagttcgagactagcctggccaacatggtgaaaccctgtgtctactaaaaatataaaacttagccgggcgtggcggcacactcctgtaatcccagctactcaagaggctgaggcaggagaatcacttgaacccaggaggcggaggctgcagtgagccaagatcacgccactgcactccagtctgggagacagagcgagactccatcttaaaaaaaaaaaaaaaagggaatatacatataaaaaagtgaatgctttctcactctagcaatatgtaatattcattcataaataatcatctagctgaggagaaaagcctcatgcaaaagagaatacatttacaataaatctgtacattaacctactgtaaacttaaaataattgtaatgacaacttaaaataaattatgacatttccatatatttttaaaatgaatatacagtgacagcagaaatggaaagtaagatgtgaaaggtaaaggggacaataagtagtcaaggccggataaagtaattttataggggcttaagattagaaagaaaagttgtatagatagctgcgagtcttaaaatgtcaattcaaatgaagagatgagacttgatgcttcatctttaaaattctgttagatgaacaaataaattttctttttaaattaagagctggctctctgcaacttgcagaggcctaacacgctccaaaattcttaattgggtgttcttatttgcaaaatggacaaataatgccttcattgagcatttgagaacagtactgagagaatgcatgctttcaaataaacaaaatattgcaaaacaaaaagtatattaaaagattttaaaaggcaaaaaaagtattaaaacattattcatgctatttgatatattttagaatacaaatgcttgtaattaaaggaaaagccaagtcaaatattccaaatgaaacgcaaatctgtattgacgtaaactaaaattattcaaggtctatggttgatgattcatagtcatctttgcatttcacacagcttttcacataaagcctaaatgacaaccactttccttgtgcttgataggaatttaattaattaaaaatatgtgagtatcagcttgctcataaaaatgaggattcttaaagtaaaattttactgggcacggtggctcacgcctgtaatcccagcactttgggaggccgaggcaggcggatcacaaggtcaggggtgtgagaccagcctggccaatatggtgaaaccctgtctccactaaaaatacaaaaattagccgggcatggtggcgcacacctgtagtcccagctactcgggaggctgaggcagaagaatcgcttgaatccaggaggtggaggttgcagtgagcacagatcgcgccactgaactccagcctgggtgacacagcgagactccatcttaaaaaataaaataaaataaagtaaaatttttaaaaatgaggattcttataatgcatacagaatgagtgtgagaagtttagcatttaccatataattttcattagtctgctattaaaagatgtattaggttgatgcaaaagtaattgcagtttttgcaattacttttaatggcaaaaaccgcaattacttttgcactagcctataaagtgtgagggaggtttcttctttttaatcttttattgtcttcaagcttttcaaagctgtttcctctggttagaaactccctgctcagaagaaaaatcccacatattttcttttttttttttttaatgattatactttaagttctagggtaaagaaataccatttgacccagcaatcccattactgggtatatacccaaaggattataaatcatgctactataaagacacatgcacacgtatgtttactgtggcactattcacaatagcaaagacttggaaccaacccaaatgtccgtcaatgatagactggattaagaaaatgtggcacatatacaccatggaatactatgtagccataaaaaaggatgagttcatgttctttgcaggaacatggatgcagctggaaaccatcattctgagcaaactattgcaaggacagaaaaccaaacaccgcatgttctcactcacaggtgggaactgaacaacgagaacacttggacacagggtagggaacatcatacaccggggcctgtcatggggtagggggcagggggagggatagcattaggataaatacctaatgtaaatgatgagttaatgggtgcagcaaaccaacatggtgcatgtatacctatgtaaatcctacgtattttctaaactcctttgaaatgccataatctttgtgaaagccttcatgacagaattggttactagctcttctatcttcacgtaacaatttatcatatttttcaatagctacctatctgttcacatgtctatatttagagactcaattgttgagttccacgaagatctggaccatgtcttattcatctttgtagccccagcttagtttaactcttaacatgtaatagatacacaatgacgaaataatgaatgttagaactaaaacagtaaccattatgaaacttccaaaggggatgtaaagggaagctggcactagggaaaacacacaatgacggaacaaatgactagctgacaaggagaaagacatcctagcagagggtggttctagagaagatcacaaataaaggcttctgtacttcctaactcttccatttacattaccattaaagtaactagacaccactgagtcactaaataacctggtaagcataagagctacaacaccttttttgcatgctaaaatgttaggctaaaaccaattcttcccaaaaaaccttaactgccctatttttccttgaaataccataagaatgccaaaatgtgtgaataatgagtaatactttgatgtgaaaaacagtacaccagttattctcaattaagggggggaagacacattctcttggagggaaacagtgcagcgtgaaagtgcaaatataataatttatatttagaaaacctaaaaatcttgttttcaagatgcgaagataatcttgtgagcttagcagggttactcaagaaatatttaatttagaagactgatttttttttttaattattatactttaagttctagggtacatgtgcacaatgtgcaggtttgttacatatgtatacatgtgccatgttggtgtgctgcactcatttacattaggtatatctcctaatgctatccctccccctgccccccaccccatgacaggccccagcgtgtgatgttccccattccccaccgtgtgtccaagtgttctcattgttcaattcccacctatgagtgagaacatgcggtgtttggttttctgtccttgcaatagtttgctcagaatgatggtttccagcttcatccatgtccctacaaaggacatgaactcatccttttttgtggctgcacagtattccatggtgtatacgtgccgcattttcttaatccagtctatcattgatggacatttgggttggttccaagagaagactgattttctaagattaagggagtataagaaactctaagaatagctttttatatttattaaaatgggacaactattttaaaataattgagaaacagcatgtatttttaaagcatattttgataaaactactgtatatatttatttacaagaagtctgaaacaaacacatgtgttcatacacatcttgagagatggaaggatgtacgttaaactgttaatagtgaatgtctctgaatagtgatttgtctgcatttgctgaaatttcctaggatgaacaggaatttcagaataaggaatagcaatagctatattacaaattttgcctttttcaccactgaaaactaaaaggaattacggcaaggagtagacccaatatatttcagattcagtgtataaaaaaattacacattcaacttgacatctagattttaaaaaataaaacctgccactcagataagactaaggaaaagagcaaaatactgggcatactgtattaggaaaagattaggtattttgggtttaacttttaaaaaatagcctggatcaagcagggtgtggtggctcacgcctgtaatcccagcactttgggaggccaaggtgggcagatcatctgaggtcaggagtttgggaccagcctgaccaacatggtgaaaccctgtctctactaaaaatacaaaattagctgggcatggtggcacatgcctgtaatcccagctcctcgggtggctgaggcaggagaatcgctgaacctgagaggcagaggttgcagtgagccaagatagtgccattgcactccagcctgggtgacagagcgaaactctgtctcaaaaagaaaaaaaaaaaaaaaaagcctggatcagtgaagacaggaaaaaggagttacctacagacataaaccatagatggtatagctaacattatcttgcaaagcactaaatgggtataggggattgggattgagcatgagaaactcttaaggaatggcagatgtgaagtatgaggcaaacaaacacaaaataaaagacattcactggctcaaataaaactatgttaataacatttttgtgattttttaaaaaatcaataaacccacgagtattatcaaacatctgtcaacttaccatttttccaatcatcattacataaggtcctgcctgttgatttacagctagaaaatctagcaaacgcacataccaaaatattatgttaagacagtaaattaatcttccagccacaaaaacatgattatcatatgcatttgcaaagttccattttgctccaaatcttagtccaaatccaatgaagaaagaaattatggcaattgtatcactgatgttgaagtaatcactaaaccatactttaatcttctggtttactttcccagcttcagacataaagatctaaaggtttaacaacaacaaaaaaaagtgtaatcagtttattcctattaaaacacatacagcattcaactataacattacagtagaatttcacatagcttttatttattaacttatttattttgagacagagtctcgctctattgcccagggtggagtgcagtggctcaatctcggctcactgcaacctccgtctcccaggttccagagattcatccaactaagaagctgaaaattcagattacaacccagttctctagacctggattgtaaaatacttttgaaaaattgttttatttcaaattaaggcagcacctggatatcctggtagtagctgccaaacctgccttctttgtagaaagtaaataactcaatggtttaagtagctgtatttacctaactaatttaaaacatatgcctcttctcctgaatatatgaattttaagaatcatcttttgggaggaatggtaacacattcacaacttcaaaattcatggtgtatcataaatactgcaaagcatccgtttcactcttctcccttagccaattaattactcttcccactagaagcaaccactactattactgtctcatgaacacttgcagagctattttatgaatatacatattttaaaacgctttgcaatttgcttttatcatttaacaaatcaatttcttcaaacatgctgataaaacaacagatttaataaacatatggatcataacactcagaggaatttaaaatgcaaaataagctatctaataagaaattccttctggttcgagttggtgtttggaaaagaaaaaaaaaagaaattcttatgatatctaagtgagagagaagtacaacaccttctaattatttttgcaatttcttgtattctctaaatgtaaggtagagacatgaaataattcagaggtacttatgcaagtatgttataaaacaatattcatggccaggtgcggtggctcacgcctacaatcctagcacttcgggagacaaaggcgggcggatcatgaggtcaggagttcaagaccagcctcaccaacatggcgaaaccacatctctactaaaaatacaaaaattagccaggcttggtggcacgcacctgtaatcccagctactagtgagggtgaggcaggagaatcgcttgaacccgggaggcagtggttgcagtgagctgagattgtgccactgcactccagcctgggtcacagagggagactacgtctcaaaacaaacaaacaaacaaacaaacaaaacccaatattcatgtagctactacttcaaaaacaaagtataaatattacgaaaaagattttcttcaaaatcaggatattaaaaaagacctaactattttatttttattttgagatagagtatcactctttcgcccaggctggagtgcagtggtgcaatctcagttcactgcaacctctgcctcctgggttcaagtgattctcctgcctcagtcttccaagtagctgggattacaggtggccgccaccatgcctagctaatttttatatttttagtagagatggggtttcaccctgttggccagactggtcttgaactcctgacctcgagtgatccgcccgcctcagcctcctaaggtgctgccattacaggcgtgagccaccgcgcctggcctaaagacctatttataacttacctacctaattggctaaatcaggtaggtaaattaaaagtcatttagctaagtatatttaatactttttgaagagtgacagagagcaaaaatgtgaatgttcaggaaataaaacaaacaaacaaaatacaggttacatttttataggctacatttctaacacaaatcattttatctgtaatggcaacaaagtatacagcatactcactaatctctattcttttgccattattttgggaacagcaaaattacacaggttctacacttctacaatgtcatcatacacacacacacccccctacgtatacacccaaaacaaaacaaaacagaaaatcttccatgtatacagtaaattattggtagaaaaaaactaaagacatacctcacggactttctcaatggcataagtaaaaatataagcaataacaatccattcttgaactgaaggtaactgttccatttgtacaagaaccacaaatgtataaagcatcagaaatcctaaatatgccaactaatgaaaaagtaaaggttacataaataacattggttacaaaataaatcttttaattatgaacattttcaaacacacacaaaaacagacattaaatgaacctctgtaaattatctcctagtttcctttattaaaacaattttagaaatatctcttcttcagcacagacattgcatttattggtgtataaatggtccccagagtataaacgtgttgttctacaactcttgtcaacctttagaacgtcccacagaagggattttacaatcaggtttatgttctcagcatatgccacacaattctgcttaactcatacctacagtatcataatatattaaaattactgcagaatttcaccaccataatcatcaaggaacacatgtttcctgcctccttcctccccaaaccaaacagtattcctaaaaaagacaactggggcacgccgcggtggctcacgcctgtaatcccagaactttgggaagccaatgcaggcagatcatctgaggtcaggggttcgaaactagcctggccaacagggtgaaactccatctctactgaaaaaaaaaaaaaaaaaaaattagccagacgtggtggtgcatgcctgcaattccagccactcgggaggctgaggcacaagaattgcttgaacctgggaggtgcaggttgcagtgagctgagatcatgccattgtactctagcctgggcaacagagcgagactctgtcaaaaaaaaaaaaaaaaaagaaagaaagaaagaaaagaaaagaaaaaaagacaagacaagacagacagacaactggtattttcttagctcccagtcactaaagttgaaccccaaaaagtggaaaaaatgtgaagtggctttgacccaggtaaggaaacagcccacctttgatactctttacaaaacaggttacagagaggtgctaaagtttatgtataaatacatgtgagtatttatttcatttcagaggaaaacccacacttattgacccttgaaaaattatgggtaagaatcctctcatctgtcttttatttatttctagacttttatgtcttgtctccaccagtcctagaataagtcacatcctttatttgattatctgtggcaggctagggagtaaactgcagtaaagaaagaaaagagaaattcctgtagtcacccatgttggctattttaacgcagccattcacatgaatgcaaatgtaagcaaactgccctattttcatcagtggagacagaatttggagattagatcagataactgatatttgcaattccagcctctgaataggaaggaacaagaacattttcatatagaggtgtaaggaaatgttagtctcaggttaatggtcacatgtgtgggtgaaaaagcaatcaccaaagaaacaaattcttgttgatgaaaatgaaaaaatctccccaacaacaaagttaaaaaacatcttcattaagggttttcctatgacggggagttaagaactcatttactcagtccctggttaaaagtaggggctaatctcatttgctgtatcacctgttccttcaggttggtccattgctagggaaagtagcaccagcaagacagccaactaatatttcctagtgctcattctccacacaaaacaaccaaaacaacacataaacacctacatttcaaccaaaataacaggtgagtccatccttgtatggacatatgctctttaacctgctagtaaaatcaatttttccataaagcaagagaaaagccaattatatggaaggtaatcaagcatacactttaatacaattaaagaaataagccacagataaataaaaccatataaacaatctggattactttttatcatcatcaattaacactgcaaacaggtttatttctagacttttatgtatcatctgcaaaatcctaaagcacaaaaaattataactgtgtatcagaatctcttttggtccatcttttatcattatttttactagttgattagtatttgctaccaacttacaaaggccaatggtattgtatatttgttaagtacatttttggttccaattagaactaaaatttgttagtgtttatcactctagatgatgacaatttaaatgaaactaaggcaaatgtatcactcttttaaatgtgaaatgccttttcagtgatctaagttatatcaacattagtatggattccgaaccaatggtcccccaaagcctaactcttaaaaacattatgcttgtgtaatttaaaaacataccgtgttaaaccagaattttacaattggtgcatgataaaaggcataaaactttcgcgtaattggaagcttttttgatttcatttgtatctccatctcattctttccttcattactatccaaaatccgtacttctttaaacacttcctaaaattaaaaaaaaaaaaattcttttgtacaattattcagaacaaacttatatttactttaaaatgttttcctgcttaccatggggatctcttctgttatgttctgaaagttgttttcgctgtcatccattgtcatctgatgagcatcttgagattgtgggatatgggacatttcagccttagttttatactctaacagcaatatggcaggtggaactaaaatgcttagtatgacctaaatttttagaaacataattttgcatttaaaaattaatgaccttcaagaatataataaaaacaaaacaaagaataaaaacaataaaagattttaaatatcttgtgattagccattttgcccctagcagtagagggaaaaaaaacaacaaattgattttttacttatatattgtatttaaagaggcccaagtttaactgttttaaagagtaacaaaacatttgattattatgataataagggtataggatagatttaataattattatagacttgtcctttaaataaaatcagattacaatttgttcaaaaaatacattttgtttaaacaaaattcaagccttataaaggtgctatgtccttaattttatcctaaatctctttgcaagtgttccatgtcataatgtgattactcagcttgtgcctctataaacaaaaaggtttatttctaaaattttacttattacttgcaaaatcccaaagcatgaagaaattgtaattgtgtaacaggttttctgttggttattcagtggcctatggttaaactatttgcctgatttctgactcctacatttctgcaccttattttaaaagatataagataacaaaaagcaaagttcaaagcagtatctatcaccatgacaaaaccaaaggtacatgccattttacccaaatttttaatcataaaaacaggccacatggatatacttatctataatgggtatatcaatatactcatccaatatactttaagtaacttaaaagtaacagattattaaattagtagataggtcttgaatttcagaatttgggaataatcttttcataaagtagtaacttttttcaaggctgctaggggccataatctccaatatttgccatttgttccccttctagctcaaagagaggccataatcattatagacacctgaaaaggattcaaaagttaagtagaggaaaaaagaagcccattataccacttgggatgaaatgccaatcatccatcttgctccctctttaccccccaccattacactcacacatcaaggcattttactacacatttagactaattcttctgttctttttatctaatcacatgctttatatcaaattatttctaaagtataccttgtaccaggaatttttcctcatattcagccttcccatccacatatcagataacaacatttgtgtacaggtgtgagctacaaaaggtctaagtcttgaagaaactgctaacttaaggcaggttgaattactccagttcttcagttcataagtgagcaatttcatagccatggtttcatcttgtctgaaggactgttctaataattcaacggccaactgaccaaaatcactataaaaagataaaagccaaaatatactcagattaacaaactgcaattttaaaccactattcttatatacattaatacttcctactttttaatattctcacacacacttacagaattatgaggcattaaaaccataactctgttttcagacatctacatctatgtggaaatcacaaaatattaaaatatgtcgcattatgtacaagattgagaaggtgaatccagagcacattctcccggtcctagaaatcaaactataatctcaaagggaatcaaaactcacaatgctacaatgctctgttcaaaaaagtttatgtagtatttcaaacacagaaaacagttggtacctggtagagaggaaaaacaatgtgactagggactaacctaattatgaaaaacatctgaatcttgaagtcccactaagtaaccataggatccctgttaaagagttattttcagtaacaattatcactgccctctaaataccccacttggggagccggaggtcttagtatatattagaaaacttctacaaactacttttccagtttaatattccaacactgcccctctaagtaaattgtaaacttttatgaactatgtcgttactctgtgtatgtagttctagcttctgaagtgccttcccagttgaattcagtctattttcttataacacagctccaacttcacttccaccctttccttaccaattcaaatggaactttctaatccaattgctactatttgcaaaaattaaaatgaattctggcatttcttctttgtttcgagacagggtctattgctgtcacctaggctggagtgcaatggcatgatcacagctcactgcagccttaacctcccaggctcaagtgatccttccacctcagcctcctgagtagctgggaccacagacaagtaccaccacacccagttaatttttaaatttcatgtagagacggggtctgcctatgttgcccaggctgcatttcttctttcttgctgagatatttaattcttgagttgcaaatataataacctctttttcatagaggcagaaagtttcttttaattaaaaaaatatatacttatataattttctgtcaattgtaccaataagattatacatataaatacatcaccattaagtacgtggcactgtaacagccactcaaacaatacctactttgaatttttaaaatgttttcaaatgataaaataccacttacttggaatactgttttagttcttctgaagtatcatctaccaggtcactctgctttgcttcatatgccattgaacgatagatcttacaggcaactaatgctttagccattgattcttcaccatgttgccataaaaaacgggccatgacctgcctcttcataaggcaagcccaaattaaaagttcattaagtggataaggaaagcgcttggtttctggatcatcaatgtctacaatttcatctttggttcttttcttctttccttcttccataactgtatcaatcttccagggaaaataaagttataaagctcattataataaggccatatgaaatttatgtcagtgaaaattttagtaaaatatctttacattattcagctccataaaactgcacaatagcataaattttataaacttgatttttattatagctcataattcattttatgaaaatgctgtttcaacaaaaatgcctttgcaataaacattttccaaaatttaagggcctaaatatttcaactaatattctaatagaacataattttaataaagggttagataacatttttgttatacatgttcttaatcaagtaaaactggaatgaaaggagtcaggtaaacatttattaaaacattttaatttggttattatcatacctaaatatgaaaatgtacgctgggcgcggtggcccacgcctgtaatcccagcagtttgggaggctgaggaggatggatcacgaggtcaagagatcgagaccatactggccaacatggtgaaacccagtctctactaaaaatacaaaaaattagccagtgtagtgctgggtgcctgtagtctcagctactcgggaggctgaggcaggagaatcactcgaacctgggaggtggaggttgcagtgagccaaaattgtgccactacactccagcctggtgacagagcaagactcctgtctcaaaaaaaaaaaaaaaaaaaaaaaggaacagaatcattaacttataattaatatctctgtgtgtgagaaaatgacaattctaggacatatccaaaaacgaaaggtaattcttactaaatcaattagttttttttgtttaataatactaagtaatttagaaagaagaaaataaaaacccagaaagaataatatttaaataaatttacctttggtcggtagggctgtgctgtcttaatgaaatggttatgcctcattttttcctttttatctgccctattgccaaaagattcatgactctttcgcaactgaggagtgctgctggaggtatttcggccagacctctgaaaatgagatcttattagcttttatagatttaaacgtgctgacatgttataaaaattcaagaatcaatttatatatgtgtgcaaatgtgtttgtgtacacacacaaaatatgactgatttaggattttgacgacataatatttctaattgctcttagttgaaaatgttcaactttatgacagtgtaaccttctccgttctaatgttaattcttaacaattaaagtgcatgtgttaatattaaagcatatatatagatttccccacaaattttacatacccgattatttccaccaagactattatatattaatcgaaaacgtttcctagtataggtgcatctgtaggttcctcccatgagatattcaataacaagtcctatatcaatcagagtgatcttatatcctggaggaagatttccctagaaacaaaacatttgttttaaatagatcagatagcacttctcaatattgccatgccctgcctaggaacaggcctactctccaaaatgacaaatgtttacttcttataagaagcaagggccaggtgcagtggctcacgcctgtaatcccaacattttgggaggccaaggcgggtgcatcacctgaggtcgagtttgagatcagcctgaccaacatgatgaaaccccttctctactaaaaatacaaaaaaattagccaggcaagctagtagatgcctgtagtcccagctactcaagaggctgaggcaggagaattgcttgaacttgggaggcggaagttgcagtgagccaagatcgtgccactgcactccagcctgggagacagagcaagacttggtctcaaaaaaaaaaaaaaaaaaaaaaaaaagcagcagcaagggttgccagcagctaagctatctttacagaaggaaatgcttgtttctctatttcctctgtaaaaatatgggattctaaagttctgaggtctcaaaggtgtgccctgagacaggagtatgacctaaagcaggaagataacaatttcatctcttcattgccccaacactttacacatgagacaaagcaggctgggcgctgtggctcaggcctgtaatcccagcactttgggaagccgaggcaggcagatcacctgaggttgggagttcgagaccagcctggccaacatggagaaaccccgtctctactaaaaaaatataaaattagatgggcatggtggcaggcacctgtaatcccagctacttgggaggctgaggtaggaaaatggcgggaggcagaggttgcagtgagccgagatagtgccaccgcattccagcctgagcgacaagagcgagactttgtctcaaaaaaaaaaaaaaaaaaaaaaaaaaagagacagtggaaatgctaatcagccaaatattccattttcattgtgatacatacaaaaaattgcatttttctggaaaaataatgctgtattatgtttccagactggcccagaaatacatgttaagtatttttttaaccaaaattatactggtaatattataggtttttatagtgttgtccaggaattaactaccgcttgcaacattgtttaaagataagacttcattttcccatggcaatttacaaatgcacttttggaacatacaccatttgtgagtttggaaagattgcctgttttaaaatttaaaaactggttaattttattaaataatcttaaagggatttaatcatcagataatttgtattttttaactaattctgccctcctaccatcaccatttttttatttccctgattatgtcatgaacttgttttttttaatgtctgtatttttactatcttggtttcactgggcacggtggctcacctgaggtcaggagtttgagactatcctagccaacatggagaatccccatctctactaaaaatacaaaaattagctgggtgtggtggagggcacctgtaatcccagctactcagaaggctgaggcagaagaatcgcttgaacccaggatgcggaagttgcagtgagccaagttcacaccattgcactctagcatgggcaacaaaggcgaaactccgtctcaaaaaaatatatatatattggtttcatctgtgaaatttctaatttctagataactatatcctttaaatctctaatttgaaaataaatcaaaatacctatttccatcttgaatacaagatttttggttttaactcaagcaatctcaaaatatgcagaatgattgagaatgtcacctatgatattcttcaatattatttattaaaaaccacaaatgccattatatgaacccacttgaagaagaaatttttaaattaggtaaaataatgtgaattatctaacaaatgtcatgacgatcaagttctcaaactacactaagtcataaaactcaagttaccaatttgaataaaaatattcaattactacctgtatttaaagatttatcacttatagaaataaaaaaaatagggcttattattatagccaccgatgtaacaacaatgtatacaaattctcacatttgtttccaaaattttaactaccataattctttcttagaaacatggtcttaacgtctcccccattacttaagatttctaggggaaggagggggaattttaattatttaaaaagaccaaatcaaattgatgtgaaatgaccagaataagcaaatcattagattaatagttaccataggtcggggacagaagtggggagtacagaaggagaagaaatgagaagtgactgctaaagggtacagggtaacttttcgaagtattataaatgctctaaagttagactgtggcaatggttgtacaactctgaatatagtaaagtcaaaaaatgtatgctttttttttttttagacaaagggtcttgctctgttgtccaggctggagtgcaatggcacaatctcagcttgctgcaacctccgcttcccaggtccaagcaattcttctgcctcagcctcctaagtagctgggactacaggcacatgccaccacacctggcaaatttttgtatttttagtagagacagggtttcactattttggctaggctgttcttgaactattgacctcaagccactgggtctggccaatatacactttaaatgaatgaattttgtaatttgtgaaatgtatttcaataaagctataaagaaaagcacatgcaggctgggcgtaatggctcatgcctgtaatcccagcaatttgggaggcgaggtgggtggatcacctgaggtcaggggtttgaggccagcctggccaacatgatgaaaccccatctctaccaaaaaaataaataaataaataaataaataaataaataaataaataaataaataaaataaattagccaggcatggtggtgtgcgcctgtagtcccagctactcgggaggctgataggagaattgcttgaacctgagaggcagtgggtgcagttagccaaaatcgcgccaactgcactacaacctgggcaacagaccaagactccatctcaaaaaaaaaaaaaacaaatcagtcaggcttggtggcaggcacctgcaatcccagctactcgggaggctgaggcaggagaatcacttcaacccaggaggcagaggttgcagtgagccgagatcgtgccaccacactccagcctgggcaagaaagggcaaaacttcatttcaaaaaaaaaaattttaagtataaaatgtctcggttcttcctataggatagtagtttagtattaaatcagttacaaaataaagaaaatgaaaacagaaaatcacatttttaaaaaacatcctcaaggctgttaaaatgacatttctaacgtcattcttttttcttaagaagggtcttgatgtgtacccagactggagtacagtggctcgatgacagctcactgcagcctcaactcctgggctcaagtgatcctccctcagtgccccccacacccccaccaatcatttggactacaggcacgtgacaacatgccgggctaatttttaaatttttttgtagagaaaaggtctcgctttgtttgcccaggctggtctcaaaccccttctctctggcgatccactcacctcagactaccaaagtgctggtattacgggtatgagccaccagccctggccttctatgtttttaataatgcactcatacttagcagcaagtaaaagctgaaataaataaataattctaaacaaaatttaagtttagaaacttagaagatattttaaccaaataaatataaatactattttatcaaggaaaacaaaactgtattgaataccaataatataaatggctataaaagtggtgataaacgtttaaaacttttagttcacaaacaatcctgatagaagaggaataacagtacatcaatttagtggccacagaatagcctgagatcatgacagtgttatgcgttcatcaccaccaatactagatgttttttacttttaaaaaagttaaaaatgctcacgcctgtaatcccagcactttgggaggccaaggagggcagatcacgaggtcaggagatcgagaccatcctggctaacatggtgaaaccccgtctctactaaaaatacaaaaaattagccaggcgtggtggcaggtgcctgtagtcccagctacttgggaggctgaggcaagagaatggtgtgaacctgggaggtggagcttgcagtgagccaagatcacgccactgcactccagcctgggcgacagagcaagattccgtctcaataaataaataaataaataaataaataaataaataaataaataaacgtatgttaaaatgatttatatatatttagggggtacaagtatagatttcttacacgcatatgttatgtagcggtgaagactaggcttttagtgtacctattatctgaacagtgaatagtgtacccacaggtagttgttcaaccctcaccacccccacccaacctcccaccttttgtaaagtctccaatgtctatcattccactctatgtccataggtacccattgtctagctccaacttgtaagtgaaaacgtggtatttgactaagttatttcacttaggataatcaacctccagttccattcacactgctgcaaaggacatgatttcattcttttgtgtggctaagtagaaatactagatttttttttaaaggggagagagttttcagcatttttactggcaaagtctgccattaagatcatgacccagtcctcaatttccttattcaacatcctttacattgggacaattttctgaggaataaatttctgctgaagatagaggaaaaaagatacattctatcaacagtctttcttttatgaaccaatgagctttatacatcatattctatcttggatgaccagaagctcaacagcttttttttctttttttttttttttgagacagagtctcactctgtcacccaggctggaatgcagtggcaagatcatggctcatggcagcctctacctcctggcctcaagtgatcctcccacctcagcctcccgagtagctggtactacaggtgtgcaccaccatgcccaggtaatttttttaacttttcgtagcgatgggatttcagcatgctgcccaggctggtcttgaactcctgggctcaagcaatctgccagcctcaacctgccgaaatgctgggattacaggtttgagccacccatgcccagccttggtcttaattccataaactctctttttttcttgttttctgatacattatgctctttactcctctcttaccacaaattcagcccatattttatcttgttctgtaaactgtaattttattggtatttctaaaatgtatttaaatgattttttttttaaaaaacatgaaatataaatgattttttaaaataacatttttcaaaagcaaaaaataatctcttacctgtttgacgtctcgaacaagatgaaacagcattggattagttggaccttgtttctttagggagaaaaagttacagcaaactattatttttcttctaaactaatttaaaccttacaggatttttatgaaccttcttatacaaattacattgttttggagttatttccttaagttctattcataaagtagaacaacaaagaattttcacatttactgccaaaaaacaaataatcttaagagtatcactaaaatgatacataagtttttgtttcacaaaagtcatcactgcaactttacaattgtatcttaaatttaaatttacatttctttcattgataatggcgctgtacaatacctttcttcttgttaaaatgtctgttcctctgtttctgtcactaataaagtcatattgagactttaaatattttgggtaacaagactttaacacaagcttgttcaacctgtaacccacgggctgcatgcagcccaagatggctttgaatatggcccaagacaaatttgtaaactttcttaaaacatagagtttttttttcaatttttttcaatttttttttttttaagctcatcagctatcgttagtgttagtgtattttatgtgtggcccaagacaatttttcttccaatgtggcccaggaaagccaaaagattggacatccctgatttaacatttatatatgccataattttgccattatcttacttctctttatatatactgttagagtgggccacctaccattatttctttggagaaaaagttattttctttgatattcttggctttcaaattctatataatatttaagatgactacaattgatattgcatatgaatcatattttactttactttgctctgccttctttttacaatatttatttagggctgggcgcggtggctcaagcctataatcccagcactttgggaggcagaagcgggtggatcacctgaggtcaggagttcgagaccagcctgaccaacacgcagaaaccccgtctctactaaaaaaacacaaaattagccgggtgtggtggcacatgcctttaattccaggtactcgggaggctgaggtagaagaatcgcttgaacccgggaggcggaggttgcggtaagccgagatcgcgtcattgcactccagtctcagcaacaagagtgaaactccatcccccaaaaaagtaaaaaatttaaaaaattccatcctggctaacacggtgaaaccccgtctctactaaaaatacaaaaaattagccgggcatggtggcgggcgcctgtagtcccagctactcgggaggctgaggcaggagaatgccgtgaacccctgggggcggagcctgcagtgagccaagatcgcgccactgcactccagcctgggcaacagcgagactccgtctcaaaaaaaaaaaaaaaaaaaaaaaaacctatttatttagtcgatcaactcaggggctaagttctctctgccaattctcccccacaggtgaactttttaaaataaaagtttcttctaagttaataagacgtatctcatattttgggggtattggggaatttcattgcatttttctctaacggtatgtaatcacatggaaaggcacttaaaatttcttaaattctattttatcctactctattaaatgtttatccattaaaaataaattgttaataaataataaatgtactttaacacagtaattctcaaagtgtgacctggggacacctgaggcccccatgattccttcaggagttccacaagatcaagacttttttcctaatcatattaaaattgtattatttcattcttattctctcagtgtttggtggagttttccagaggctttttgatgtgtgatattgtgagattgaattcagaagcaaatacgagaatccagctgcttttataaggctagactttaaagacatttgcaaacgtgttttcctcttctcaccaatttttttgttttctttaaaaataaaaacatagcaggctgggtgcggtggctcatgcttgtaatcccagcactttgggaggtcgaggcagtggatcaccttaggtcaggagttcaagaccaacctggccaacacggtgaaacctcatcactactaaaaatacagaaattagctgggcgtggtggtgggcatctataatcccagcaacttgggaggctgaggcaggagaatcgcttgaacctgggaggtggaggtcgcattgagccaagattgtgccactgctctccagcctggatgacaagagcaaaactgcgtctcaaaaaaacaaaacaaaacaaaaaaaaagtatcaggcagaagggtgctaatttaagaaaaaagaaataagaacaaatatttatgttaatatgggataagtttagaaattttaagtaaatataactgctactttaataaaaacaaatattttttaaaactctcatttttacattctaaaataccaacacacacaaacaaaacctctttagaaaagctctttgaagttctcaataattttaatgtaaaggaaccctgaaaatcaaaaagtttgagaactactgctttatcatgttgcaagcccttaaatgttttaaaacttcatcaataattgatgctgaaagtaactacagtattatcttaacacctttgagtcatacaatttaaaaaattacttgtcttgctaatgggatcaatttttatttttattattttacattgctttatagttcaggtataaaccttactacagcacaatgaataatccttttaatttttacatctgtccactagggacagtaaaatgccaacaaagttcaacgcaaatgtgctacacatactaaaagaaaataatggaagctgggcccagtggctcacgcctgtaatcccagaactttgggaggctgaggcaggcggatcatctgaagtcgggagttcaagaccagcctggccaacatggcgaaaccccatctccactaaaaatacaaaaattagctgggcatggtggcatgcacctgtaatcccagctactcaggaggctgaggcaggaaaattgcttgaacccggaaggcagaggttgcagtgagcccagatcgtgccactgcgctccagcttgggcaacagagtgagattctttctcaaaaaaagaaaaaaaagggagaaaatgagatataatacctacttcaaagaaatttacaatccaaagggaaagacataataattgtacttaactatgccaccaagcttcatggaaccagtggcatggcatttaagctaagtcctaagcaattaataaaatttcaataaatgggttattagttggaagcaaaacagaccagcactgtgaaaatagcaaatgcttttttttaaaaaagtttgcatttttggccgggtgcagtggctcacgcctgtaatcccagtgctttgggaggctgaggcgggcagatcacgaggtcaagagatcaagaccatcctggccaacatggtgaaaccccgactctactaaaaacacaaaaattagctgggtgcagtggcacacgcctgtagtcccagctacctgggaggctgaggcaggagaatcacttgaaccagggaggcggaggctgcagtgagcaaagatggcaccactgcactccagcctggtgacagagcgagattctgtcaaaaaaaaaaaaaagaaagaaaaaagtttgtatttttagtaaatagtaggtagacatttaccatcttattgctgccccgccccctccccgccccgccctggatttggggggcaataaaaaggccaagtgagaaaagtagatggggcaatatatgaagatctttgaaaatcaagttaaggatttgggtagtaaactcatattcataacacagaaaaccactaagaagggtagtatatcttcaatgctaatacaataaaaatttggaataaaatgtgaaagtctttgttacgagaatagtaagttttcaggagtcctttacaaaaaaaatgaaaacagtatgtaagctaaaaggggtataccatgaggtcaaacaatgaatgtaaaaaaagaaaaaaaaaaagagaaaaaagcaatgcataattcctccattagacaacggagtcaaaagaaacataatcaccctataattaagaagttgatcctctagttttgataaggggagggaaagggaaatacacaggaaagagaggtaggcttaatagccctatgtggttatggtgacagggaatgggttctaaaaacaaggaaagggtttcagactgtaatacaaccaatccatactaagactggctataattttttcatataactaaggaagacattaagggttttatcaataggaatggctatattcaggtaaagtaacatttcccaaaagataaaatgtagtcaataaagaattttaatgtagacttacagtgttgtaaagttcttccagtctcggaatggtaaggaatttatgcatgcttactccattttcaataagaagttttacaaatgcaactctatccattacaagagcatcaagcatagcttgttccaaggatccaacctaggagtatcaaatttaataaatacatatttcacatattctaattatacaaacacttttaaatgttaagtccttaggatttacatttaatttgttcccaacagttttagaacaaaattagaaagatgcaacacagtaaaaagctaataagactttaggtgtttagggaatagattaaaagacctctctagaacaacgtttcttaaagaatattccacaaacactacttctgtaggagaataagtgttacatgggggaaaaaacagaatccatcatcaattaaatcttgggaaagaataccttaaagcaatgctctcagtgtttagggaaggttttgtgggaaggattatttcaataattgagtgctgttactaacatttaatgggtagggtcaagggacatcagaaatcatgcaatatgctggagaattctactcagaaagaaactatcccgcatcccacacaactttttattatcctgttagatgtttatgactgaaaaaccagtaattctgccttacaaatgaacacaaagtatttcatcatagtttttgttctacagtgaattttccaaaaatacaaccatcagataagtcaggcaagattgtacttagtcttcagaactttaaaagaaatcattcatcattatggaaaagaaatcacttgacagcaatacaacttatgtcctttgtgcttaatataacacatctgtatcattcagcatttgtagctgtcctttatatattaaagcctattttataaacttcaacagacttgaaatcaaatattggtaaattagtagggacatgaaatataggtatttcactgagttttattaataaaggttgttttaatatagtctgtatattttttaatattttgtatatttctgtgtattttaagtattttagtaccacattattaaaaacatctctgtggcaaaaatcaatacaaaaccactggtttttttacccattatttttcaatcttattctatcttcagaggtttaacacacaactacacaacttctctagagcaacttgtattaccatttctttctccaatctatcttcgatttacatcacctagcaaggatatagtcttcatgatattttaagtatatactttctgtttttttgagacggggtctcattctgtcacccagtggcacaatcatagctcactgcagcctcaaactcaggggttcaagggatgttcccacctcagcctcccacgtagctaagaactacaggtgtgtacccctgacccctgtacctgccttttttctttttctttatttttaaaatagggacaggtctcaaactcctggcctcaagtgatcttcctaactcagcctcccacagtactggaattagaggcatgagccaccacacccagtcctattttaagtatatactgatgaaatgtatgccttttacatgatggaatttaaagatgaaaggtatgttttctgtgacatttttcaatactcagttctgtcacaacaaggaaaatatttttcacttgcttaaaaataaggcctgatctccaagaaaataatacttattagttttctctacattattaggctgtagtttatcatggcatcgtactattttacttaagattatttccttctttctcttatcacatacaaataatcctaatgttattacttactctaacagtaatattctaacattattctagtgcccacttggtctttctttgtcctacacttgcaaagggtgtttatctgttccccaggatatttaagttaccaacaacatacttgtattagtatgtataactgcagcatttacactgattcttattataactgcaggcatctgacttattatgtgttttatattgccactcttgaacatttatatactgaaatatttattttttattataaatcattttttctgtcttattacaattagggcattatacatatattcttaatttatgtaattacttatgaaatttcactttagtagaataaaaggggatataacaaaatattgtttttaaaacaagaacattctgtgtttataaccactgccctagaacaaaatcttaattttcatatctgagggggaaaaagggaccattttaaaaaaaagtgtctgttttgtaaggagcatttcctcacactcaatgcatattgaactcctggcaagcaagaagaaagaagaaaaacaactgtcctgcaaattctaagtttagcaagaagcacaaaatcaaataggtaacactatgcagaagaaattcatcagacaaaccacatatacacagaagataaatgcttcatccaagcctttacatctgagaacaaaatccagttaaattattcaagggaaaaataaggttggttatagtcatcaccacagatgattaacattaatttttttcctctgtagtcctgcaagaggagaagtgactaaataaactcttttttattgctatataggaaatacattcccatggttaaaaaaaaaaaaatcaaacactacaaaatggtataaaataaaactttccttcagcccccatctctccaagatgaatcccatgttaacagttttagaaaggtactattaactacacagtacatgtagatatgcatgaatgtttgtacattcataaggagaatttgccacaattaagatcatactgtgcatacttttctgcaatttgctgtttatatttactatgtggacaaaaaggatctagtttgtcctccgtaaaggctggtaatacttcaaggtacagatgaacagttaatctgcccagcctcttattaattcggacatgtaacaaaactttaagtgattactacctaccaagctgtcaatacagtagtaaacaaaactgaaaaatattcttgccctcagaaagtttactttctaggagaaagacaaacaataaataatagctacattatatggtttgtcagatggtgacaaaagttagaaaaaaatagcagggaagaatgctggtttagggggatgctattaaaatagggtagacagaggaagtccaaagaggagacatttggttagaggccagaaagataggaggaattaagcccacgtgggtatgtagggaaaaatgttaagatagagagacaggcaagtacaaagcctagagataggagcatgcttgatatgttcaaagaagagcaagaacgtcaacaaggttagataaaaaagagcaaagaggatagtagtagcatgtaaggctctgggttatgctctgaataaatggaatgtgattcatctcctgtccataaaaggagagcaagtatgagagtagtgaaaccaaaaagtatgctaccgaaataacacaaaagaaggatgacagactagaccaggatgataaaattaggtattttgaaactagatctgacaagatttacagatggaattggattggaatacatgagaaagagaaaagtaaaggataacactaaagagtctcatcttagaaactaggaagaagttgttcccatttagtaggatgaggaagactaaaaaaggaataggtctaaacatcagggggaatgctagaatggactctctggtatacagagcatgagttttaaagcttctttcagttctaagattcttagagatctatatactctacaaaaaaataaggttttatctagaggcatacattaaatcctaaactggatcggaatggtgtagaaatacttagctaaactatttttgaactattggcagaaaggtaaaatgtcaagtcaggtcacagttcccgcaaatacttttttattacttagtgtaatttaattgtattgtgtatgtagattatttacataccagccactgctgtccataaacaaatacatgatttttggcaatgtcaactctatcccatgccaatgtaaggataagctggtcaaatgcagatgcattagtacctaatcgaataaagaaaatagttgacaggttcaattaatttatctccattaaaaggtgaacactttttttttttttaagagatggggtcttggtctgttgctcaggctaaagtgcaaaggtgatcatggctcactgcagccttgaattcctgggttcaagtgtacctcccgccttagcctccaagtagccgagactacagatgagcaccaccacacccagctaattttttaacttttttgtagagacagtctcactctgctgaccaggctggtctcaaactcccggcctcaagtgatcctgccacttcggcctcccagtgtgctaggattacaagtgtgagccacagtgcccagcacgaacacttatgacatctccccaccattctttagttaacttacacagctggtgtcagccaccattcagaagtagcctgcctcagagataagattagccccagggttaagaactttacctttccagctataaacgacatattcccattcattgcaaacatttagaaatgcagaaaaatgagaagaaaacaaagatgaactgtttctatcacagagatagcgctattaggattctgaaaatagcctgccaggcacctttctgtgcacatacaagctcatgcatatactttccattttttattcaaaaatgggttcatactacaaaagtgttcagtagcttgctttatgtaccttgatatcgtaccttggttcttcttaaaattatacataaatctcccttatatatacttaggtaaaccacaatttatttaacaaatacttcaaatggtagatattcaggttattttgaattttttgctgagtatgttttcatgcacatgcttgattattcaaataggatgatattctagaagtcaaattgctaggtacaaggatatatactttaaggtttttgatatactccaaaatacttcagattgcttctaccatccaccatgggaggggtataaccataaccatttctccatgtgccatggagaggggagtttccttcttcttctcttttctgagaccgagtctctccctgttgtccaggctggagtgcagtggcgtggtcttggttcactgcaacctctgcctcctgggctcaactgatcctcccacctcagcctctcaagtagctgggaccactggtgtatggcaccacaccaggctaagttttgtattttttgtagagatagggttttgccaaattgcccagactgatctcaaactcctgggctcaagcaatctgcttgcctcagcctcccaaaatttattactgtaacattggccatccttccatattttctctaagcatttggattcctctactaattatctattacataagttctgacccatttttctaagaggtagtcatctttttcttattaatttttaacagctctttttgatccctctactttaacatttctattccttagtttcctcatctataaaatgagtaaagccataggaaatctgacttgtaggaataaaatgagataaataatgtaaaccacttgaacacagtggttaatacacagaaaagtacatggtaaataattcatgaatatggtactctctttttaacctttttttttttttttttttttggagacagtttcactctgtcacccaggctgtagtgcagtggtgtgatcctggctcactgcaacctctgccttccgggttcaagcaattcttgtgcctcagcctccagagtagccgggactacaggcatccaccaccacccccagctaatttttgtattgttagtagagacgaggtttcgccatgttggccaggctgatcttgaactcctgacctcaagtgatccacccgccttagcctcccaaattgctgggattacaggtgtgagccagcgcacgcagccttactttttatttttatgcactcccatttattaattttttttcctttttggtttctaggtttcctatcacttgtgatctcttgataccatgattccagatgatataaatatattttatcacagtattttaaaaatgcttgatgtattggcaatttattatggtctaatatgcaagaaaattcttgtaaataaaaggacagtatcctcttaatgtgctgggctcctggcacatcactctacactaactttcaggtagacagatgggataccgtcatagtttctaatttctgagaagatttttcgctataatgttgttatatctgttggatgtctttggggagacaataagaggatcagtgtgtgtgtgcttcaatcccttagtcctaaaagataccactagttttcaaattttcccttcataatgaagatgacatgttttaaaatcctatctttatattctatcaactaatgccttataacctttaaacacttatttttcagctgattaagaaagtgacacatttttatttggagacagggtcttgctgtcacccaggctggagtgtagcagtgtgataatggctcactgtaacctcaaaccctgggctcaagcaatcctcccgcctcagcctcctgaacagctgggactacagagtgcacaccaccatgcccagctaatttttctttgttgtgagatagggtcttgctctgttgcccaaactggaatacagcggcatgatcacagctcactgcagcctcaactttccaggatcaggtgattccacctcagcctcccaagtagctgggactacaggtaaatgccaccatgcccaggtaatttttaaactttttgtagagatgggtctatcttgtccaggctggtcttgaactcctggcctcaagtgatcctcctgctttggctcccaaagtgttgggattacaggtgtgagccaccatgcctggcccaggatgttagacgttcttaataggactattaaataggtttggtggcataaaccttgctaaaaacttttattttttaaattctacaagattaaattaaaagttaccttgccgccaaggaaaccaacattgtgtctttcacaaagaaaaatgactgaaaattcactttgcaagcatttagccatggtaaaaggttttatattttatatacatacacatatacacacatacacacacatatacatacataaaataaaaggtcttacaaataaaaaagttcttagaggcttaccttttagcagtgcagtaagtattgctacatctatatcttgatgttcatctgacccaatatggaaaacagtgatctatttaaagataaatttataacattatgcctttatatttttaaaacaaaggcatcataaaactcagtaatttcaaactatatggggggcaaaatatatatgtatgtatctaggaatctatgtattatgtatatataaacatacatacacataatatatttatgtatatagttagtaactttatttcaaccaaaaaaccaaaaaattttaaaaactttatcatttactaaataaaatggcaaatatactaaaaatatttggtttcatattacattcatattttgacctatcttatgtcccttactagagtaagaaatttaggggctgaggctatagattccttatcagggtaaataaatcctacaggtccttccacagaatgaacatttacatgttcacataatgtatatattcttgaaagataaatgtttgttttggtcaatatttttattgcaaatatctttaaatcacttgaaacatagcaccatttcagaaattgtaatttaataacatttttcataaagtgaaagatggccaggcccatggctcatgcttgtaatcccagcaatttgggaggccaaggtgggcggatcacgtgaggttaggagttcgagaccagcctggccaacacagtgaaacaccgcctctagtcaaaatacaaaaattagccaggcatggtggcgtatgcctgtagtcgggaggctgaggtgggagaatcgcttgcacccgggagacagaggttgcagtgagctgagattgcaccacggcactccagcttgagcaatggagcgagactctgtctccaaaaaaaaaaataaataaaaataaagaaaagaacgtgaaacattattatacaaaatttttggccaactttatttcatagtttacaaaaacttgcaatgaaaaagacagcaaatcaaatcatgttatgtatttataggcttgctaaaaattttatctctgaaaacttatgcccacatttacatgattgaaacaaagcagcactgatctttaatttaataggcttaagcacattaaaaatttttttccaaacattttattagagaaaccattaacaactctttatagttcttccttggtactgaacattatctgttgagacctagttacttttcctaaaacttttcctaaaacagaagcacaaatacagtctcaataccatataaaaaactacaggcctccttctatgatacctctcaacttgaacagaccaataaatgacatatttttatggttaataaagatttcaaagtttaaaatccaaataaaaacaaaagtatttcaccagtttagaatgtgttttgaatgaaagaaaaatggcctatcagctttttaaatttctgctgaaatctacttacaagctcctttcttttcatgcactccatcagtgtttgaaataaatgaagtgcttcattctggccaaagttaaatgtttttttgatagtggaaataatatcgggctctgctgcatcaggaagattcctggaataaaaggaaacataattcactgatttcatcttccattatttgtaggatcaatatgaagtacaggtagatccatgtaagacctttgaaaataatggattaatattacatacttcaccttgggtgggattatttcttcctacatgagactcccaacacaaatgttagaaggaaaataaatgaaacggagtgatttttctctttgaattactttgtgaattttatcaaaaagtatgtgtgtggcaatatcagtacttacataagatattgtataaaaataatttgaagatcttatgatgtataaactagtatttcaccacgatgttcttaaacataggaactcacatttttcttttttgaatacttaatacattttcatggctcaaaaatagtagaaaacataaaatgttaaaacattaaaattaatagtgaaagtctccttcccgctctctttcatctgcccagttctatcacaactatttttaggaatcatttacttatatataactttccaagatgtctttctgcatatacaaataattatcccctctccttttattctatataaaaagtggcacaatatatatgcttctctacaccttcctttttgcatgtacatattttggtaatcttctcaaaaccattcttactcagctataaaccatttctttgtataaatacaccataacttatctagtcttctcatgttctactttgttccaatcttttataaagaaccccgtaatgagtagctttaaacatatattatttcacagatatacatctgtaggaacaattcccagaaatgaaactactacgttaaaagataagtgcctctacgtttgacacatcttacaaaactgtgttccatgaagatggttttattttaatttgttccaataacatatgagtcaggctatttcctcaacccttaacaaagtattgtattaaacttaacattttcatgttcataaaacacagggaggaatccaacactgtattctaaaaaccacaagccactttaataaattcattaaaatgggccaggcatggtggctcatgcctgtaatcccagcactttgggaggctgaggcaggtggatcacttgaggtcaggagttcaagactagcctgcccaacacagtgaaaccccatctctactaaaaagatacaaaaattagccagacgtggtggctcatgcatgtaatcccagctaattgggaggctgaggcaggaaaatcgcttgaacctgggaggtggaggttgtagtaagccaagattgcaccactgcacgctatccaggctgggagacacagcaagactccgtatcaaaaataaataaataaataaataaataaaattaattaaaatgttgtcatacacttaccctccttcttctgtttgtttatgaatatacgctagcagatctgcagctctgcctgttccttcacacacaactactggaacaggggggctttcctgaaggtattcaagaactgtgaggataacatttggcccaccctcaaatataagtgccaccacagggacaccctggccaatccctaaaaagagcaaagttaaattaaaaaattatttcatcccaagcaagtttctctccaagaaaaaaaaattaggcaaaattcagtactctaattttagattttactgaaaaaaaattaaaaagtaaaaacataatttctaagactatgttgacttgactttaagcactccacctgataccagttcacgtaagtaaattaaataatgaatactttgtcactatcttaaaagctgttctctaaatgacaaaattagaaaatccaatatataatagacagcaaataatttatatattcactacttaaaagtaaaaatttgttttccatattttactgagctcttgacgtgaaatgtaaacagtaattttttagtttgctttacaatacattagttgaacttctaacattgatttttattcatttttaaaatatatatttctgattccaaatgagacattaaaatagaaattaatgacagtcttggccgggcgtggtggctcatgcctgtaatcccagcactttcggagaccaagatggacggatcacaaggtcaggagatcaagaccatcctggctaacacagtgaaaccctgtctctactgaaaatacaaaaaattaaccaggtgtggtggcaagcacctgtagtcccagctactcaggagggctgaggcaggagaatcacctgaacccaggaggcagaggttgcagtgagccaagatcatgccactgcactccagcctggtgacagagcgagactccctcacataaaaaaaaaaaaaaaaaaaaaaaaaaagactgtctcaaatgccacctgaaaggtttgtaaaaaagaaaaaagaaatggctcacgcctgtaatcccagcactttgagaggccaagtcgggcagatcacgaggtcaggagatcgagaccttcctggctaacatggtgaaaccccgtctctactaaaaatacaaaaaagtagccgggcatggtggcatgcgcctgcagtcccagctactcgggaggctgaggcaggagaattacttgaacccgggaggcgaaagttgcagtgagctgagatcgtgccactgcactccagcctgagcaacagagcaagactccatctcccaaaaaaaaaaaaaaaaaaaaaaaaaaagaggacggctgggtatggtggctcatgcctgtaattgcagtacttcaggaggccgaggccggcgatcacgaggtcaggagatcaaaagcagcctggccaacatagtgaaacctcctatctaccaaaaatacaaaaaattagctggggcgtggtggcgagtgcctgtaatcctagctactcgggaggctgagggatgagaatcgcttgaacccaggaggcagaggttgcagcgaggtgagatcgggccactgcacaacagccagggcgacagtgcgagactccatctcaaaaaaagaaaaaaaaaattaaaaattaaagaagaaattgatgacagaattacataactggaactgatcaataaaattccaagacctctagaagagcaacaacagataaaattagtgaagaatatgaatttttgcttttacaataacttgcggtgcacagagaaaatggaaaaaaaaaaggtatctgtaggactataaacaattcttaactttttttttttttttgcaatggagtcttgctctgtcaaccaggctgaaatgcagtgacgcgatcttggctcacctcactgcagcctccgcctcctgggctcaaacaattctcctgtctcagcctcccaagaagctgggactacaagcacacgccaccacgctcggctaatttttgtatttttaggagagacagggtttcaccatactggtcagtctggtctagaattcctgacctcaggtgatccacccacctcggcctcccaaagtgctgcgattataggcatgagccagcacgcccagcccattcttaacttttagcaaaagttctgactccaccataatctgtaaacactgttctgtagtttttttatttctatttcactttaccacagagctcaacttcctggggtccttaggttacaaattttcctttatttgaaataaaaatttagatgttgaaccagaaaattcagacatggttggaaagaaaaatcagtcccaggaatacaatttttaagacacatttagccaaacagtgatactcatttcataaattttaagctgatttatttctttcagtgatttttttcccttttagttttcaatcttgaatttcacagccatgtattagaataaatcacacattaagaatatttatgggtcaggcgcagtggctcacgcctgtaatcccagctctttgggaggccgagacgggcagatcatgaagtcaggaaattgagatcatcctggctaacatggtgaaaccctgtctctactaaaaatacaaattagctgggcatggtagcgggcacctgtagtcctagctactcaggaggctgaggcagaagaatggtgtgaacccaggaggcagggcttgcagtgagccgagatcatgccactgcactccagcctgggtgacagagcgagactccgcctcaaagaaaaaaaaaaaaaaagaatatttatgaattccttgggctgaaatggaattgcaataacaacagagcttccaatgaaccttttttggttttagccttgataactgagtacccaattttcacttcttttccttggtcttatcattttgtctaagatcaaccactgttggttgtttcatatgttatcttgctatgtaagaaagagcacttcaaagaacattctactttctttgaatttggctattagtacagcccaggacaatttcaacaataacaaatttgtgaattcacttactagcatgaattctttgctgattaatagttttttcaagttctcttctcagtctgacttccgccccatactttccaacagtgccatcatccaccaatatgaaatgggaatgcagattattcaaaacattcaatttgctcagggggttcaataaggtttgataaggagcaaccacctaaacaatagcaaacaaaagagttagtgagcaggattaaatacagtatgatgtaaaataaattttgaaataatccgtaaagacaagtaagaagtaaaattctattttacatacagaaataaataccaaatgacaaagaatgtttcaaaaagcgtaagcttttaagcagctgaggattaatcattaatgggttgaaacacatgattatatcttgacccatactgcagaattatatatttcatcatcacatgcaaagagagaagcaataaataactaaatagtgcaaataaactattatcagattattaagtgactaaactacaatatataaaagatattgtggccaggcacagtggctcatgcatgtgatcccgtcactttgggaggccgaggcgagtggattacctgaggtcaggagttcaagaccagcctggccaacatggtgaaaccccatctctactaaaactacaaaaattagatgggaggccgggcgcggtggctcacgcctgtaatcccagcactttgggaggccgaggcgggcggatcatgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaaaaaaaaaaaattagatgggtgtagtggtgggtgcctgtaatcctagctattcaggaggctgaggcaggagaatcacttgaacctgggaggaggaggttgcagtgagaccagatcgtgctactgcactccagcctgggcgacaagagtgaaactccatttcaaaaaaaaaagacactgtaaaaaacaataaaatgtaatattgctatttttccagccatgagtagactcaaaaactgacattagaaatttaataacacttgaaagtgatcattataattcagtaattgtatgtatgtatgtatgtatgtatgtatgagatggagttttgctttgtcacctaggctggaatgcagtggctcaatttcagctcactgcaacctctgccttccagtttcaagcaattctcccgcctcagcctcccaagtagctaggaggcacaggccactacacccagttaatttttgtatttttagtagagacggggtttcaccatgttggccaggctggtcgtgaactcctgatctccagtgatcagcccgcctcagcctccaaagtgctgggattacaggtgtgagccactgcgcccagccagtaattctttttaacagtgttgataaatatctataaccaattcacatgtctttaacctattcaaacaaaacactagcatttaactcctattccctagtcttagtgagaataaaattaattctcatgtcatgtagtcattaaaaatttaattacaaagactagcttatatggaaaatgtgaaataattttacacataaaagactgaaagcaaaatgtgccaacactgtaacagcatttatatttatgaacttaattatttatagttatgaattatttatatttatgcatttccaaaaattcagaagtaaacctcaggaaaataccttttaaacttaatttgaaaagtataatataatcataaatattttaaactggcactattcttactataattttgtttacatataatttcaaacataagaaattttaaaaataattcttacatctctcccaacaagatcatttctgttttcaatcactccccatggagctattccgatagtgcaaatctttcgagatgatctggaagcatgttctttgagggcatctccaacatgttttgccacacctgttcataaaaaaagtttattcattttgttttttttattttcttaaagacagggtcacccaggaaagagagcagtggcgcaatgacagctcactgcagcctcaaactcctggactcaagcgatcctcccttgtgagcctccccagtaggtgggactacaggtgcgtgctaagacagccggctaattttttttttttttttttcagtagagacaggtgggtcttgaactcttgggctcatgcctcagcctcccaaagttctgggattacagtcattactgtgttcagaacaatcctgtgctaaatctgtaacactataatatgtgatatatttctccacaccttcaagatataaggcaacaaggtcataacaaacttaaaacaaggtcatagccaaacctacagaagaatacacaaggaccaaaaaggaacaaaaaccactaaaccccacaatatcaaatcactacaaatgccagaaaacacatataacactaaattttaccatgttatttggtctagtccgtttttgcatttctcctctaagtaactgtagttttttattattgctctacacatcatttagaaaaaattaatcggtggcacaggaccatacgcaaaacacacacacacacaataaacaatgacaaaagtctatttcagtcaaaaatgagagagaaaagtataaaaggcagttccaaagagcatataactcctcattatcacttcttttttttgagggagggagtcagggtctcactctattgcccaggctggagtgcagtggtgtgatcatggcttagctcactgcagccttgacctcccgggctcaagtgatcctcccacctcagcctcccaagtagctaggagggtaggcacataccaccatgccggggtaatttttttttctttttttttttttttttagaaagtgtcttaccatgttgcccaggctagttttgaactcctgggctcaagtgatcctcccacctcagcctcccaaagtgctgggattataggcatgaaccaccatgcctggcccattattacttcttatgggctgaattgtgtcccctaactcccaataccataaaatatgactgcagttggagacagggcctttatatatgtgataataccttaaaacattactgtacttggaggcagggcctttaaatatgtgacgattaatttaaaataaggcctctggagtggccctgaatctaactggtgctcttataaagaaatctgaatacaaaaggaaacaccaaggatacctatacacaggaggccatgagagggaggacacagtgtgaagatgaccatgtgcaagccaaagagagaggccccaagataaaccaaatctgctgacacttactcttagacttttaatctcggaaaccatgagaaaataaatttctgtttttaagccacccagtctgtgatatttggttacagcagccccggcaaactaatgcatcactcagtttgatctccataatgcatcacatctcatccctcacccaaattatgaaaatagcatcttcgtaggtctttcaactgctgccttgccattatactccattttgaaaacatcatccgagtgatctttgcagctgttgactctctacttaaaacctcctcttctcattcagagcagaagccaaaatgcttataacggtccccaaggcctcatgcgatgaactgcctactgcctctactagtcaccatgcttctctaccaccatacaccagaacttctgacttcatcacctagcactctctgcttattccactcaagctatattagactgttcttactattcttccaacacacgagccatctcctcccctttacatgctttgccttatgtttttcttgtaccttgcttcctcatttccatttctcctcaactgtcaccttatcagctctccttgaccatgtaacaaaatagcagcccttccatcatccctcactatccctcttcttgacttcatgtgtctgcataacacttatcagcatctaacacgttatacattactgagttatctgtttcttatctttatctcccccactagaagttccatgaaggtagatatttttactgtttatggaataaattcttagcagcctcaaaaacttctgacacaatgaggttcaaaaaatagctgctggccaggtgcagtggctcacacctgtaaccccagtactttgggaggcctaggcgggcggatcacctgaggtcagaagttcaagaccagcttgaccaacatagtgaaaccccatctctagtaaaaatacaaaacttagccacgtgtggtgacgggcacctgtaatcccagctacttgggaggctgacacatgagaatcacttgaacccgggaggtggaggttgcagtgagctgagatggcaccactgcactccagcctgggtgacagcaagactctgtctcaaaaaaaaaaaaaaaaaagttgctgataatgaattagatgtttgcaagctgacttaaatgttttattttagacaatgaaagtaatctgccctctttatattcaacctgtatatgtgatagggaagatatagaataaaagacagtagtatgttacaaattaatttttgaaagctacttcttactgctgctgaggcaatggattgccattcttgtatcaatttaccactagaaggaaagtgatggaaataatgctttgctctacagtagggtcaaaaacctttttctaaaaggctaaacagtataagctttatagggtataccatctctgtcacaactattcacctctgctgttacagcacaaaaatagccatagacaatatataaactgatatggttaagctttgcatccccactcaaatctgatcttgaattgtaatccctataatccccaggttttacgggagagaccaggtggaagtaactgaatcatgggggcggtttccccaatgctgttctggtgatagtgactgagttctcccaagatctgatggctttataaggggctcttccctcttcgcgtggcacttctccttcctgccactttgtgtaagaaggtgccttgcttccccttcaccttccaccatgattataaatttcctgaggctccctagtcatgctgaactgtgggtcaattaaacctctttcctttataaattaccaagtctcgggcagttctttatagcagtatgaaaacagactaatacagtaaataagtgaatgttccagtaaatctttattcaaggtttgggctggatttggcacacaggctatagtttgccaaatcctgctctaaagtgttgcgttttttttttaaagacaaaataataaccaaacaggttcgattatcatttttacctacaaactgtagattatttatcaagagttaagtatatctatattcagtgttgatctgtatttcaaatatctaattgctattataaaaaaatttaagggccgggcgtggtggctaatgcctgtaatcccagcattttgggaggataattttgcggatcacgaggtcagcagttcgagaccagcctgaccaatatggtgaaacctcgtctctactaaaaatacaaaaattaaccgggcatggtggcgcaggcctgtaatcccagctactctggaggctgaggcaggagaattgcttgagcccgggaggcagaggttgcagtgagccgagattgtgccattgcactccagcctggcaacagagtgagagtccgtctcaaaaaaaaaaattaaaacacactaaataaaattggtataatcatcacattacctgtgtttactcctccagttaaaatccaggctccagttgtaactgcagctttaataagaccttttccaagcaactgcttgattcgtgggtgaagctcaaatttctgcatgcccccatgtacagagataacaagtttgggtaactccatttgccattctttaagcagaagttgcagaatgacttcaggtttggtgtcatatgatagcctcacatactagaaaaagattttaaaaggagaaaataattgaacatgttcacaggtttcataatgtgacattatatgactttggaaaattttatatgaatcagattatgtaaaaagagatttcataggctattttcaatatatttatactccaaggaataagcaatagtaaatgattttaaagttgaaaaaatcattctgtgagatctacagaaatagcgaaactaacttttaaacatttagacacaaatgttactctttctgtttaaactcaattaccattgacccaatttacccaagtacctgcagtatttattgccttctttaactatgactacacagtgagttagaaacattaagactggctgaagaggatcggaaaaggaaaaaaaaggaattaggggggaaaaatatggaggcttctaaggctcttgctatgaagagaggcaaatactgaattatttgtatgaaagtttggcaatgatctagtccatttataaatgaattgtgactatggagtaaaatttaaaaagatatatttaatatagatgattattttcttcactgtaaataactggatttgatcagactgagaaataatcagaaaatcgtaatcaacatttcatggtgttcggatggattctccagtttaatttttgaaaacatctttctatagaaaaatagaaaaaaaagctatcgtgtgtgaaataacttcttctggtttgaaagattttaaaaattaacttcctgtttaagtgatatcataagacttacttgctatactcacattaattcattctcttggcctaaagcacatatatgaagtagctcataagaaacttcaagtattcagacattgagacatttaaaaatcatctctaagaaaccttatttgcaaaatgatgtatttcccattcctttacaaagatcaaacactactgaaaatctcagtactgacaaacaaatgaagccaaaaggccaggcacagtggctcacgcctgtaatcccagcactgtgggaggccaaggcaagtggatcacctgaggtcaagcgttcgaggccagcctgaccaacatggtgaaaccccgtctctactaaatacaaaaaaattagctaggcgtgagtgcttgtaatcccagctacttgggaggctgaggcaagagaattgcttgaacccaggaggcagaggttccagggagctgagactgtgccattgcactccaggctgggcaacaagagcgaaactgcgtctcaaaaaaaaaaaaaaaaaaaaaaaaagaaatgaagcccaaaaaaccccagaattccataaaactgagtagaagactggagtcccttaagaatactttggtttttggttttgttttgttttttttagacacggtcaggctctgttgcccaggctggagtgcagtggcgccaccacggctcactgcagcctctgcctcccaggctcaagccatcctcccacctcagcctcccaagcagctgggactacagacacagggcaccctgcgtagctaattttttaaatattttttgtagacacaaggtttcaccatgttgcccaggctggtcttgaactcttgggctcaagtgatctgcccacctcagcctcccaaagtgctgggattacagacacacggcacccagcatggttaatttttttgtatttttggtagacacaaggtttcaccatgttgcccaggctggtcttgaactcccgggctcaagtgatctgcctgcctcggcctcccaaagtgctgggattataggcatgagctaccacaccagaccaagaatgctttgtaaataggatttgttcttttttttttgacaaagtcccgctctgtcgcccaggctggaatgcctcccgggttcaagagattctcctgcctcagcctcctaagcagagtagctgggattataggtgcgcaccaccaggcccagctactttttgtatttttagtagagacagggttttgccatgttggtcaggctggtcttgaactcctgacctcaggtgatccatctgccttggcttcccaaagttctgggattacaggcataagccaccgtgcccagccggatttgttctataataagtctttctgtatcagttttgtttaactcattattatatttgggcacataaagtagtattagagaagcagtctaaagttaatgtttttaatactatattagagataaatgagaaattccacttcctacaatgatgggctaggttgatttggacatactctgcccctgggaactagaaaaactagaaaaaagaacaataacacctgcttgaatacattagcaggtggccgggcatggtggctcacacctgtaatcccagcactttgggaggcggaggcggaggcaggtggatcacttgaggtcaagagttccagaccagcctggccaacatggtgaaaccctgtctgtaatcccagctactcgggaggctgaagcaggagaatcgcttgaacccaggaggcagaggttgcagtgagctgagatcgcgccactgcactccagcctgggcaacagagcgagtctcaaaaaaaaaaaaaaaagacattagcagggtacaaaggcagtgagaatttgtaggatcgggatccaggagaaaagaaaaacttggagagatgatgagctcactgttgggcaaggttttcctcatcagaacacggaggcaggcagaacaatgtagaggttaaaatggtttttgctgttgttatttgtttttcaggcaaggtctggctctgttgcccaggctagactttggtgacatggtccaaggctcactgcagcctcaacttctcaggctcaactgatcctcctgcttcaggctcccaagtagctgggactacaggcgtgtatcagcatgcccagctaatatttttgaattttagtacagacaaggtctcactatgttgcccaggctggtctcaaactcctgaactcaagtgatcctcctgcctaggcctccaaaagtgctgagattacaggcatgagctaccatgccaaggttaaaatgttcaaatctaaataaataataactgttttaggggtttaaaacagaaaattaaaattcatgctgacaagagcacataagtcttaagagaaataagtgcagtttcaaatattccaaaggttcctgcattgttgaaaaagtggtaaaggattaatttacagtacagtcatgtgccacacattttgattaatgatgaactgcatacataaggtggttccctaatattataataccatacttctgtacctttttcttgtttatatatatttagacacatatttcccattgtgttacactgttacacctgcctaccatatttagtacaataacatgccatagaggtttacagcctaaaagcaataggctataccatatagcctaggcatatagtaggctataccatctaggtctgaatacactctacggtgttagcatgatgaaattgcctaacacatctctgagaacatatccccattcttaagtgatgcatgactgcatataacaagttaaaaatgcattttatcacattatcacatttattatagtattctttttctttttttgagacagtcttgctctgtcacccaggctggagtgcagtggcgcgatctcggttcactgcaaccttcacctcccaagtttaggtgattatcctgcttcagcctcccaagtagctgggactacaggctcgtgccaccacgcccgactaatttttgtatttttagtagagacagggtttcactatgttggccaggctgatctcaaactcctgatctcaggtgatccacccaccttggattcccaaagtgctgggattacaggcgtgagccaccgtgcctgacctataatattctttttctaaagaacagaaaaacaggccgggcacagtggctcaggcctgtaatcccagcactttaggaggccgaggcgggcagatcatgaggtcaggagatggagaccatcctggctaacacaatgaaaccctgtctctactaaaaatacaaaaaattagctgggcatggtggcacacacttgtagtcccagctactctggaggctgaggcaggagaactgcttgaacccaggaggccggaggttgcagtgagccgagattgcgccaccgcactccagcctgggcaacagagacaccatctcaaaaaaaaaagaatagaaaaagaacatatagtaggccttctgtatctgtgggatccacgtttatggtttcaaccaacggtgaatcaaatatattcaagaaaaaacattgagcctatactaaacatgtgtagactttatttacctgtcattattccttaacagtgcaatttaacaactatttacattgtattgggcattttattaatatttttattttaagtagagacagagtctcactattttgcccaggctggtctccaactcctagcctcaagccatccttccaccctctcaaaagtgttgggatgataggcgtgagccactgtgcctggcctatattagatattataaggaatctagagatgatttaaactatacaagagggtgtgcatagattacatccaaatactattgataatctgtagactttggtatctgagggaagtcctgaaaccaagccccctgaaggatgactgtataaataatatgctaataaaggagtaagaaaataataaaaaatatttaatccaaaataatacaagaaaaaaaacagaacaaagaaaaaagtgagacaaatagataactaataacataatggtaaatttaaacttaaatacacagcagacaacatttttaaaaacaattaaaagacatctcttaaacataaaaggttaaaaccgaaaaggaagaaagatggcttaactacactgattgcagaaaaagcaaaccatgtcaagaaaaatgacaagaaacaaaacacattttataatgatgaaaggttcaatccaccagaaagatacaattctatatttgtatgcacctttgtactttaaaatatacaaataaattactgagaccaactttttgtcaatattgctacacaaattgtgatgtttattatttaaataacaacataaatgaagaaaaatccaatatgtgacataccttagctctgtaggaatgagaacccccttgaaaatttatgactccataagcatccgttgggctctgttctgtatgcttttccacagaccattcttctattgcctgattaaaatggtcacccaatttcacatctgagtatttcatggcaagacttgcagtaaaacaagcatgttgcttgaccaagcgaccacaaaaacacctaaaagaaaaaggtgagattaaaacacccttcaaaaaattagagttaatgaaaaaatggaattaaaagtgaatgaaccgacaaatataagctttaaaatttttatattttatataagtataaaaataagctttttgattttaggatatctatatattaataccttcatcatagcactgaaatagtataattagtctaagatgaattcatcatctaaatttaacatgaggcatctacaaaacatggcataggcatataacagaaatagtatttacaccggctgtggctcacgcgggtaatcccaacactgtgggaggccatggctggaggaccttgaggtcaaaagttcaagaccatcctaagaaacacagcaagaccctgacttgacaaaaaattttaaaaaattaggcaagtgtggtggcatacacctgtagtcccagctacacaggagactaaggtgggaggcttggttgagcccgtcagggctgcagttagccttggtcacaccactgtgctccatcctggacgacagaacaagcaagaccccaactcaaaaaaaaaaaaaagaaagaaagaaagaaaaaatactatccaataataaagagaagtgaatgaaccactaataatactacagaatggataaatctcaaaatcatcatactgagtgaaagaacctagacaccaatgattatatatttgtatgattccacgtatacaaaattcaagaaaccgtgaactaatctatatagtgacaaaagggtgatcaatggtgtctgaggctggggtacaaagacagatggctttctacccagaagcacatactggactataacaccataagtaggaacctagtggagctgggcagtctcattgatttgatataatcttaaaaatcagatgagagtttgaggaagccaaggcagctagagtttgtgaggtagaaaacaaaaagaggagggagctacaacgagaaagttccaagtatctgcagaagggtctccttaagcatgtggaagaataactacttggccaggtacagtggctcacacctgtaatcccagcactttgggaggccgagacgggcagattacctgaggtcaggagttcgataccatcctggccaacatggtgaaccgtctctactaaaaatacaaaaaattagctgggcatggtggcgcgtgcctgtaatcccagctactcaggaggctgaggcaggagaatcacttgaacctgggaggcgcagaccacagtgagcagagattgggccactgcactccagcctgggtgaaagagtgagactttgtctcaaaaaaaaaaaaaaaaaaaaaaaaaaaaagaataactacttaaggcaaagttaaaagctactggacagcaatagccgaaacaatttctgaagctcataaagggcagggaacactttatgttcccaccagccagagtagagatctcataacacacaaggcttatgacagggtcctcaaaaaaagtatcattaaattagaaggactaaattagacctagacagaccaggcacggtggctcatgcctataatcccagcaccttgggaagccaaggtggatggatcacctgaggtcaggagctctagaccagcctgaccaatatggtgaaactctgtctctcctaaaaatataaaaattaactaggcatggtggcgtacgcttgtagtcccagcttctcaggaggctgaggcaggagaatcgcttgaacctgggaggcagaggttgtggtgagccgagatcgtgccactgcactccaggatgggcaacacagcaagactgggtctcaaaaaaaacaaaaaaaaacaaaaaaatcagacctagacagcccatgccctgacaaagtttaagagcaagacctgaaaggatcaaactgatccaaagtaatctaattgcatgctatagcaagtctaaaactcgctagtggaatacaacaaatgccagtaaccaaaaacataaaattcactattgtcagcatgcatgaaaaattcccagacattggccgggcgtggtagctcacacatgtaatcctagtatttttgaaaatggagaccggcagtttgcttgagcccaggagtttagaccagcccgggcaacatggtgaaccccatctctacaaaacatacaaacgttagtcgggcgtggtgatgcacgcctgtagtccaagctacttgggaagctgagatgggaggactgcttgagcccaggaggcagaggttgcagtcaactgatatggtgccactgcactccagcctgggtgacacagagagaccctgtctcaaaaaagtaaataaataaaaatttcaaagaatactgaggcatgcaaagaagcagaaaactatcaataaaataaaatcactaaatgaagaccagaaaagaacgagatgatggaattatcagaaaatgacacaaaaacaagtattataaatgagctccaactattaagaccatgcttgacgccgggtgtggtggctcacgcctgtaatcccagcactttgggaagccgaggcgggtggatcacgaggtcaggagatcgagaccatcctggctaacacagtgaaaccccgtctgtaataaaaataaaaaaaatttaaagaaagaccatgcttgttgggcacggtggctcatgcctataatcccagcactttgggaggccgaggcaggtggattgcttaagcccaggaattcaatattagcctggcaacatagtaagactctgtctctaaacgaaaaaattaaagaaaaaattaaagaaaagaagactgtgggaaaagaatatgagcatgatgaagaccaacatggtgaaaccccatctctactaaaaatataaaaaataagctgggcgtcgtggcagtcgcctgtaatcccagctactcgggaggctgaggcagaattacttgaacccaggaggtgggggttgcagtgagctgagatcgcgccactgcacatccagcctggcgacggagcaagattccttctcaaaataaataaatacaataaataaataaaataataattttctaaataaaggttttaaaaatttcatttaaaaaataacctaaacttctaccttaaaaactaaaaataacagcaaattaaactcaaagtaagcagaagaaaagatatgataaagaaaacagaatgggccgggtgcggtggctcatgcctgtaatcccagcacttcagggggccgaggcgggtggaccacttgaggtcaggagttcgagaccagcctggccaacatggtgaaatcctgtctctactaaaaatacaaaacttcaccgggtgtggtggtgggcgcctgtaatgccagcttctgaggaggctgaggcatgaaaattgcttgaacctgggaggcggagattgcagtgagccaagatcatgccactgcactgcagcctggctgagtgagactccatctcaaaaaaaaaaaaaaaaaaaaaaaaaaagaacacaatgaaacagaaaagagaaaaatcgtgggggaaagcaagaaaacaaaaagcttgtcattgaaaagataaataaaattgataaactgaagtcagaataatgagaaaaactgaacaggaaaataaatcaacactccagcctggacaatacagcaagactctgtctcaaaaaaaaaaaaaaaaatcattaatacacctttccacaaagaaaattcaaagccagatgccttcactggtgaatttcatcaaacatttaggaggaaatataaattctacatacgttcttccaaaaaaatcgtttaagtgggtacatttcccaattcatttcatgaggtgagactcattctgctttggaaaaaaacaaaaacaaaataaaaccagcccgtaattccagctacttaggaggctgaggtgggaagactgcttgaggacaggagttctagatcagcttgggtaacaaaaggaactccatctcaaaaaaagaaaaaaaggcaaagcattagcattacaagaaaagactaggccgggcacactggctcgtgcctgtaatcccagcactttgagaggccaaagtggaaggatcacttgagctcaggagtcaagaccagcctgacaacatggcaaaactccttctctacaaaaattagccaggcatggtggcatgcacctgtggtcacagttacttgggaagctaaagggaaaagatcacctgagcccgggaggtcaagtctgcagtgactgtgacactgcactccagtctgggccacagagtgagaccctgtttccccactccccccaaaaagaaaaaagaaacggacgtggtggctcacacctgcaatcccagctcttaaggaggcataagtgggagcatagcttgagccgaggacttcaaaacttgccttggcaatatagtgagaccccgttctccacaaaaaggaaaacaagcattggacaaaactgaatgtctgttcattataagcactgtcagcaaactaggaaaggaggaaacttcctcaacagataacataatacttattaaatcttatcaagagtaccactacatgctaagtcttgtgattcattctagctaatcatggaatctaggtgtggtctcggagattcctgacataaatgtgaacaaaatatatgagataactgtttcaggcattaaacaagaagaaacacgaagctgtgatccttgaaatgagggaaacacatgaggtaaacccccatgactgcaccagcttgggggcaatttctcaatcatagagatgacacctaggcagaaaacagtagacactgggccaagcaaggaagtagagaacagaattctaggctgttgaaacagttggaatttgtagcagagttaccagagaaaagggagctataaagacaagaaggaaaaaaatctcacatggggattcaccatgggtctttggccatggtctaaggtgtatctgtgagagattctgtgatgcctagcagtaatcacttgctgtgtgtgggtctgtgaacggggtcctaaaggtctggaagacatagcagttttagttcagcgtgaaaagacatcactgaaccccctgaacactcaattgagaacacaaaaaagctataccttaagaggaaggtccacatcctaggactaagttcaaaatagaagtagaactgccctaacaaagaagaaaatcaaacctgaatggacaaaagaatctatcaaaaattaatttaatcacctgtcagaaagaaactgaacactccttacaggaaaattatttactccagaacaacaatatatgataaaaaattattggccgggtgcagtgactcacaccatcccagcactttgggaggccaaggcgggcggatcacctgaggtcaggagttccagaccagtctggccaacatagtgaaaccccatctctactaaaaatataaaaaattagctgggcgtggtggtgtgcgcctgtaatcccagctactcgggaggctaaggcaggagaattgcttgaacccgggaggcagagggtgcagtgagctgagattgcagcactgcactccagcctgggcaacagaacaagacaccatctcaaaaaaataaaaaaatactagacatataaaaaagatgaaggaaaaaaagcagtcaccagaaacagaccctaaatgatgcaaatgttggaatcagtagacaaagactctaatgcaggtattataaatatgctgaagggcatacaggaatagacagtcataatgagagtgcacatggtgcatctcagcagtaaaatggaaactataacaaagaatcaaatagcaatcctagcactgaaaaatgtaatgtatgaaatgaaaattcactggatgggctgggcgcagtggctcacgcctgtaatcccagcactttgggattacaggcgggcagatcacaaggtcaggagatcaagaccatcctggctaataaggtgaaaccccatctctactaaaaaaaaccacaaaaaactacccgggtgtggcagcaggcacctgtagtcccagctactcgggaggctgaggcaggagaatggcatgaacccaggatgcagagcttgcagtgagctgagactgcgccactgcactccagcgtgggcgacagagtgacactccgtctcaaaaaaaaaaaaaaaaagaaaagaaaattcactggatggacaaaacagcaaaatggagaatgtagaaataagagtgaacctgaagacatcaatagaaattattcaatacatcagataaagaaaaaaaagttaattaaaaaaaaaaaacttcctggccaaatgcagtggctcacgcctgtaatcccagcactttgggtggccaaggcgggcgaatcacgaggtcaggagttcaagaccaccctgaccatcaaggtaaaatcccatctctactaataatacaaaatgagccaggcatggtggcatgcgtctgtaatcccagctactcagatggctgaggcaggagaattgcttgaacctgggaggcagaggttgcagtaagccaagatcgcaccactgcactccagcctggacaacagaccaagactccatctcaaaggaaaaaaaaaacaaaaaaacaaaaaaccttctcaatcaggtaaaaaatttgaacgtgcaaatatttacgcaagcagaataagtacaaagagaatcactctcaggcatattatagacatgctgctgaaaaccaaaggaatagaaaaaaaaaatatttaaagtagctagagaagaaaaagacccattccacacaggaagacaactactgtattacagctgccttctcattagaaacaaaagctacaagataaaataatgacacctttaaagtgctgcaatgggctgggcgcaacagctcacgcctggaattccagcactttgggaggccaaggcaggcagatcacaaggtcaggagaccagcccagccaccatggtgaaaccccatctatactaaaagtacgaaaattagccaggcatggtggtgtgtgcctgtaatcccagcttctggggaggctgaggcaggagaatcacttgaacctgggaggcaaaggttgctgtgagctgagatcgcaccactgtatgccatctagcctgggcaacagggcaagactccatctcaaaaaaagaaaaaaacaaaaaaaaaaaacccctgctgcaataaaataacacaacccagaattctatatccagtgaaaacattcttcaaacatgaaaataaaagaaatatattttcagatagaccaaactgagaaaattcatgttcagttcagtgtagctgcactatatgaaatgctaaataaaagaaactctttggcatcgtcaaacaagagacaccagatggaacctcaccatctataagaagaaatgaaaaggactggagatggttaagtacaggggcaaatatgaaagactgtcaggtctttttgtttgtttttttttctggagacagggtcttgctctgttgcccaggcaggagtgcagtggtgtgatcagggcttattgcagcctcaacttcccaggcccaaacgatcctcccggctccaatgatgttcctgcttcagcctcttaagtagctgggactacaggtacatgataccatgccaagatttttgtgtgtggttttcttttttttttttttttggtagacacagggtctcactatgctacccgggctggtctcaaactcctaggctcaaaccatcctcctgcctcaacctccccaagtgctgggattacaggcgcgaaccatcacatccagcctgtcaggttttttgtttttgtttttacagacttccttgaaaaactcttcaatatatctaaaataaacccattctatgtacttttattcctagcctaccacccagagaccttctcttcttcctcttatacttcctcatcagaccctaaagcatattacaatttactcagttgcctaagaaggaaatgtagttaccatgctcaaatcttcccttttcttcacattcaccaaatcctattgcatttatctcattaagcccttcaaatatgcctacttctcttcattgtcaaaaacatcttacttcaggttctcatctttttgccagagtcactctaaaactttagcaactggtctattttcttccaatccaatctaaaaatgcaaactgctcttacaaaaaataaaatcagccgggcctggtggctcacacctgtaatcctagcactttgggaggccgaggcgggtggatcacctgaggtcaggaattcaagaccagcctggccaacatggtgaaaccccatttctactaagaatacaaaaattagccgggcatggtggcgcatgcctgtaatcccagctactcgggaggctgaggcaggagaattgcttgaacccatgagacagaggttgcagtgagccgagattgtgccactgcactccagcctgggtaacagagcaagactccgtctcaaaataataataatactaatatagcatgttattaattgcctgtacaatatccttttaacatgaaatcaaaagcatgtgcaacaaaaagccttgtagagtaactgaaactctcatttttccaggcccaaatctctcaaatctccatcttacattctgcagtttcctgacagaaccatgatgtctttcactatcaggccttcccatacactgctctcgctgcctaaaattcctgtccttcaacttctgctcaacagacacaactttacaactcttcttaggtagcttcacctgagtttcaaacagccttgactgacccttcaccttccaagtctaggtaaagtacccatcaaatataatagcatgtgagtttcatgccactgtgttctaactcatatttctaatagattagttttatttattttccgaaatttgtgcggtatagttatgttaaacttacctgacgagttgctgacaaatttgacatcctggaaggcatctattgaacacaaaaaggtaaataaattatttcaggtgaaaaactttctgattttaaagtatataaaatacataaaatacaaaacaaaaaaaattatatacctagtttaatttttcagtagatattatagttcacgtataccttgatttataattcaaataactattttttaactgacagtctcaatttttttttttttttttgagacagagtctcgctctgttgcccaggctggagtccaatggcgcaatctcagctcactgcaagctccgcctcccgggttcacaccactctcctgcctcagcctcccaagtagctgggactacaggctcctgccaccatgcccggctaatttttttgcatttttactagagatgggatttcactgtgttagccaggatggtctcgatctcctgaccttgtgatccacctgcctcggcctcccaaagtgctaggattacaggtgtgagccaccgcgcctggcagacagtccacacctataattgcaacactctgggaggcacaggtgaattgcttgagtccaggagtttaagatcagcctgggcaacaaagcgaaactccgtctctacaaaaaaaaaaattagctaggggtagtggtgcaggcctatagtcctagctactagggaggctgaggtgggaggattccttgagcatgggaggtcgaggctaaagtgagccatgatcatgccccactgcactccagcctgggcgaaagagcgagaaactgtctcaaaaaaaaaaaaaaagacattatcttggcaagaatacagagagagtctggtatctgtgggtgagagtatatatttatataatccctatggaaggccacttggcaatacccatcaaaataaaaaacgttgactctcacacactaattccagttctaaaagcataggctaaaacacatctgtagtatacgtataaaatgaaaattgtacaaggtcgttgactgcagaatttttttcctaacagccaaaagaaagtgaaaatagctaaaatgttcaataagagattactaaaacaaattacaattcagacataattaaataggctgcaacaattaagaacaaactagtggccaggcgcagtggctcacgcctgtaatgccagcactttgggaggctgaggcgggaggatcacgaggtcaggagatcaagaccatcctggctaacgcagtgaaaccccgtctctactaaaaatacaaaaaattagccagatgtggtggcacacgcctgtaattccagctactcgggaggctgaggaaagagaatggcctgaacccaggaggcagagcttgcagtgagactacgccactgcacaccagcctggatgacagagcgagactccgtctcaaaaaaaaaaaaaaagaaagaacaaactagtgatcgccaagataagttacagtcacagtgggctacactatatattttaaagggggaagggggataatcatctgcttggacatacaaagactatatctaactttctggaagacattccaaggaatggataacatcagattttttattagcaaggtaaacttatagctaaagcacagtactggaaaggagactttcacttacagcatttggtaccttttaagttatgaaccaagtgtcaattacctattcatataaaattaagagttcaactactgtagaaagaagtgacgagctaactgtaaattatgtctctcatgaatggttaaaggtggggatacttagtaacagctttggatttctttaataccttgagtgcttttattatttctattgcaaagtggaattaataaaactatagaaaataaactccttaatgataaaatctattttttcttttttttttgagatggagtctcactctgtcactgaggctggagtgcagtggcaccttgtcagctcactgcaacctccgtctcctggattcaagcaactctcctgcctcagcctcccaagtagctgggattacaagtgcccaccaccacgcccagctagtttttatatttttagtagagacgcggtttcaccatgttggccaggctggtctcgaactcctgacctcaggtgatccacctacagcctcccaaagtgctgggattacaggcgtgagccaccacacccgaccaacaaaatctatttttttaataaagcaaaacatcaatttctccggaagaaaaatggtattttattttagaactggcacactgaactaaggaggcttaaatactaatcccatctttatgaatagccatgtgacttgggaaatgtcatttatcctcttgttgagaaatgtgatacgatgttgtaataaaacatatctttaacaagtagtaagaaatcagaataaatcatagactctaatgattggaagagatgttaaggttatctattttaatgatccaaaaagaactaatcaaaaacatttacagaatgtattaaaaaattgagggatatttaaaaaacataaaatattttctcaataataaataaatccaaatttaaaatatatactattataattactgtcaactaaaaataaataaatgtataccaggcacggtgactcactttgggaggctgaggcgggcagattatctgaggtcaggagctcgagaccagcctgaccaacatggtgaaacccctgtctctactaaaaataaaaaaaattaagtgggcgtggtagcgcatgcctatagtcccagctactcaggtagctgaggcatgagaatcgcttgaacccggaaggcagactttgctcacctcagtctcccaaagtgctggaattacaggcatgagccaccatgcccagcctaaaaatatatacatactattttctacttatcacgttttcttgatggtgatggaaaatgttactccagtcattactcagtaaaggagacaatctcattcactactgggtgatcatttatattcctttaatacttttcaaaagattctggcattacataacctaaggggggaaaatcttaaatataaaaaaggttttatccacaaagatcttcattgtggcctaattaaattttaaatggctaaaaatcgaaaacaactaaattgaccaatagtagaacaggtatataaattgtggtatacacaataacagaatattaactaccattccttttttttttttttgagacagagtttcactcttgttacccaggctggagtgcagcagtgtggatctcagctcactacaacctctgccttccagtgtcaagcaattctcctgccttagcctcccaagtagctgggatgacaggtgcccactaccacgtctggctaatttttgtatttttagtagagacagtgtttcaccatgttggccaggctggtctcgaactcctgacctcgtgatccgcccacctcagcctcccaaagtgctgggattacaggtgtcagccaccgcaccaggcctattaactaccattcttataaaatatctgtagtatgaaaagcaggtacattttgcatatagactgaatgtagcactactttaaaacaaaagcaatacactgagaaaaagttaaaaataaagccaccaaatgttattaataatgacagtcttaatgtattgaaactctacgtattgcttcaactttgtttctcaaaagttttttaaatgtatcatatacattacactttcaatggaaatgtgtttgttgtgagagatccgttcaaagttaagaattttttaaaatgttaaaataaagagaaatttttggaaatgctattcaacaaatatttactacatatccactataaacaagaatagtgacatattctataatataaagagatatcagttagtaaaaactgtctatttagctatgtttttctaagagttatatatctaacagaaatgaaagttgcagagaaggtaaatgggtagagaacacagtgtgacaggagacggaaaaggaaggaagattcaaaaatcttgcaaatacttttgtcaattaattttcattttttctaagtgcccatgaagaaaagtgctctataggttaggaaataactatatcttagatttccttaagtttttttctatctttaggcctcagaaaaaagaaaaatttgctgggtgcggtggctcacacctgtaatcccagcactctgagaggccaaggcaggcagatgacctcaggtcaggggttcaagaccagcctggccaacatagtaaaaccctgtttctactaaaaatacaaaaactagggctgggcgcggtggctcacgcctgtaatcccagcagtttgggaggccaaggcaggtggatcacaaggtcaggagattgaaccatcctggctaacatggtgaaaccccatctctactaaaaatacaaaaatttagccggctgtggtggcacatgcctgtagtcccagctactcgggaggctgaggcaagagaatggcctgaaccctggagggagcttgtactccagcctggacgacagagcaagactctgttccaaaaaaaaaaaaaaggtaaaaagaataattttggcaaaaatgtttaagtaaatatttcatgagctcaactttttcttcagttactaagttaatgtcctttaatttttttctattatcaaagccatcttagagaccaaagacacagacacctatagtctctgataatagattttccagtaaataatgatctgtatctatatattggcaaacaaaaagaatgactattattaggttcatattgctttcttcgacatgaaccatagtgttggatacccagtagatgcccaatagatacacaaatttaagttcccaatatcagtgaatccattaaaaaataagagagtcttaactgccttacctttgtaaaacactacactatgatctgagggagtttagagatggaggaacacttcaaggaagagattgtatgctgtaaatggcattaagaactccaaaatactgatttcagtgctgtttcctcctcccaatccctcccaaattaaatgattaacagtaattataaaaagtaacagtaagtacaaataatttatttagtggtttttgtttccaataaagaaataacaatataatttacactaaaatttctagaagaccccagaagtaacaaaggtgtgcttacctgtgagggtccttggaacttggtataatatatacacattccctcttggtcaaagtgctttctatccaggatttctgggactaaaacaaaatgttttaaagaattgtttataagttaacccactaaataagaaggaaacaatttcatgataaacacataaacagttcttttttttttttgagacagagttttgctcttgttgcccagactggagagcaatggtgtgatcttggctcaccacaacctccgcctcccgggttcaagtgattctcctgcctcagcctcccgggtagctggcagtacaggcatgtgccactacgaccagataattttgtatttttttagtagagatggcgtttctccatgttggtcaggctggtaacgcccgacctcaggtgatctgcctgcctcggcctcccaaagtggtgggattacaggcgtgagccaccgtgcccggcccataaacacttctatactacataattttttatttacttttcactacataccataatctgaggatggcaccccaaaacgtcagaataattccatttaaatcccaagtgacctaggttattaaatcaacagtactgtgtagatactattgcttcaaatagtcaaacaggagggaagcctagtttgagattcccactacgaaccaaaaaccttaagaggggctggtattattctgggatatgagccatttaaaagacaactagctcggcacagtagctcacacctgtaatctcaacattttgggagccaaggtgagaggatccttttagacagaattcaaggctaccctggaaaacatggtgaaacgccatctctaccaaaagctaaaaaattagccaggtatggtgatgtgctcctgtagtcccagctacttggaagtctgaggcaggaggatcgcctaagccgaggaggctgaggatgcagtcagccatgatcaggccactgcactccagcctgagtgaaagagtgagagactctgtctcaaaaaacaaagcaaaaaaaacctgaaaaaaagacaattagaattgacagatttggccgcgtgcggtggctcacacgtataatcccaacactttgggaggctgaggtgggcggatcacaaagtcagaagaccaagaccatcctggccaacatggtaaaaccccgtctctactaaaaatacaaaaattagctgggtgtggtggcgtgtgcctgtaatcccagctactccggaggctgaggcaggagaatcgcttgaaccagggagtgaaccagggagtcggaggttgcagtgagccgagatcgcgccactgcactccagcctggcgacagagcaagactccgtctcaaaaaaaaaaaaaaaaaaaagtgatagattgataaaaaataaaacccagctacattccatttctaatataaatacctaaagcataagggcatggaatggttaatgatacaggaataaaaagacataaagcaaattctaattagaagaaaaatagtgtcagaaaaatgggtacaacacatcaatagggatagagaaggttattacaaacgttaaatctgccagattgctattataatcttaaatatgattaaccaaataaaagtttcaaaatacataaagggaaaaaattagtagcattagacaaatctaggctcacagaagattaacacatttccctcaatactgaaaagtcaatcaaacaaaacctaacagcagaagccaggcatggtggctcacgcctgtaaccccagcactctgggaggcaggaagatggcttgagtctgtgagttcaagaccagctgggtaacacagtgagactccatctctacaaaaaaattaaacagtcagccgggtgtggtggtgcacacctatagtcagtcccagctactcagggggctgaggtgagaggatcacttgagcctgggaggtcaaggctgcagtaagccaagatcacaccactgcaatccagcctcgttgacagagcaagaccctgtcttaaaaataaataaataatcagcagaaatatttaaaagattttaacaacatgttaacaagcttcatttaataaatatacgcatgtttctgtatattagaaacagaagatccattcattcttctcaagcacacatgaggcatttataaaaattaatcatgggtcaggcccagtggctcgtacctgcaatccgagtactttaggaggcctcatggatcacctgaggccaggagttcgagaccagcctaaccaacatggtgaaacccgtctctactaaaagtacaaaataagtcgtgtgtggtggcacacatctgtaatcccaactactcaggaggctgaggcagaactgcttgaacccgggaggcagagattgcagtgagccaagatcatgccactgcactccagcctgggtgaaaagagtaaaactctgtctaaaaaaaaaaaaaaaaattgatcatgtgcttgaccataaaataagattcaacaaatttcagacactgggtatctggcagatcatactcactgatcacaatgcaattaacataatgtaaataaaaattttaaaccaccaacattcaacactttatataacttgaggatccaataaaaattcataattaaaaattttaaattcttagaagtgaataatagtgaaaattctatgcacttgaaaacctgtacaatgtagtctaaatggtgcatgtataggaaaatgtataggcttaagtgattacatttaaaaatgaaggctgggccaggcacagtggatcacgcctgtaatcccagcactttgggaggccgaggtgggcagatcacttgaggtcaggagctcaagaccagcctgaccaacatggtgaaaaccgtctctactaaaatacaaaaattagcagagtgttgtggtgggcacctgtaatcccagctactcgagagactgaggcaggagaactgcttgaacgtggaaggcagagcttgcagtgagcccagatcgtgctactgcactccagcctgggcaacagagcgagactctctctcaaaaaataataatttaaaaaaaaggctgaaaattaatgagctaactctcggactttaaaaacatattgaaagaataaagtcaaaggaaagaaataaaattaaagaaaaaaatcagtaaaacagattttaataaaacagcaagataagcaaaagttaaaagttggttcttaggttaacaaaattggtaaacctttatcaagactgaacaagaagccaggcagatcacttgagtccaggagtttgagaccagcctgggcaacatggcaaaaccccatctctacgaaaaatacaaaaaattagccaagcatgtgatggcacgtgcctgtagacccagctacttaggaggctgaagccagaggatcatctgaacccagggagctcgaggctgcagcgagctgtgatcatgccaccgtactccagcctgggtgacagaatgagagaagggagaagaaggtagaagggagaaagaagaggaggaagaggaagaagaggaagaagaaaacgaagaggaagaggaaaaagaaaaagaggccgggtgcagtggcttatacctgtaatcccagcactttgggaggctgaggcgggcagatcacctgacgttgggagttcgagaccagcctgaccaacatggagaaacctgtctctactaaaaatacaaaattagccaggcatggtggtgcatgcctataatcgcagctacttggaaggctgaggcaggagaattgcttgaacctgggaagcagaagttatggtgagccgagatcgtgccattgcactccagcctgggcaacaagagcaaaaactgtctccaaaaaaaaagaagaggcggtggaggtggcagcacaagtaatagtaagactgaaaagatacaaggtaattgaaagataaagaagaaaataacaggctgttctgcctctggagtagccattcttctgtttctttactttcctaataaacttgcttttactttactgtatggattcgcctcaaattctgtcttgcacaagatccaggaacctgttcctggggtctggatcaggacccctttctggtaacatctttctggcaaaccataaagggatgatactgaggagacccccaacccaaaggaaatagactgcagcattgattggccgactctgggggtgtctaatggcagttatggggaaatacacagctctctgcatgtctggatcagagaaacatgctcttggccccctagaagctgtgcctgattactaggccctagaaactgaacgctttcctcgccctgttcctccaagggctctaccttgaagccagtaatccaattaagaaattggcaaatgaaagaccttacaactgatggatctcccgcctatgtatttatatgtgttgtgtgtgtatgatatgaaagagctttgattaactggtttaaaaataagagctgctggccgggcacagtggttcacgcctgtaatcccagcactttgggaggccaaggtgggcggatcacttgaggccaggagttttgagaccagcctggccgacatgtaaaaccccacctctactaaaaatacaaaaaattagctgggaatggtgccttgcacctgtaatcccagctgctagggaagctgaggcaggagaatcgcttgaacccaggaggtggaggtaacagtgagccaagactgtgccactgcactccagcctgggcaacagaaggagactccatccccctccaaaaaaacatatttaaataagaaataataaaataaaattggatcaatttgtctataaggttttattaagaactgggtttcacatatcaataatgcactagtccaacagtgaaatttggcttattgacataaaaatcatacaggaagcattgccaaatatgaaatggtgtttggctttctttgggttgcatttgtataaatatgttattggtatgtgttccaaaattatgaaaagctcctataattctgatatgattcaatgtaccttatcagcagtaattatgattattatgttaaattattgtgtgccacaaaggtaaccaaaattctttgtcaatcgtgtctttgactatggctgtcctaagactttttgtcatcaacatacaactgttgtcatgttttgatcctcttcgaaaggtggtttataatcagctataggactttcacaggtgctcttaaatgcaggtttctgataactttggagactctaacattagaataaaggaaaaaacattcaggactgtcatggagggctggaatgttcacgtgtatcaaacaggagttaacttcatggactgaattaatgtaagactcatcttttttacttttttgcttaaaacgtcgctgatcctttattttgttttgcagtcaaggatttgagctattgacagctattaacaattgagtaaagtatactcctgtggacaaaatttggagcatatttgtttctctctaccccatttctcaatttggagactatttatgagtactcttaacttatggcaatagatttgtttttgttttttgttttttgagacaaagagttttgctctgttgcccaggctggagggcagtggcatgatctcagcttactgctaactctgcctccggggtccaagtaattctcctgcctcagcctcccaagtagctgggattacagatgcccgccaccacaccaagctactttttgtatctttagtagaaacaggttttcactatgttggccaggctggtctcaaactcctgacatcaagtgattcacctgccccagcctcccaaagtgctgggattacaggcatgagccaccatgcctggcctacaatagatatttgtataagtgcagtaagaatcggttttctcttgtgacaggacacaattggagaaactggttattttaccaaggctttgactggaatgatgtgctctccttaaaggaatcaaacttgacttgtagagccaattaaaagctgcttgggaaaactggcctcatatcttgtctacgcagtccctgtacagggttcctgacctgtgataagttaagaatgtcactttttgacaggcccaggagccccaagttatcttgggacctcaagaagagagaaatttacccaatacataaaggtatttgagggtacaaacccacagctgaggtcaggcgcagtggctcatggctgagcgtggtggctcacgcctgtaatcacagcacattgggaggctgaggtaggtggatcacctgaggtctggagttcgagaccagcctggccaagacctcatctctactaaaaatacaaaaaattagccaggcgtggtggtgtgtgcctgtaattccaactacacaggaagctgaagcagcagaaccacttgaactcaggagatggaggctgcagtgagccgaggtcatgccagtgcactccagcctgggcaacagagtgagactctgtctcaaaaagaaaaggaaaaaaaaaatccatgctgggctcggttttaaaagtcttatcggagattccttatggaacagagttccatcaaagccaatttcgaaagcctatataattattcttgctgcactttatacaaataatctggccaagtataacaaagcaaatcggtcatactataacttgtctttagtaaaaatgggacactggagtgagaaaaaattgtgtttcaagaactatggtatacctgtcagtagattctagtctcatcagttgtttgagtttttttcctgcaatttaggctgaccttgctttctcctgtgaaccaatcagtgatctctgactgaagtccaggaaaaaaaaaagggatggctaatgtaaaaatctggatcaatattctaattctgggcacataatacaatcagcgatcccttatcagcatggttccaacagttgccagttcatggaaagccttctaatttagtttacttgggacagttttacttattttgctttactgttatggaatacattgctgttgtactctttgtataggaatgcaggataagcttactgaatgttttattaaacacttattaatctttcagatatcatgttttgtcagaactctgagttatggatggccctcagcaaactgatgtgttgtgaatgagtgcctctctatcacggacacaagagaccttaatagttaggcaggaatatcatcaccccattcagcaagaagaggttacaaaaggtgtatcttcatccctctacaacccttaggatgaaggattctcttataaaagaaggggggaaacgtcagaggtgtttaaaccagagtgactccatcttgaataggggctgagtaaaataaggctgagacctgctgggctgcattcccagtaggttaggtattctaagtcacaggatgagatgggagtccaacataagatataggccataaagactgtgctgataaaacaggttgcactaaaaaagctagccaaaacccaccaaaaccaagatggcaacagagtagacctcttcctcactgctcattatatgctaattataatgtatcaccatactaaaagacactctaaccagcaccatgacagtttacagatgccatggcaacattcagaagttaccctatatagtttaaaaagaggaggaaccctcagttctgggaactgcccaccactttcccagaaaattcattaataatccactccttgcttagcatataatcaggaaataaccataaaagtgggcaaccagcagccctcaggactgctcaacctatggggtaaccattcttttgtttatttactttcctaataaacttgccttcactttactgtaaaaaaaagaaaaagaaaaaaaaaaaaaaagcaagaaaataataagaggatactatcaacaactctgtgccaaaacgtgtcaaaacatattaagtaggccaggtgcagtagctcttgcctgtaatcttagcagtctgggaggccaatgggggcagattgctggagctcaggaatttgagaccagataaaagggggctactatacattgcggaatggctaaatcgagctaattatcatatacattgcctcacatactatttttttgtggtgagaccacttaaaatatactcttagtatttttcaaaaatacattgttatttagcgtagtcaccatgttgtacagaagatttcttgaaattattcttcctaactgaaattttgcatcctttgaccaacatttccccagcaatccccacccaagtccctgataaccaccattctactctccatccagaaattgaacttttatcagttcaattttttagattctacacagaagtgagaccatgtagtatcttgtctttctgttcctggcttatttcacttaacataatgtcctccaggcccatccaggtcacaaaaaacagaatttccttctttaagattgaatgatattcctttgtgcatactgtcatgtgccacataacaacactgaggtcaatgatggaccgcatatttaacagtggtcccataagattataatggacctgaaaaattcctattgcaggctgggtgcaatggctcacacctgtaatcccagcaccttgccgtgggaggaggagatgagaggactgcttgaggccaggagttcaagaccaacctgggcagcataatgagatcctgtcgctacaaaagttttttttaattagccaagcatgttggtgcctgcctatagtcccagctacctgggaagctaaggtgggaggatcatttgagcccaggagtttgaggttaaagtaagctatgatcacgccactacactccagcctgggtgagagaacttgtctcgaaaaaaaaaaattcctatggcctactaacatcgcagccatcataagttcatagcaccaggactacttgggtatttgttttgatattggtgtaaacaaacctgcactgccagttacatagaagtatggcatatacaactatgtacagtacataatactttgtaataataaatgactatgttactgatttatgtatttactagactacgctttttatggttagagtgtactcctacctatttttgtttggttggtttttgtttttgttttttgagacggagtctcactgtcgcccaggctggagtgcagtggcatgatcttggctcactgcaagctcatctcccgggttcacgccattctcctgcctcagcctcctgagcagctgggactacaggcaaccaccaccacacccagctaattttttgtatttttagtagagacattttcaccatgttagccaggatgttctggatctcctgacctcgtgacgtgatccgcccaccttggcctcccaaagtgctaggattacaggcgtgagccacctcgcccggccactcctacctatttttttttttaactgtaaaacagcctcaggcaggtccttcaggaagtattccagaaggcactgttatcatagaaaatgacaactccattcatgttattgtccctcaaaaccttccatgaggcaagatgagaggtggaagacaattctactgatgatcctgaccccgtgtaggcctaggctaacgtgtatatttgtgccttaggtttgaacaaaaagtttaaaaagtaaaataattttaaaatgttgaaatagaaaaaagtagccaggtgcggtggctcacgcctgtaaccccagcactttgggaggctgaggcaggcggatcatctgaggtcacgagttcgagaccagcctgatcaatgtggtgaaaccccatcactactaaaaatataaaaattagccaagtgtggtggcggatgcctctcatcccagctactcaggaggctgaggcaggagaatcgcttgaaccagggaagcagaggttgcagtgagccactgcactccagccagggtgacagagtgagactctgtctcaaaaaaaaaaaaaaaaaaaaaaaaaaagcttatagaataagtatataaagaaaatgtttttatgcagctgtacaatgtgttttatacgaagtgttattacaagagtcaaaaagttttaaaatgtttacaaatctgttaaattaaaaagttacagtaagctagcgttaatttattattgaataaaaaaatactttttataaatttagtgtaggctaggtgtacagtgtttatcaagtctacataagtgtaatgccctaggccttcacattcactcaccactcactcactgactcgcccagaacaacttccaggtccacaagctccattcacagtaaatgccttatacacctatactattttttatttttattgttttttacttatttccataggttattggaaacaggtagtgtttagttacataagttagttctttagtggtgacttgtgagattttggtgcacccattgcccgaccggtacacactgcaccctatttgtagtcttttatccctgacccccttcccaccctttctccctgagtccccaaagtccattgtgtcattcttatgcctttgcgtcctcatagctcagctcccacttatgagtgggaacatatgatgtttggttttccattcctgagttacttcacttagaattaagagtctccaatctcatccaggtcactgtgaatgccattaattcattcctttttatggctgagaagtattccctcgtatatatatatatataccacagtttctttatccactcgttgacttgatgggcatttgagttggttccacatttttgcaattatgaattacgctgctataaacatgcgtacgcaagtatctttttcttataatgacttattttcctctggtagatacccagtagtgggactgctgtatcaaatggtatcctaaggaatctccacattgtttcccatagtggttgtactagtttacattcctaccagcagtgtagaagtgttccctgtttaccacatccacataaatgtctattatttgttgttttatgtattatggccattcttgctggaataaggtggtattattgcattctggttttctgttttgtttcttgagatggagttttactctgtcgcccaggctggagggcaatggcatgatctcggctcactgcaacctccacctcccaggttcaagcgattctcctgtctcagcctctggagtagctgagataacaggtacctgccaccacgcccagctaatttttgtatttttagtagagatggggtttcaccatgttgaccaggctggtctcaaacccctgacctcaagtgatccatctgcctcggcctcccaaagtgctaggattacaggcgtgagccaccatgcccagaagcccagctaatttttgtatttttagtagagatgaggtttcaccatgttggtcaggcttttcttgaactcctgatctcaggtgatccacccgcctcagcctcccaaagtgctgggattacaggggtgagccgtggcacccagccagtgcctggtttctaataaatttctgatgtcacaatgtatatgtttttgtactatgtatcccttaacaaattattgttgctattattatttttaatggtttttgtcttttaaccttcatactaaaaatacaaatgatttgcataccaccattatggtattagagtattctaaattaactctatttacatttaccagtaagtttcatacttttcatattctttttgttactaattagcaaccttgtctttcagcttgaagaaattctgttagcatttcttgtaacacaggtctagtctctgagcttttgtctgggaaaatcttcaaatctccttcatttctaaaggagagctgtgccaggtacagtattcttggataatgggtttgtttttgtttttttgttcttcaacacttcgaatatatcatcccctctactacatcccatagttttgggttttttccaagagctggaaaccagagttgtttctcattggcaaatccacccaaaactttagcaaacaatttgctaaaagtcacttaaattgtgtcactcccatactcacagatttttactaaattttatgcctacagggacacataatgacattagcatgtttcaagaaaatctcctggctgggcacggtggctcatgcctgttatcccaacactttgggaagccgaggcaggtggatcacctgaggtcaggagtttgagaccagcctggccaacatggtgaaacccagtctctactaaaaatataaaaattagctgggcatggtggcgggcacctgtaacctcagctactcagaaggctgaggcaggagaatcgactgaacccaggacacagaggttgcagtgagccaagatcacgccattgcactccaacccaggcgacaagagcaaaattccatttcaaaaaaaaaaaaagaaaatctcctacagccttccctacctcattcaccaattttgtttatttcaaaaacttactacctctcattctgtttatgtaacagccaaatgtacatacattcttcccacacgtagcattctcatcatttacggccttcacttgttacacaggaatcggcttcacaaatccaatattcacataccccagctgaaagttgtaaatatcacctaatgataaaaaaaagtttttatagtttttgaaattctaagtttcttctctgccatcagttacccaatcaaatgtgccctggttataaatacatataaaaatcctagttttatacactttgctttttaattttgctaggttgcactaccagattttaccaagaggtggcaaactacaaacacaaatctgaaaattcctaaatttgtatgttccaagtaatgtaaaaagtaactatatccacagaatgctagtagagcagggaatcttaaagatcagttggtgatcttcagtggttaaatagtacagattctggaatcagactggtctgagttaggatcccagctctgctgtttactatgtgtgcaaccttgtgcaagtttcagagcctctttttgcttccttacctgtaaaataggataacaacagtacttactcacaatgttactctggtgattaaacaaaatgatccatgtaagttgttttagcacaatgcatggcacatagtcaaatttcaactatgatggtgatcacttcaaaactccttaaattataaattcttacaccagtctaccagcaataagggacatgtattacaaataaacctaagcacaccttactctctaaacaaatcactaccagcacatccttcctgcctagatgctgctagcaaaaattgggggaaaaaattaaagattcctaaaaaattctgctgttaaggtaacatgtggaaatcaaatttttttttaacaaatacattctatgattatatatattaaaattagaaaattctagctatggagaagtaggtcctattaggctaaccatccctcagataaccaccataaattctggacaaaagataaaaaagaggctagacacagtggctcacacctgtaatcctagcactttgggaggccaagatgggaggactgcttgaggccaggagtttgagaccagcctggtcaacacagcgagacctcatctctatcgtttaaattttttttttaataaaaagataaaaaagacttgaggacactgaagagcaaccaaaagcaagcagaaaccagacggagtctatacttagaataaaggaatggtattgagtgagtttcccaatttttaaggctttttgcctgaaaacagtccccatcctatgcctagtgaacagcaaaatatcaatagaaatcccacagtcttactgacttatagaaccagaatacccagttcaaggtgaaaacagcagctggaaagtgatgggaaagtttccgcaagagttgagaaaaggaatcctaaatacttaatattaattctacacaaatctctcactgacccatgaagatcgtacacatggggcagcctccaggcagcccagctaaataaaataactgagcagatattcctgctgcccattgtaggagagacagtttggagtttgagtacaatgaagttaatcaacaactgtcttagtcggcttgggatgccacaaccaataccacacagacttggtgggataacaactgaaacaaattttctcacagttctggagactgaaagttcaggatcaagattccaggagggccagtgtctgatgaaggctctcagacagctgcctcctcactgtgtcttcacacagtgaagagggagtgaataagctctctggtatctcttcttctaaggacataaatcctatcagacccagggccccaccctcatgacctcatctacccctgattacctccatctcccaaagttctcatctccaaataccatcacactggaggttagggcttcaagatatgaattctcggggagcgagggagatcacattcagtacataacaacaacaacaacacacacacacacagagcacaggattaaaagagaacccagaggctgggcgtggtggctcacacctataatcccagcactttgggaggccaaggcaggcggatcgcaaggtcagaagtttgagaccagcctgaccaacatggtgaaaccccatccctactaaaaacacaaaaattagccgggtgtggtgtcacgcgcctgtaatcccggctactcaggaggctgaggcagaagaattgcttgaatctgggggacagagcttgcagtgagctgagatcacgccactgcactccagcctgggcaacagaacaagaccccgtatcaaaaaaaaaaaaaaaaaaaaaacaaaaggtaacccagagcctctactaagtaacaatcccaatgtccaatatacactccaaaatgactagatatggtaatggacaggaaaatgtgacccatattcaaaagaacggtaatcaaattaaaagaaattgcctactaataaagttcatgtgctcaagaaaagaaagttaaatgacactaaagacctagaaattggctgggcgcagtggctcatgcctataatcccagcactttgggaggccgaggcgggcggatcacgaggtcaggagattgagaccagtctgaccgatatggtgaaaccacgtctctactaaaaaaatacaaaaaatcagccgggcgtggtggtgggcgcctgtagtcccagctactcgggaggctgaggcaggaggatggcgtgaacccaagaggcagagcttgcagtgagccaagatgcaccattgcactccagcctgggcaacagagtgagactctctctcaaaaaaaaaaaacaaaaacaaaaacaaaaacaaaaacaaaaaccaacacctagaaattcagagttatgtgataaatttgtacatgggtcaacatgcctgccaagggtgaccaacatgcctgccaagggtgacacagacaatgacaaataagactagcctaaagcaaaatgttgaaataagctggcactctctgacttcccctatcagagttcaatacatttgactttctgacactcttacagaccctactctctagttccattctttaaaaaaaaaaaatatatatatatatatatatatatacacacacacacacatatacataattttattatgtcacagagttccactcttactctaaactggctgccaactactcaactaattaataattagatattactgacattttagatacgaaccctatgagagttttaaagatattattgaaaagcatctataattctgtaacaattggtagaaaagttctatatatttaaaaacttaaggccaggtgcagtggcttatgcctgtaaccccaacactttgggaggccaaggcaagaggaccacttaagcccaggagttcaagatcaacctgggcaacagagtgagaaacccatctttgcaaaaacaaaaaaaaaaatttttttgagacgaagtctcgctctgtcacccaggctggagtgcaatggcgtgatctcagctcactgcaacctccacctcctgggttcaagagattcacctgcctcagcctcccgagtagctgggactacaggtgcgtgccaccacgcccggctaatttttgtatttttagtagagatggggtttcaccatgttggccaggatggtctcgatctcttgacctggtgatccacccgcctcagccttccaaagtgctgggattacaggcattaaccaccgcacccagtcaaaaaaattttttaattagccaggttggtggtatgggcctgtcattttaggtacttgggaggctgaagtggcaggatcacttgagcctaggaggttgggaatacagtaagccatgatgatgtcactgcactctgacatgggcaacagagcaaaacactatccaaaaaaaacaaaacagaaaacttggacgcttggacgttcacactgcgagtaagccatatcaacccattatctatcagtgagcagggtgttgatacttttgttgatacattcatgataggtttctacaggttttatttcatttatatatatatatattatatatatgtgtatatatataatatatatatatatatatatatatatatttttttttttttttgagacagagtcttgttttgtcacccaggctggggtgcagtggcgcaatctggagtcactgcaacctccatctcctggattcaaccaattctcatgccccagtctcacaaggagctgggattacaggcgcacaccatcacgtccagctgatttttatatttttagtagaggtggggttatctacgttggccaggctggtctcaaactcctagcttcaagcaatcctcccgcctcagcctcccaaagcactgggattacaggcaagagccaccatgcccagtcttttcctgctgcttttaacaaagagttacacccatccagaaatctatttaatgacttttctaatctactaaggattgccccagagtatgtgtctctgcacttgtcaaaataaaatgcatgaccgggcggtggctcacgcttgtaatcccagcactttggggggccaaggtgggtggatcacttgaggtcaggagttcgagaccagcctggtcaacatggtgaaaccctgtctctgctaaaaatacaaatattagctgggcatggtggcgggtgcctgtaatcctagctactcgggaggctgacagaggagaatcacttgaacccgggaggcagaggctgcagggagctgagattgtgccactgcactccagcctgggtgacagagcaagactccatctcaaaaaatataaaaataaaaataaaataaaatgcatacagactaatgcgtgtaatcccagtactttaggaggccaaggcaggtagatcacttgagaccaggagttcaaggccagcctgagcaacatgccaaaactctgtctccagtaaaaacacaaatttttaaaaaataaaaataaaaacacaaaaagtagcccaatgtggtggcgcaacctgtaacctcagctacttgggaagctgcagcaggagaatggcttgaacccgggaggcggagtctgcaatgagccaagatcgcaccactgaactctagcctaattgacagagagagacacttgtctcaaaaaaaaaaaaacaaaaaccagacaactgagttgtaaattatctgtcctaaggttaatacacagaaatttgatagtaaaggaaattctattaggtttcattatcatttgaagaaaatcaagtacagcaaactttttaagttataacttttttaaaaaaaaccttaacttttttaacttgacataacacctgtcatctgaggtcttacaaatatacatgtccctgaatatcaaaagccttctccaagtttctgtagtttggcaggtcaacacctactctaccacttattagccttgtgaccgttggcaagtgatttttgattctctgctctttatatataaataatggagaaaacagtattgacatcacagaattttcctgcgggattaatatatgtaaagtgtcgggcgaggtggctcatgcctgtaatcccagcactttgggaggccaaggcgggcagatcacgaggtcaggagttcgagaccagcctgaccaacatggtgaaactccgtctctaccaaaaatacaaaaattagccgggcatggtagcacatgcctgtaatcccagctactcaggaggctgaggcaggagaatcacttgaacccgggaggcagaggttgcagtgagccaagatcacgccactgcacttcagcctggatgaccgagcaagacttcgtctcaaaaataaataaatacacacacacacacacacacacacacacaaagcattcagagcaatggccacagctaaatgccgacacattagctaatgcaaaaatgtgcctaaagcctattacacacttctcttagtccagagtatcttccgggtactgggtatgataaattagactaggaagactatcatttcatatagtaaaggctaatgtatagccctatctttctagtctaattatgtttctccagtgtcctcctaacagtaatagtctgcttctcaggtaactttcctcctgttatctccagcatactaccaaactgccagcagaaagcagaaaactaagcctgttaaatttcactttgcacacatttttcaatcagtgaactctgtctcagggttgctatattattgatgacttagctcaaaagctttttgctcactttccacaaggagctttgtttccaaaggttaaggtttccagaagtctggcagctggatagttaaggtgttatgttattgacatgtttatatgatagtaagaggggtaaacagtgtttcacagactttaatcctaatattgctccttaggtcaagtagggaaaagattatcatttgccttttacagattgagaagataacagtgatgctcataaaagactgtgcggtggctcacgcctgtaatcccagcactttgggaggctgaggtggatcacttgaggtcaggagttcaagaccagcctggccaacatggggaaaccctgtctctactaaaagtacaaaaattagtcaggcatggtggcaggcacctgtaatcccagctactcgagaggctgaggcaggagaatcactttaaactggaaggcacagtttgcagtgagccgacatcgcgccaccgcaagcctgggcaaaagagcaaaactcagtctcaaaaaaaaaaaaaaaaaaggactgtgacctggcaaaaatatgtcaagagtcaagtcttgacttatcaacttcaaaaaactgcttacctccacacaccaaaattcctttaacagggttctaaaacccctacgtggacagaaaactaaatacacagtcccagaaaaacaggttaaaaaaatccagagcatgaggtcaagagatcgagaccagcctggccaacatggtgaaaccccatctctactaaaaatataaaaattagatgggcgttgtggtgtgtgcctgtaatcccagctactagaggctgaggcaggagaatcacttgaatccaggaggcggaggttgcagtgagccaagatcgcaccattgcactccagcctgggcgacaagagggaaactccatctcaaaaaaaaaaaaaaaattccagagcaatttcctaaatccaaaattaactgtaccaaaaagtcaacaaaatctctaaaagaactaacaatttaaattagaactaatcatatttgtataaagtacaagaggtccaattctccaagtcaaacactgtattcacattcaactaatctaataattgcaaagcatcatctaaaagtgacacccatcttaagttctttttactgattcacataaatgactcagttaaaatccccatagtcaagtaatgcttatgtcctaaactaacctcaaccactgaattttgcttcccggtaccaaactttttttttttttttgagacagggtctggttctgttacccaggctggagtgcagtggcatgatctcagctcactgcaacctcaagccatcctcccacctcagcctcccaagtagctgggaccacaggtgcgcatcaccatgcccagctaatgtttttttattttttttggtagagactgggtttcgccatctttcccaggctagtcttgtactcctgggctcaagggatccacccgcctcagtctctcaaagtgctaggattacaagcatgagccactgcaccctgacccaggtaccaaacttaaagcatttgacatttaacaggcagtcacttaaaaaaaaaaaactgcaatttacttatatgttgaaagatttcccaaaaagaaaggagaaaaggaaacccagaatgaaataatagatcaatgacaaaaactaaatgactactacaaaaactactacatgaataacatatggggaacttcacaactgagagatcaggcatcagacaacacgaatccactggtcaatcttaacatttaaaaaaaaaaaaagaagccagggtcagtggctcacgcctgtaatcccaacactttgggaggccgaggcgggtggatcacctggggtcaggagtttgagaccagcctggccaacatggcaaaccctgtctctactaaaaatacaaaaattagccgggtgtggtggtggacgcctgtaatcccagcttcgggaggctggggcagcagaatcgcttgaaccaggaggcagaggctgcagcaagccaggcactccagcctgggtgacaagagcaagactctgttccaaaaaaaacaaaataaaacaacaacaacaaaaaaaacaagtgcaagactccttctcaaaaaacaaagacagtatgtgcctcttaatgtaatgcaacagaaagtacatagtactatctatgagtattgtcaaagtatgaaactagaatctgatcaagtcttttttttttgagaaagactctcacccaggctggagtgaatggcgcaatcttggctcactgcaacctccgcctccaagttcaacggagtctcctgcctcagcctcacgagtagctgggattacaggtgcccatcacgacgccctgctaatttttagtagagacggggtttcaccatgttggccaggctagttttgaactcctgacctcaagtgatccgggatcagcctgtcgccgcctcccaaagtatggggattactgcgccccacctgattaagtcgttttttttttttctgagacagagtctcactctgtcacccaggctgtagtgcagtggcaggatctccgcttactgcaacctccacctcccaggttcaagcgattctcctgccttagcctcctgagtagctaggattaccacgcccgattactgatcaagtctttagattaactactaactagttcacaggaaataaagagtagaagctgggcaaagtggggcatgcctgtaatcccaacactttgggaggtgagacagccagatcactggacatcaggagttcaagaccaccctggccaatatgacgaaaccccatctccactaaaaatacaaaaattagccgggtgtggtggctcgcacctggagtcccagctactcgggaggctgaggcaggagaatcacttgaacccaggaggcggaggctgcagtcagccgagatcgctacactgcactcagcctgggcaacagagcgagactcggtctcaaacaaaaagaaaaaagaaaaaaaaatacagaggagaaagaaacatgttacatgacactacagggatgcattcaacaaaatccaaactgatggaaattctacaaggcaaatgatgggtttctttcaacaaataaatggtaaaagacacccccacaccccaagagagaaggtactagagactgaaagagttaccgaccaaatgctatgtgcagaattctttgtaacctgattctaacaaatcaactgactaaaacatgagacaatcagggaaatatgctgaatatttaatgatactaagcaattattaatttttaggcatgataataatattgtggttatgttaaaaagtccttgtctttttagacataaacacaataaagtatccataaatgacatttgtctgggatttgctttaaaattatcccattgaggaatgatagaagaaataaaattcacatggttgaagctgttgaaactggccaatgggtatatggtagttcattctacaatgtatctttgcaagtttgaaatctcccatgttggcctggcgcggtggctcacgcctgtaatcccaggactttggggggctgaggcgggcggatcacctgaggtcaggaattaagagacgagcctgccaaacatggtgaaaccccgtctctactaaaaatgcaaaaattagccgggcatggtggctacagtcccagctactcgggagcctgaggcaggagaatcgcctgaatcccggaggcggatgttgcagtgagcggagatcgcgccacttcactccagcctgggcgacagagtgagaccctgtctcaaaacaaacaaacaaaaaagaataaggtggaaaatagtgaaagacacattatttattcaaagtattactacatttgtgttataagtaaaactcttattttagttttgtatggcacttgaattagcgtccagtgaaaagcaaacttgccagactccagcagagggagagttgtttgcataaagcctatcaaattcaagtactgaccaaaaatacctactttgctcttcatgtccctgatgtaaatgactttcttaagaaatcttcaaaattggttcctgatatccaaaaataaaaagctctatcggaagctgcaatgcaccgcctccctctctccattccgcacctttcggtttaaaacacgatcaactgttctctggggcaagggatgcggtagttcgacttaaatcctgactgacagtacattgtcttggtccccacagaagcctccccccacccaccaaaatccttaattcttgctaaagaaaaaagatctaccatcaatattgtcaaatccctcccttttggttccaaaaaggaaatgtacctgtagagtatccgctgcacagcaaacaaggcactgctccaaacccgtgtcctctaccccctttttgcacccttctagccctccctcccttttttccatgtaaaacttgagcagagcatttggttcccttatctgccagcaactggcgccaggaggaccgtgctcccaggagatgcggagcttgtaggctgagccctgcgtcgggcgcgctgaggccgctcagctgagcccagccaggtagtcccgggctcgcgcctctgccgcctggagaggccctcgctgggagccgagtctcggctcaggggattcccgcgaagaggtgtcgcctctaacttgctacctgctcccgcccctcaccccagaacgaactgcacacccgtcccgagaggacaaatccggaagcctcaaggcaattcgagggtccttcgccgcatggaacgcggctccccacacacttgcctgccaagtctctcctttaccgcccgcaaccccagaaccattccccgcccgggcctgcgtgggtccagtaccattctcctcacggggcggactccggaagggcagcaactccacctcctcctcctccgcggcctgtagccatctatcgggaagcgtctccggaggcggcagcagaggccgccggacaaggaacgcccagggaaaccttctcagaactaactcagctccggcgctagcagcagaagccgagtctttcataattgtgcgaccaactcctccgggtgactggccacagggacgcgcccgcgcccgcctccgccggcgacggggctggggacggaccacgtgagcggcgc

SEQ ID NO: 339 - DNA, 465778 bp, Homo sapiens
gctggtgcgcaggctcttagcgcgcacgcccagaaagaggcttctccaacccggcccggcccttccttcccctttcccgcagtcgttgcctcctcctcccctgcctcctcctccccttcctcctcctggccgcttagtctcacacccgccgggccgttgttcccgagacgttgttgagtcccctgtgtcctcttctgggtgaggcgtccggccacttaagggaagggaagggaagggtcggccttgactgcatccccaaggctgcctattaggtgtctggaacccgtgctgcttcctctccgatcagtgcccacttatctgtattcagtactctttctctcctccccttacccttgtaggacattttcctggcatttgaggagcctttaattcacgtctggctaccgaaggcatttttaggctagtgttgcttgtagatttaaacgcttccagcacttgtgataatgtttgaggcacagctgagtttagatgagataatgctgtttggttacagttatcctgagtagaaaggcctagggatatcttttcatttttagccgtttcctttttatttaaagattgacaaggggccgggcgcggtggctcacgcctgtaatcccagcactttgggaggccaaggcgggtggatcacgaggtcaggagatcgagaccatccaggctaacacggtgaaacccccgtctctactaaaaatacaaaaaattagccgggcgtggtggcgggcgcctgcagtcccagcttctcgggaggctgaggcaggagaatagcgtgaacccaggaggcggagcttgcagtgagctgagatcgtgccactgcactccagcctgggggacagagcgtctcagaaaaaaaaaaaaaaaattgacaaggtgcaaaatggtgaatttccctcatcatgggctgttttccactaaagcacttctgtgtcttaacacaaatttcttccccgaagagtcagtcatgacatgaccaaagtctgaaaagcagttaatccttaggttaaattttaaagtatgagaccaggaggggtgaggtgcttattcttttgacttgtaaatcagaatgaaagaagggaaagtcttttattttgtggctgttatttaaatggtagagttttgctttgtatagtttttgcttgcttttcctcttttttttctatgatccaccacgtgtatgtcctgatttttttcctttttaacttgcttgctggattttccagccagatgactgccgcttggtcttctgggagtctcctgttaatggggccctcatgcttggctcttgacctgatggccactggcctggctcttggaggacctcctagtgggaggcccagagcactgttattaaggatgattgggggaacagatcagagggggtcagctgggcctggagatcaattttgagggggagggaggttgggagcctgcctggctggatttggaagtcaaaacatgtgtgctgggagaagggcataaccccagagggtggagagccatgtctttctggataaaattaataagtttactgggaggaggctgggccttccaggctgtgttagtttttgttgtgggccttggcttttcctggaatttggttccctttccctaacctttcacttattagtttaaatagttccctttacctaacctttcacttattgatttaaatagtttaaatcacagtcaattaccagctggtttttaaaataatttgaggtaatgaatcttgcccttaatctcctagccagagtggaaccccctacctccacccccagggggatttgaaatgattattttaccagaacgtgctacagagatcacttaccttctcacccgcccacctttttataatggagggacatagaatcaacccaggtggtgtcagagatcatccaaatcagttcttcatgtattcatttgttcactcatcttgtccacatactttgggcccagaactgtggtagtctctgggaaagtgcagatgagtaagacttggtctctgctttcaagctttcatccagtttgcttcaatccactttgatgagggagattatgtgatagtgagatgagtacattgaaaaggtatgccgaagactcccaggagttgagagaagggcaaatggctcaacatggggaagccatttggggaggacttcccagaagggaatactggagccgagttccaaagcctaagtatgagtgggctggagaaagagcgagggattatatgaaccgggaacagcatgtgcagaactacacaagcatggcacatggttgattaggatggctgtgcaggaaaggataagttggaaaaaatcacctgacaggaggctggggagggtgaaggccaggtcaggaagggtctggtgaatcatcttaggggagtttgaaatatatctccagggcaaacagtgatacatactctcaggtttatgttatagaaaattaattctggctgcagtttggagaatgaattggattggcgaagcccggagagaggtaattgtagtaatataggtgagagacgtgttagggtaatagttatgggagtggagagagattaggaaaatagaatggttaggaatgttataaaggttcagtgccacaaaagaaatagcacttgaatatcaaattttcttttttcttctcagcaaggccatttacttctatagaagggtgcgccctcacagatggagcaatggtgagcgcacacctggacaagggtgggggggcgggtcttatgcctgacgcacgtggcccctgttgctgtgtcgttcccctattggctagggttagactgcacaggctaaactaattccaattggctaatttaaagagagtgacgatgtgagtggtttggcgggaaaaatggttatggcagagcaggaaatcggaatgagtcagggtggagaatgagcaggtaatcggaatgagtcagtgagtctgggtggagcaggtgatcgaaaaagcttgctttatgaggacgttaaatttaaaagtagaaaagaattgaacatactgacatattgattctttgaagagaaatttagagctcatatctaatggaaattaattactgactgaatgtagggataagaaggaatgtagtcatcagtaggtgttcttgagtgggctattttgtagcagctttagtgaggaataactgacatccagtaaactacgtattgagagtgtctaattggagaagttttgttatatgcatatatctatgaaaaccatcatgaccatcaaaagaacatacctaataaccccaaagattgcttgtgccctttttaattcctctttgtataccccctaaggtaaagtatgtattcaatctttcgtccattttaaaaaatgagccttttattttctttttattgagctttgagaattctttattcttatcataagttctttatcacgtgtaacttgcagatattttcttattttgatgcttgtctcaacagtgtcttttgaaagcagagttcttaattttgatgaagtctaatttataatttggttaaataaatgttaccaatctgaattataatggatcatgctttttgtgttttatctaagatatctttgcttaacctaaggtctcaaatattcttcctatttttaaaagaagttttgtcatttttggttttatattaaatctgtgatcattttaaggtaatttttgtataggacatgaaatatggaatcaagttttttttttgcatatggctatccagttccagcactgtttgctgaaaagcctatcttcattgaattgcctttgcacctttgttcaaaaatcaatttaccatgtatacattggcccaattttgtgttttattttgttcagttgatctcttgtctattttaatgcgaacaccacatagtcttataaatacagctttgtaataagtactgaaatcaggtagtataagtcctttaattttgttctttttaaaatttgttttgattattctaggttctatttccatatgaattttataatcactttgtccatttcaaaataaggcctatttagattttaactggaattgtattgaatgtatacattaatttggggggagaattgacatttgaaataccaagtcttctgacccgtggacacagtatatctgttcatttatttaagtcttccttatttctctaggcaatgttttgtagctctcaatatgtaggtcttacacatctttgttggattatctgtaggtatttcctattttttgatgatattgtaaatgatattaaaattttatgtattttaaaaatttattttccagttgttttcttgttactggtatattgattgtgtatcctgaaatcttgctcatgtgcttattatttctaagagcatttttgtagatgccatcagattttctatttaggtgatcctgtcatctgtaaataaagatagttttacttcctttccgatgagattgccttttatttttcttgctgtattccactagccagaaccattgctttgcatagaactgatgagagctgacatcttgccttcttcctgatctgagggagatgcattcattttttcattattaagtatgatgcatgatgctagttgtatatcttttgtagatatgctttattaggtttaggaagtttcattgtattcctactttactgagaatttttttaaaggaataatggaagttgtaattttgttgtttttcctataactgttgtgatcattcttttttttttttttttttttttttgagatggagtttcgctcttgttgcccaggctggagtgaagtggcgtgatctcggctcactgcaacctccacctcccaggttcaagcgattctcctgcctcagcttcccgagcagctgggattacaggcacgcaccaccacacccagctgattttgtatttttctttctttcttttttttttttttaagtagagatggggtttctccatgttggtcaggctggtcttgatctcctgaccttaggtgatctgccctccttggcctcccaaagtgttgggattacaggcgtgagccactgcgcccagctgatcatttatatttttaaaaaagattcttaatgtggtgaattacatttattggtttttttttccaatgttaaatcttgtgttcctgagataaaccctattggtcagggcatattatcctttttttatattgctgaattttattagctgaagtttgaagaatttttgtatccatccttatgatggatattgatctatagttttcttgtatcagctaaatacctgacctctcggtaaatctggcctcgtagaatgaattaggaagtatttcttccattttgattttttctggaagagattatgtagaattggtatttttgtttcttaaatgttattgcagcactattcacaatagcaaagacatggaatcagtctaaatgccggtcaatggtagattggataaagaaaatgtggtacatatgcaccatggaatactatgcagccataaaaaagaacatgatcatgtcctttacagcagcatggatggagcaagctggagaacattatcctgagccagctaacacagaaacagaaaaccaaaaatactgcatgttctcacttataagtgagagctaaacaatgagaacaaatggacacaaagaggggaacaacagacactgagatctacttgagggttagatctacttgagggggtaggaggaaagaggattagaaaaaaaaataatttattaatataaaaaatgcaaacctaaagtatttaaataaaattgaactttattcagtttgttgaaagtttaattgaatcttattaaataagttttaaaaaataaagccattcacaattccaaaaaaaaccccaaaaaaccctgtttagtaggattcactagtgaagccatcagggcctggagttgttgttttgggggcaggaggttaaatacaaagtcgtttgattacatagatataggattgttcaggttatctatttcctttttcccccagctttattgaggtatgactgatgagtaaaaattgtacatgctcaaggtgtgcaacgcaatttgatatacattgtgaaatgattaccacaatcaagctaattatatccatcacctcatgtactctttcttggtgtggtgagaacacttaagatttactctcttagcacattttaagtatacagtaaattatcaactgtaatcactatgttgtacattagatctccagaatttttctaataactgaaagtttgtattctttggccaacatttccccatttcctcaatccctggtaaccaccattctcctctctgctttaatgagttggacttttttagattcttcatataaggaatatcatgcagtgtttgtctttctgtttttggcttatttcaataggatgttgtactcttaagttcatccgtattgtggcaaatggcaggaatctttaagactgaataatattccattgtgtatatatgtatgacattttcattatccattcacccatctgtggacattaaggttgttttcatatcttagttattgtgagtaatgctgcaatgaacatgggagtacagctattacaccaagtagtgatttcatttcttttggatatatatccagaagtaagattactatatcatatggtagttctatttttattattttgaggaacttctgtactgtttgccataatgctgtaccaatttacattcctaccaacagtgtacaatggttcccttttctccatattctcatcaatacttattctttgacttttgataatagctatcctaataggtatgaagtgatttctcattgtgcttttgatttacactttgctgatgattagtcatgggtgagcacgttttcatatacctattaggcatttgtatgtcatctttgggaaaatgtctattcgagttctttgcccattaaaaaaaattaagttacttgagttgtatacatttttaaaaatatattttggattttaagcccttattgggatatatgatttgtaaatattttctcttttagaggttgctttttcattttctcgattgtttcctttgctgtgcagaaactttgatgtagcctcacttgtttatttttgcttttattgctcatgcttttgatgtcatatccaaaaaatcatagccaagaccaatgtcgaggagttttttgtcgttttcttctaggagttttaatgttgcaggtcttatgtttacaactgtaatccattttgagttgatttttgtgtatagtataagggttcaatttcattctttcgcatgtgactatccagtttttccaacaccatttattcaagagacttccttttccccattgtgtttttgttgcttttgtcaaagggtagttgattgtatatgagtagtttatttctgggttttctattggttccattagtgtatatgtctctttttattccagcaccatattgttatgattattatagctttgtaatataatttgaaattgggaagtgtgatgtctccagctttgttctttcccaagattgctttagctatttggagttttttgtggttccatatgaattttaggattgtttttctctattttttttttaaatgccattggtattttgatagaaattactttgaatctgcagatcactttgagtagtatggttattttagcaatattatttctaccagtctgtgaacatggatatgtttccatttatttgtgtcttcttcagtttctttcatcataggtttatagttttcaatatacaaatctttcacctccttggtaaattttttcctaagtactttttcctttttgatgcccttctaagtgagattgttaatttctttttggggtagttcattgttagtgaatagaaatgcggctgctttttgttatgttgattttttattctacagctttattgatttaatttattagttctaacagttttttggagtctttgggtggttttctatatataatatcatgtcatctgtaaacagacaatgttatcccttcctttccaatctggatgcctttcatttagttttcttttgtaattgctctagctaggacttccaatactgtgctgaatagtagtggtaagagtgggcattctctcttgttcctgatcttaaaggaaaagctttcggctttttgatgttgagtatcatattggctttgggcttgtcatatatagtctgtataatgttgaggtggattccttctatatctaatttgtgatagtttttattgtgaaagtatgttgaattttgtcaaatgcttttgcagaatctattgagatgatagtatttttatcctttgttctgtgaatgtagtgtatcacatttattgatttgcatatgttgaaccatccttgcattacaaggatagttacttacttgatcatggtgaatgatcttcttaatgtgctgttgaatttggtttgctagtattttattggggatttttgcatctgtgttcattgtggatattggcctgtaattatcttttctcataatgtccttgtctagctttagtttaagggtaatggtaatgctggcctcataaaatgagtgtggaagtattccttcctctttaattttttataagagttcaagaagaattttattaattgtttaaatgcttggtagaatttatactctacccaattccctctgagttatgaggctttctactctggctgttatgaatagaactattcctggccttatgtgaagcccactgatttgttctctctaatcctttttggtgcttctgcctcagattgttttcacatatagatgcattagtacggatgattagtactctcctgaatacttggggagtacctttgcaattctctggcattcttcttctgtgcagctctctcctctcttgcccaagattctagcctttttgttctccacagactttcagctctgtctcctcaactcagggagactgctgggcttggcctgtgttcatcctttttgtgccacaatctgcagacatatcccagggattaaacttgagccattgaaggacttatctcattttttcccatctctgtgtgattactctgttgcctgatgtccaatgtcatgagaatctttgttttctatttttttccccattgttttaagcagggaggtaaatatggttcctgtcactacatcttggctggaattggaagcattcaactagaatttttgaggaaaatataaataagggactatctaaagatgtgaggaggggatttttgaggtactcagataccaataataaaggggaacttttaccacttcaaggtgctaagagcatggtgaaggaagtatatcagagggaaaaacataagctataactaaattaggataattttcaataaaagaactattgagtaagtgagggcagcctgaatgcctgggtctagtaacagtaagactgttacatccttagacccaaaggggtgagggaaggactggttaccagaacccaaaaggagaaatcgtgtggagaagcctgcctggagaggatctgttattttagcccaagagaagcagctggcccaggccaactctacaggaaaagaggcctgaccttactcttctccttcctttgaggcttcagctagagctctccattgctcaaacccaactagaagacagaggattagagagtcttggagatccagattattgtccccaggacagatagcagggagggaaggtagagaatggatatgtagttggggaagaatatacagtgacatatgtatagagtgcacttaggaaggataggaaaatcaaataaaaattgttcaggctaaatatattaccagtcccttaaccatctagatttggggctgagctacactgaaatccattgcagattatgctgagagctgaatagcttggattctgctaaacaggctatgggagagagattaagaaaggactcggttgctgactggatattgcaagatgaaaattgagaagaagacaaagtctataaaatgaagaatgaggccaagcacggtggctcatgtctgtaatctcagaactttgggaggccgaggtgggaggatagcttgagcccaggaattcgagaccagcctggccaacatggcaaaacaccatctctataaaaaatctaaaattattgtgtcatgatggtgcatgcctgtagtcccagctactcgtgaggctgttatgggagaatggcttgagcccaggaggtcgaggccacaatgagctataattgcatcactacactccagcctgggtgatagagtgagaccctgtctcaaaaaaaaaaaaaaaaaaaaaaaaatcgagtgatttagacagatcaaactcaatctagttaaccaaatattgggattgtagaattatgtggcagctttgacatttgaataaggctattgttaggatctttaaaaaattgtcatgtgacatagtagaaagaacataggattgaaatccttctctgttattcactgactctatgaccctgacaggtgacctaactgctcagaaccttggtttcccatctaaaagttgcagaaaagattagcaaggccatctggtaagtcactggcaccacatcttgcacagagtaaatgttcataagaaatttattgatgtaagatgagggttggctcaaaatataagtaagtctaaaaagcatttggattcatgtgaagctacatattgataaaacacagataacactaattctagtgaacccttaagggaagaatagtgtatttgacaaggattacctcaaaattcccctcaaagacagtttgtgaagaagccccagctccctttcccttctcccttaaaaagcagattattttttatgttagttagaacaaactatagatagtttgttcctatcaagaacaacttatccttgtcagagattggatgctgggctggatgggccagtgatgtgtcccagcatgtgttgcatccagggggtctccaggaagggagagggaaaaggaagacttcctgtgtgcttaccgtgtgcagctagcccagcttacctcatctccatgcagtgtcatgtagaaacatgggtgactgaagatcattctagttaagtatggtcagtgcctcttaatgctgctgcttctctttttattttagaaaaccatgtcatggaggaaaattacaggaacttaaaatgtatagcatggagaaaagaagacccaacaggaggtcatgagagtcatcttaaaacatttgaaagggtagcccatgtataagggtaaaaaaggctgtttggatgatcctttgggataaaaattaggactagagggtaggagctatactaagcacagttcaactcaatacagagaaggtcttccttcctattactgtaatagctgctcattgagaacattcagacagcacagagagggacaggtaaatggcctccaaacctccactatatttctttttgctggatgtcattgcagtaagcaggttttgtgtgtgtttcctgaaatcttttatgataggtctttatacaatacagtggttctcaaactctagcatccatcggaatcacctggaggcctttttaaagcacagactgctgaaccccaccccagtgtttctgagtcactggagctggaagggggcctgactttgaatttctaccaagttccctggtgatactaatgctgctgctcttctagagaccacgaatggccctgttaaaatttgagaaaataaaagtttgagaaccactgtattgcatgaagaaaatagagcttttgctctattctttattaaaaaataatacaaatggcatcatactgtatcatccaagaacttgcttttttagttaataatatataattagcagctttctttttttctcattcaacagctactgatgtatcaattttagaagtcccctattaataatcatttaatttgcttctagagtgtttgtggatatgttcttgcctttacaaaaaaaggttgtggtggattttttttgtatctttttgatgagtcagtgcataaattcttagaagataaattcttagaagttaaactgttgggtaaaagacttgattttaaaaatggatagatagtactaaattattctatcaaagatagaatcacttttctatgaaaagtgtatgaaacagcctgtttcccacacttttgccaagtgggtattatcaaaattttccagttcctgtttgttaggtgtaaaattatatcttagtgttgttttgatttatattcctacactatttgtcagttgaaagattcctatgtatttatttttctatgaactataagtttgtattctttgcattacaggtagagggaacagtatgaacaaaagcaccaagccttcctttgaatagtttctagtagttttgtagcattgaagtacgaaggttgaggttagggagagaggcagggagctaaggttagaaagtcaggcaggggcctgagcttagaggtccttttgggtcaaataaagatattgggctttattttgggcagaagaagcattggtgctgtttaagcttgtactttggttcgtggtacttttgacagagccatgtttgtggaatggtcaagtctaatgtttaatcttcaaataattcattctttagtcctttcaccttcggccttaaagctaccagaccagggccaagcgtggtggctcttgcctgtaatcccagcactttgggaggccaaggtgggcagatcacttaaggccaggaattcgagaccattctgagcaacatggcaaaaccctgtctctactaaaaatacaaaaacaaattagctgggtgtggtggtgtgtgcctctaatcccagctacttgggagtctgaggcaagagaattgcttgaaacccaagaggcagaggctgcggtgagtggagattgcactactgcactccagcatgggtgacagagtgaggaaaaaaaaaaaaaaaagctaccagaccaggcttcataaactggtaaacataagaatgggccaaagacttcaacccatctgtgacttggcattgtctctgaggggggaaattttgcatgatcgcatggagaatggattttgttgctttatctgatattgtcctcagctcctcctgaatttgccgagatcttacagcagtcagtaaggttggtgagttctttcgttgttttaatttgagtgactttctgggaaaaactgtggatttcggccaatatgctgatgataatagcattgctttgaaggtcttgttctgtagaaaatcatttcatagttaattatgtcagcaaatcaacagcaacctcttgaagaagaaagcagtgaggggagaaactgtgtatatgtttaaattattcagaactcaaagagaggtcaggaattcacatttcaaaaggaggagtctatgtaagaacaaatcattaaatttgcatatcttttccccattatgggcctagttttgtaattggcatattagggattaaaatgaaataaccctgcatttagaattaggaaatgactccccctgtcccccgactatctccctttctgtctccagggtcctggcacaggagtaagaaactatcacatttaaatgtctgcatttagagaactcagggtgtccgttgggtttgtagaagatggactgactctgttgattcacttgtcgggtggaccctttctccatcgtccttctctcctcagtgtgtgttcctatttaaatggagccccctgcttgggagggagactgctccaaagaggagcatggtgcttcagccacaagccacatagaaggcttgctcataatgctgctagaactctgcagaggaagaaagttttttagggtctttttattttaagagatatttgactattttatatattaataatcctctcctccttcacaacccagtaattccccttattactacattacaatacattgtgctcatacaaggaaggtagggagcagagcattttcagttaatatctaatgtttcccacagtaggatttatcgtgacatcaggtagtctgtattaactggatcatggagaaggcatttctaatgatcatctgaaaaggcttcacaggattaacagatttgaaacttcattctctgtgtgcccaggacacaggcagcttggttagtgtggaaagccaagtcatttcagggatggtagaaagagttcagctctggctgataacaaacctgaaattttttttttttttaaagattcttttttttcaatattttactgtaagttccaggatacatgtgtagaacctgcaggtttgttacataggtatacgtgtgccatggtgatttactgcacctattgactggtcctctaagttccctcccctcgtccccccaccccacaacaggccctagtgtgtgttgttcccttccctgtgtccatgtgatctcattgttcagctcccacttatgagtgagaacatgcggtgtttggttttctgttcctgtgttagtttgctgaggttgttggcttccagcttcattcatatccctgtgaaggacatgatctcattcctttttatggctgtgtagtattctatggtatatatgtaccacattttctttatccagtctatcattgataagtatttgggttggttctatgactttgctattgtaaacagtgctgcaataaacatatgtgtgcatgtgtctttacagtagagtgatttatattcctttgggtatatacccagtaatgggattgctgggtcaagtggtatttctggttctagatccttgaggaatcgccatactgccttctactcttccacaatggttgaactaatttgcattcccactaacagtgtaaaagcattcctgtttctacatagccttgccagcatctattgtttcttgactttttaataatcgccattctgactggcatgagatagtatctcgttttggttttgatttgcatttctctaatgatcagtgatgttgagctttttaaaatatatttgttggctgcgtaaatggtcttcttttgagaagtgtctgcttatatcctttgcccactttttgatggggttgtttctttttgtcttgcaaatttgtttaagttccttgtaaattctggatattagttctttgtcagatgggtagattgcaaaaattttctcccgttctgtaagttgcctgttcactctgctgatagtttcttttgctctgcagaaactctttagtttaattagttcccatctgtcaattttggcatttttttgcaattgcttctggcaaacctgaactttaatatggctttgtccctctaagggctttgtgactatcaacaggatattgactctttcaacatttcagtttcctcatgtagatgggagaaacaacatatactttggtaggtgttataaatgtggattctcctctccttttctctgtaaagggaatggcttggtaggtcaacagaagaaggcattataaacaagtaaatgtgctttattggaacacaagggttgaacagaacccttgggagggtgtaagcagggttttatggaagatggtatgggagatctgaagtttaatttctttaaggggatgtttgttggtggagtttggggatgtcatttgatgagtcagattttttcatccatgatatctttaggacctgttctgtgcatttggcttcagccaagtttgggttttatgtttcccttgtgactgctgttggacattacctgtgtggctcttggaaggttatggtttttggccaccattcaagatggttcaccatccaaaactggctcagtttggattcttgtggctgccacattgtgaggcacacatggggatttggtaggttctgtcttttctgccttttggaatccaactttaaatttaaaaggatagccaacttttctactgtctttctgatttaataccatgtccctcttccaatcatctgttagtctttacaaatgggctcagtaaagagcataaggatccccaaaaccctgaaaaatactgagtttctgacctagttggtcagaactgttggaacagtaatgagagcagtaaactggtacctccattaactgctgacttgttgctgtgtcctcacatggtagaaggggcaagagtcttccttgggcctcttttatgaggatactaatcccgttcatgaggactcctttttcatgacctcatcatctcccaaaggtcccactttttaataccatcaccttaggggttaggtttcaacacatacatttttggaggacacaagcattcagaccataacattagactgtcagtttgttaaaattagagataatgtatttttcagccccttattcctagcatcctggcatagtgaaagcacttaatatttgtttgtttactggaaatcaagctgttagatatggcgagaatgcctaggtatagataacacatattaaaagatgtgggtgtcagcaattgcaaaaatgtgaaaacaacctaaatgcccatcaatcaataagtgggtaaagaaactgtgatatatgtatcacacacacacacacgcacgcacacacacacacacatgatggaatactactcagccataaaaaggaatgaattaatggcattctcagcaacctggatgggactggagactattattctaagtgaagtaactcaggaatggaaaaccaaacattgtatgttctcactcataagtgggagctaagctatgaggatgcaaaggcataagaatgacacaatggacattggggactcagtgggaaagagcgggaagggagtgagggatataagactgcaaacaaagttcattgtatactgcttgggtgatgggtatatccagatctcacatatcaccactcaagaacttactcatgtaaccgaacaccacctgttccccaaaaacctacggaaattttttttttctttttttttttgagacagaatctcgctttgttgtgttgcccaggctagagtgcggtagcgcaatctcgctcactgcaagctctgcctcccaggttcacgccattctcctgtctcagcctcccgagtagctgggactatcggtgcctgccaccacactcggctaattttttgtatttttagtagagacggggtttcaccgtgttagccaggatggtctcgatctcctgaccttgtgatccgcccgtcttggcctcccaaagtgctgggattacaggcgtgagccaccgcacctggcctaataaaaaaatttttttaaaagatgtgggtttcaagaggtgattcagtgttggaggtgaaggttgatttgaggcccacactttgagtaagaaggctgtagagtgtctttggtgatgctatactgttacacccaaattttccttctgtgcctcccagtgccattgattctttctggttataaaggaattgcccttttaaagggctctctgtgctcattatttcctttaatcttcacaacaatcccttggagtagttgtatagaattcatgagtctcatacctgtgaagagagacatcagtgaagagacttaccccaagtgagtcagtggtagacacagatgggacaagcatctggtttcctattctgaatagaatatggtgaccctgatattgatttattttttagtgttgtggagaagaattgtcttcatttctcccaaatgcagtgactatttgttagtccattcttcagctccttattgagtacctactgcataccaaatttatttgtgtgtgtatgcactggggatacagaggtggataagatagacgcagcttatgtcttcagttgtcaagacacagtcctgcattgcttagcaggatgacttctgcactccgtcttggagcttcttttgagaacttctgggctcagagactatgtgtgtgatgttgttttctcatgttctatggtgtctgggatcttcagagcctgttagccagctggctccaggaacctatgtgtcatgggttccacaggtgaacttcttggtactggggctcttgaggtctctccagttggtgacaggaaacattccaggtgtgagtggctgaccctcagagtagagaaagggttttgttggtttgtgttttgtttctttggatttacctctgggtttctgagaactgacattttcataatctgttccttctctgcattatgttaatagacttttctggggcaggaagaatttagtggatgtcatttgttagccaaggtatatgtctgcttttttttttccttctcccctcctcccatcaatcaaaggatttcttagtttcttatctgtgaatcactcaggcttccacttaactgccagttcagtttcctccttgcccatcctcccttctcttttctcctctccttcccccacttctttcccccatttcccttttttccctctccccaccacacttccctttcctttccccctcttttccttttcctcagattcttttgaatttttcttgatctgcaacaagccaggtcctttgttaggcattagtgttagacatcagtgatgcataaaagattgttctgctcttccaggagctagataagggcctggttccacttctcagtattcagggaatggattccctgcttactcccttccttcctttggatgccacaaaatgagcacttgactgaaaatatgcttatacgcgtttttacagactacgccaagccacaggtatgtctagatgaaaaatgtgttgtgccattgctacagactctaaaagtttggggaaccatggaagtgtttgggtttcttttgagccagtcttggcaaccttaaaacttttagaactgtctccccttggagggaaaggcgaaaaagaactgaagaggaggccttaagaaattttcatgtttagaggtaaagttttggttagcaagctggtcttttcttcctatttattgttggtagagcccatagagaaacaactattattgccaaatcagctctttccttctcatttcaaatttttccaccatcttagagcatgtaaaaattgttgaaagtggtattcagtcatttctattaagactgaggtgggcaagcttaactcattgttcatcttttttcttcccaatcttagcaaatccctgattgcagtataactaactaaataaattgcacaggacttgtgtacatcaactcccagcaaagtccaaagatcaaagttgaaagaggatactgaattccttcccagatttctgggacactgcttctgtgcactgtcaccaaataaatcctggaggagtggcgccttaagaaatagggtaagctcatccgcttctgggagattgtcatcataggcagcaatcttaatgctctgagatgcttcagagggaaagaaggggaaaagtataaaagaacaatccccacattatcggtttttagctcagtatttgtagcttgtacccccttcttaggattgctaaaacccgtttgcaaaggacagccctctatttccaggtccccttttccttttttcacactgcatttgagcagtttgcacatttgttgaagaatcagccacaaagtctgtggtttcctgtggcacatttctaacaatatttatacaggctattatttaatgaactgtataaatatttatacagaacagtcttttgatcataaataggggctaaaagtcagtccagtccatgctgaggacttggacaggaggctgtttctgtgctttgaaatgtcttgtagactgagaagttaggtatgtcccaggacttgtacgcagcacagcttgaatttctgttatttttctttctcttggccgtccacagtccgtgccctcatttctttccgcctgaccaccctccccatatccctaacagctgttttctttttagagtatttatctttgcctaagaagaatgaaatgaaaccccagttccgactctcaccattcataatgcggtctttggagtcacactgacttagcctcaaaccccagcccctgtgcttctgtaccatgcaactttaaacagcttcctgtctgagaacctcactttccttagctgggaaatggggctcatactgcctacctcacagggttgctataaggattaaatgaaatcatggagtcacatggtgatctgcagctcagagctcaatagatatttcttgctgcatttgttgttcttattgaagaagtaatcaaagggtttggctttcagttttagctggatgttgtggaaggagccctaaacttgccgcaagagactgtggttcaaatcctgatgccatttgctgtttgtggcactttgggcaaattactccacccttctgaggtataataaagtggtgataggtttaccaaactgattgggtttctgtgaatgagattaacattgtgtgggaataagtgacacgatgatgatccttatccttgtttactttacaaactagaaaaaggaataatgctttccactttacagttactttactttttgaggccaaggggtactggttgcataagattaggagtctaggacgcagcagatcatattcatgacccaggaacaaagggcatagagggggaagagcaggggacctatgatgcagaaagtcctttgctggagctcacaggtcgaatttcagggaagctgcccaagggcttgaacatccctgctttcaggttccaggtatggaaataatcacagagatcagttaaaactataataatgggaaaagtggtgaacctgaaatatgcaagtaggatctatttcatagaaaaacatgaactgggtgatgtgtgtgaatgacgctgggatggtttgactctttgctgcatggtgccctggtaataagttatagaaatccatattttgctagaagcaggccacctggtgttgtggaagggtcagtctctgaagatgaacagcctgggttctgagtcagccaaccttaggcacagcaggcagaggcccccagcagagtccttgacaaatgggcatttagtaaatagaggaatagcaggaggcagtggagcatcctgagaaaggttagggctgatggaaccggagggaatggattactgtcaattgtattactgcctagtaatatggcatactggagcaagttactttacctatctaggacttattttcctcatcagtaaaatgggagtgatcatagttattgtcttcaagaattgtggtcaggcattgtaatcaagctgcttagcagaatatcagatatgtggtaaacatggtacctttttttatttccccagtgatgaattttaaagacatccattcactgagttacaaggacttactgagctcctgctgtatgccaggcactgggcttacagctgtgacacaggcggcagctggaattaactgtaatcataccgctccattctccatgtgaagggtgggctcctgccagaaaccagaactggagcaagcccagggctaactgtagagtggaaatctgcctctttgggttttactggaaaggaatcagaatgtgggtagggtggtaagatgatgtattttatcatattactctcttcatcagagagggagtcaaaagtgaggaacccaagcctgagcacgtgggccagccccatggggaatctgtcttgtcatcggggctggctggagtagagacaagtctggatgctggctggccaggtctgtgtaagccagggtattgaatagatttttcatttcctatttatttctttgtttcttcctaagcgtttatagtagtcttgcaaaagtcttgccaagggcaaagagttgttagcatgctaggatcagtgttaaggagcagcaccccgggggcctttgcagtagagacagtgggaagcccagagaggggattccaagtaaagtaagcagctgtgagaggttggtagagggaaggtagagtggctagcttcaatcttcttcctgtttgcagctaataaaattgaggaaactcagcgaaggcattgcccctattttgtcaatcagtgtatcctcagcaggcttcctggtgttactgtcttctgcatttcttctgagtctcagatgtcactgattgcaagatgcaccattatttattattaccatgaagtaagaaaggaaatgataccaattaattgtaacataccattgattgtaaggttctcactggttttagagaagctaaatatggaaaaatgagtgccgtagaatgaataaaatgtggttgtaaaatgaataaaacaggcatggacctgttcatccttgtttctgttaattcattgattcagttgttcattcagtaaacatttactgaaaacctattatgtgccagacactgtgcaaggagcttgggatacagaaatcaataagttcatttttttcagattcagttaggaagacagacatggaaagaaaaataaaattgtgattccagagtggtaagttttaaaagaaagcagggagaagataccatgttggcatcctttgtatgtatgcaaggggagaaagggaaggaagccttttccaaggagaattgatggctgacctgggtcttaaaatataattcagtggtcaccaggcagacaaggaaaggagagaattaggaagggatgagcaaaggattggggcagcctttagcagctgggggcaattgagagcttatgaggagtttgaggatgtctgtagcctggagtgagaatgagcaggactgtattaggcggggctggatggcaggcagagggagcctgtggagggtgtgagatcccgtgctgaggccctggggtatatcacagctcaaagctggtggttttcagttgtcctgagagagggcctagcagagggactgctggggggaagggctggagggtggggcaagggcgatctttgcttcagagcagctctgtttttatctgttttgttttcttcaaataatggcttgaagaaaaggtatcactgttgaatgaatgaaggaatgaatgatttgaaaactggtgctaatggtcatatggaggtccccaaggggaatgtaagcaagggagagaagttgaggttacacaccagtggaggtctgatgaagctcctatgaacggagcaaatgttacttctgcagcttctccattttatttttcacctgctcatgagccacagagccaaaagggggacaattctgttgggaaatcattgtgattaagacagaagcaattacttttaatgaagtttttattgttttatttgttttttactggagtaaatatctaggaagcagtaactgaacatctgctggttgattttctttcagaatctccatgtttgacttggctagggaaacattttctttctgaagttgaaggatgcagaaggttgcccaggttgaaattagactctgggtggtaaaactgccttgagctcacctggagagttgtagggcatccacctgctcagttgtgttgggggcttgttcttattctttcaaagccaatctggaaaataaaagcctctatgagattccatgtcatgtgggctaatctgaccaaagggacttagagcagccatgaaggccaaggaattcctgaatgttctctggtcagatttccttgtaactcacaaggggtctgtaaggaaaacagattgtctaactaattgctgatcttgtctcctcggggttccttcccaattcccagtcacttcatgacaaagctgcaatatatttgcctcttctccaaacctatacagaaagcttttaagaaacaaaggaaagagcatgaaacttgggattgcacaaatatgggactttaggtccaggctgcccctgaatgaagctgattaaattccttaacttctcatagacttgcttcttaatcagtgtagtgtgtatcattataataatgtacatttactgtttgaatttatgagtagacctagctagcattaagcaaaaagttacttatctcttggaatctcaccttgaccacctgtaaaacagagatgtaaatagcctcaccttctagagtcatagtgaggagtaaaggggacataagcacttttcacagtgcttgcgtgtaagaggtacttagtaggtaattgttgaatgaatgactgactaggaggacaaggttccttttcagtaccttggcttctgttcttgttgattgaaattcactgagaagaaactcatctccattgcctccagattctaagttctcctaccaccctgtacttgcccttacagcactcatcacaactttgcctaaataattatgtatttaaatcctgactctctctcaagagtggaaatgccatgtctgaggccatatctgtgctgttcacccaccatgtagctcaatgtttattagtatactgttatcactaaaaatgtttgttggatgaataaataacaaatggctaccggttaggtagcggtacctcttttatttctacttttgagatgttttgtgactgtctttgcagatccacttggtcttcatatggtttttacacttgcttactataggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaaggtatgggcaaaactggtgttctctccttgttcatattcctacctgctgagtgtcgtgtgtcaatctggtgccgtaaacaatgttggggtaactttagatgcagaggtaagcaagacataggccttgcccttcaggagctcacagtctactggcagagactgataaacagctaatatatggtaagagctgggatcaaagtaactatagctggagctggggaaagagctaaccggagggggctcagggaagacaggacagcttgaggtgtgaccacatgtggaagaattcactgatcaccttattaacatttaccacgcctttaatgtgtgccaaaggctgtgtaaaatgtgttaacttgcactgtgtagttgcatcttcacatgaccctataaaggtaatactgtcactacccctattttattgagggagaaatgtaggcacagaaaagttaggtaacttactcaagttcacacagtaagtagcagaggcaggactagaacaaagcagtctgactccagaggtgcgctcttttttttttttttttttaattaaaaaaagttcaatgggtttttggggaacaggtggtgtttggttacgtaagttctttagtggtgatttctgagattttggtgcactcatcacccaagcagtgtacactgtacccaatgtgtagtcttttattcctcaccaccccccagcgctttcctccgagttcccaaagtccaattgtatcattcctatacctttgcctccgaggtgcactcttaaccattggactctgctgccttccaagtggacaaatgaggatgagaggaactgcattttgggcagagggaatagcatatgcaaaggcatggtggcacgaaaacatggtgtgttctgataaagcaaaggagtcagattagagtgtctcccatatatgccaggcatatgttcaccctgagtggccttggattggatgcagcctgctggcttgggaaggaaagcaatgcttcacaattcttgtttgtttttaaagtttcacttgactgtttgattttatgtcttggtgatcagtaatgacagaggtccttttgtctttttttccatggggaaaaataaagtcctggattccttcttttccctgttcctagtttagttccttaaatattcatgaggtgcttggtaatttgcagatggacaattcaccattctgtccctattgatcagtctgtttaaactttaatgaattctgggctgctgttagtgcccccggagaagaaggcagagagaggagggagtgggtaggcagtaccagagcattatacaggaataaaagagggatgcatcttctcttttgcccatttaattttcctctcctctcccctcctttcagcccccaatctggtaagaatcttctactctttgcacttgggccttctttcttcttttaacatacagccttgcttgccgttaaggaaattatcaagaagaaaatataatcccctgatgaaaagctactttaaaaaaggtctactctaagtacagctggtttaatggtagatttttaatcatctcccagtggtggccaacttatcatctgtttgagccctgttagctgcataagtaccatggacatctgtcgatagcaatgctattgcactatagcaaacctaaatgaagcccttgggtcttaggcgattctcctcagatggagtatggatatgtgggcatgtgccagaagccacaggataagcatgttacatctatatggaacatcattgctggtgtgaggcttagggagggaagcatttttatgttagagagataataacaccataggaatgagagaggtaggtgacctgttatagagcacagattctgcagccagactgcctagattgacatcccacttacaacgtttattaggttgtgatcttggacaagttacctaatgtttcttgcttcagtttccttatctgtaaaatggaaatgacattagtacctacttccataggattgttgtgaggattaaatgaattaatgcacataggatgtcataacattgcctagaaatgtgtatgggttgtttcctatggtggtgctgatggtgacagaaaatgagcagattatagaagatagtgaatttctaagacaaaatactgaaaagtcaaagtctacggcgggggaggcgcttcttgggaatattcattcactctcctggttagggttcttactgtgtaacactttgagaaacactggtctagggcaaagggtggcatcagatatgtcctggtctgtcttttcttcctcatggactccaggaagttgagagcttcagagcagttgttctaattccttttccctaagtcattcacattgcctgagatgactttcctcttagttaaagcaacagtaaggataatgtggtgtcaatgatgatgacaaagacagctaacagttcttgggcacactggtccaggtactatactgaagagcttttacccatcacttcattttatccttataataactacttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaataactactttttaaggtagttttgattgttctctctgttttgaagatagaaaaacaatgagctttgaagaggttcagtaagcagcctaaggtctcctgaataagaagaaggggacgctgtccctgccactgctactgctctcatgctctgtcccttgtctctctccagccatatctccctccacatgaccctacctggaactgataagaagtagcctgaaatttttagattttctacacatggggcatcatgaggttacccaggattacgagtgcctttacctggttgcctgctcatctgggaagtgtgtgccccctcagcaggggttatatctagtttatctgtatttctctagaattctttgcttgtagtgtgttcaattaatgtttgttgagtacataaatgaatgatatatctctgttgtttacattgtctggaatactcttctcttaacttcctcacctgcccaactcccaccttataaagtaagcttaggcggggcgtgttggctcacgcctgtaatcccagcactttgggaggccaaggcgggcggatcacgaggtcaggagattgagaccatcctggttaacatggtgaaaccctgtctctactaaaaatacaaaaaaaaaattaaccaggtgtggtggcgggcgcctgtagtcccagctacttgggaggctgaggcaggagaatggcgtgaacctgggaggcggagcttgcagtgagccgagattgcgccattgcactccagcctgggagacagagtgggactccgtgtccaacaacagcaacaacaacaacaacaacaaaaacagtaagcttaaacattcctgtctcctgagtgtcttccttggtgacttctgacagtctatgcccttttttaccaacctcagcagaaagagagggtgagaagcccctctctactgtccagagcccaccatcttcacccagatcactttctactccttatctttgcattttacttgttggcttgtttacccccttttaaactatgagctgagctcttagagagattcatctttatgtctccagtatctaacacattgcctggcacaaattaggtgctcaattaatggctgttgaatgaatgttacttagagctaaaaacaaagagacaaaatccaatctagcattccttatcttgtttcagtgtcactgtggggcaggaaggacaactattcttcctatttgaaatatgaggaaattgaggctctggaactaacaagtattggagacaagaccagaaccctggtgagatggctccaaatcttcctctctgtcttcctccctacattccctaaatttggcaggttttattgggctggtaagccgcacacctaagaggttttatggaaactcacaagtcatagaggttatatgcagtccacgattttaaaggttcctttatggagccacaaatcttaatcattccaaaaaggtgagaacatttcaaattagtgcatgattcatactaaacttctcttaggaagaaggagaagataagctggaggaatcatttagccaacaggtgtttgttgagtatcattctttcatttagtctgcaaacatttattgagcacttaactatgtgctatgctctttgctaagcattggagcatatagaggagacgtatacaagaagtctgctgcttttaaagatgaaacagcttaattgtatgagaaaaataaacaacacatatgaagccagtaaagtaccattttgttctgtcttggtgctatctatatgagtagtggttgtggggagggggacagaagaaagagtagccacatgtcgggttgagcaataatgttaaccttatattcatagaaccattatagtttacagtgcatcttcattttcatttgattgctattgcagggtgaagtagggaagaagttgttattcccatttacatttgaaaaactgagggccagagagttaagtgattttcctaaggtcacccaggtggtatgtgataaggcagaactcagatgggtcaaacctatgcattctctctatctctagcaccatatacctttatattttgcatggaatattattccaagaacctaactgatgtcttgatattcatttttcttttctctattcttgcatttgaagtgttttttttttcctctagtgctaactgatcatgtcactcttttgctacagcccttcaacatctatcactctactacaggcataatgataaattcagttccagaacaccataatgaggtgaatattgcaacaaagctcacatgaatttttgagtttctcagtgcatatgaaagttatgtttacattatattgcagtctattaaatgtgtaatagcattagtctaaaaaaagtatataacttaatttttaaaaattgccaaaaaatgtgttaatgatcatcgaagcctgcagtgagttgtagtctttttcctggtggagggttttaccttgatgttgatagctgcttactaattagggtggtggttgctgaaggttaggtggctgtggtaatttttttaagtaaggcaattttttaagtaaggtttgctgcactgattgactctttctttcacaaaagatttctctgtagcatgcaatgttgtttgatagcatcttatccatggcaggacttctttcaaaactggagttagttctttcagaccttagccttatcagttaagtttatgtactattctaaattgtttgttgtcatttcaacattgttcatatcatctttatcagaagtagattccatctcaagaaatcatttcctttgttcatccataagaagcagcccctcatcggttcatattctatcatgagattacagcaattcaatttcatcttcagggtccacttctaattctagttcgtttggtatttccactacctctgcagtaacttcctccacttaagtcttgagccactcaaagtcattcatgagggttggaattaacctcttccaaattcctgttaatgttgatattttgacctcccatgaatcatgaatgttcttaatggcatctagagtggtaaatcctttccagaatgttttcaatttactttatctagatcaattagaggaatcactatctatggcagctatatccttacaaaatgtaattcttaaataataatacttgaaagctgaaatttctctttgatccatgggctgcagaatggatgttgtgttagcaggtatgagaacaacattcatctccttgtacatcttcatcagaactctttggtgactcggtgcattgtcaatgaggagtaacactttgaaaggaatctcttttctttgagcagtaagtctcaacagcagggttaaaatattcagtaaaccatgctgtaaatagatgtgctgtcatccaggctttgttgttccatttctagagcacaggcagagtagatttagcataattcttaagggccctaggatttttggaatagtaaatgagcattggcttcaacttaagtcaccagctgcatttgcccctaacaagagagccagcttgtcctttgaagctttgaggccaggcattggctttttgtctctagctgtgaaagtcctagatggtatcttcttccaatataaggctgttttgcctaccttaaaaatatgttgtttagtgtagacaccttcattgattgtcttacccaaatcatctgtataacttgctggagtttctacatcagcacttgctgcttcaccttgtgtttttatattatggaaatggcttgtttacttaaacctcctgaaccaacttctggtagcttcaaacttttcattctgtagcttcctcacctgtctcagcctttacagaattgaagagttaggactgtgctctggattaagctttgacttaaagaatgttgtggctggtttgatcttctatctagaccactcaaattttctccatatcagcaataagactgtttcactttcttattcaggtgttcactggagtagcgcttttagttttccttacgaactttcttttgcattcacagcttgactatttggtgcaagaggcctatctttttgccagtcttggctttccctatgcctacttgactaagcttaatcatttctagctttacatttaaagtgagagactatgactccttctttcacttgaacatttggagaccattgtagggttattaattggcctaatttcaaagttgtgtctcgggggtagggatccctaaggagagggagagagatgaggaatagctagtctgtggagcagtgagaacacacaccacatttatctattaagtttgcccgtcttatatgggtgcagtttgtggtgccccaaaacaaatgcaatagtaacatcaaatattatcatagcagatataatattaatgaaagtttgaaatattattaagaattaccagaatgtgacacagacatgaggtgacatgagctattggaaaaatgacactgatagacttgctctttgcagagctgctacacaccttcaatttgtaaaaaacacaatctgcaagatgcggtaaagcaaagcacaatgataccagatatgcctgaggcatacctcaaactgcggttttagttccagaccactgccacaaagcaaatatctcaataaagcaagtcacatgaattttttgattccccagcatacataaatgttttgtttgtgctgtaccgtagtctattaagtgtgcaatagcactgtatctaaaaaaaaggtaccttaattaaaaaatactttattgctaaaaatgctaatgaagtgagcacatgctgttggaaaaatggcagcaatggacttgcttactgcagggttgccacagacgttcaatttgtaaaaaatgtaatatctgcaaagtgcaataaagtgaagcacgataaaatgaggtatgcctgtatttgggtagaactcaatccttaacatggccttcagggccctacatggcctgtctcgacttgcattcctggctcatctcatgatgcttctcctggctctctgcattccagccacaccttccttctgtcatgtcctcaaacatgcaatgctccctttagcgtaagaattgttacccagattctttcttctggctgcatatccttcctaccttccaccagcatatctaactcctgttcatccttagacctaagctatccaatccaatagttgctgaacccacaatgccatttaaatttatagtaattacaattaaatataattaaacattcacttcctcttttgctccagccaaatttcaagtgctcaatagccacatggtggctattatactgaacagcacagatatagcacattttcattattgtagaaagttccattggatagtgctgccccaaaccttaattcaaaagttagttcttcaaggaaggagcattttctctaccaataccacctccaactaagtcttatttcacttattaaatgttttcacagtgccttgtacgtctctttcatagaactccatgtggttcgtgaatcattcattttttgttatcaaataataaaatcattctataaatcaagaataaaataccataaaatgaaacaaaataataagatatttcactttttggattaatgtatgtcttccctactagattttatgtttcaggagggcaggagctatgttttgcttacccagagcctgggttatattagacccaggaagtgtaaaaaaaatgaagggtcaaaagaaattgagagcactttgggaggcccaggtgggcagatcatgaggtcaggagtttgagacccgcctggtcaacatggcaaaaccttgtttttactaaaaatacaaaaattagctgggcgtggtggtgtgcgcctgtaatcccaactactgaggaggctgaggcaggagaatcacttgaacccgggaggcggaggttgcaataagccgagatcgcagcactgccctccagcctgggcgacaaagcaagactccatctcaaaaaaaaaaaaaagaaaagaaaagaaatggagacctccctacttctacccactggagaaaacttgagaaaggatgtagggcaaaaagtgactcttgaactcttaagagaagacaattggaactggaggaatagaatggtcagaagcgctgagatgggaacatcaaggatcgaatcctagctgtaataggtggtttctaataggaagaaggaaagggaggctagaattgacgatacaggggtaggtgagacagctggctcagaccaatggggagctcctctagaatcatcctgagtttgagattgaccagtcttgcaacagattcagaatggctggcagagaagaaactaaatttaaggatgtcaggaggcagacatcctgatgagtttcagaggctgagatttttttttttttaaactataaactttgggaagactgggaccacgtctctcttgaccaggatatgttctctgtgtctggcacatataggtgcttaatatttttaataataaatggctagattagactattggcagaggaataaataggagggctgagactgagaggctttaggaaggcaggcgtaactggacttggcaacaatggagaggaaggaggtagaggctatttgagtttcagttcttggcagaatgttggggtcactgatataaatgagagtatttggcctttatttcatcatcttatcatcaaatggcaataccatacctaagctgggatgctacgtaggtaaaggattaggactgggtttatttacttcactggtcactagagtagcttttacaaaattgactgccttcaagggccttccaggtaatgcacgccccaacacaagctgtatttgtcttcttgctgttccccctcccaggacctctgcgctcgctgttcccctgcctggaacactcttcccccagatttccatgaggtccactcctcatgtctttcaggtgtatcctcaaatttcacttgcatcttgcataggaaccacctcctccttgcattcctaatccccctgagtaatcacttgctagtatactatatctacactatgtaatttatttgatttattgggtattgtctatccctactaaaatgtaatctccaaaagagcaaggattaaaaaaaaaagtttttctctccattgtttttccaatacctagaagagaaaattctgcacagcctgaccctagaaggggcttgattattttcgctaaggacttatggctaagtgagtgattgaactgtgtaaccaacaggtagtgatggagcctgagggaactggtgattgcataactcctcgcacgcccccaaagctgacaaaggcattcaaatcaagatttaaaagaatacagtacctgccactcagaactctactgcaagctggattatgtctatgaagccccaggctttgacccttgctctaaatagagctaaggataaaaccaggtatgcatctgaccctccagttctcagtttggagggtttctaagaaacaccatctccccacccaatatggcagatcttgctgatttaaaacacatgcagaattgaaccatttcccacaataagaagaaagtgatacacaatcccttccccaaatatttgtttgctgccccatagctacgagttgacagttgttagacatggaacaggttaccaaatgaggttgcagaaatctctttctctggaaattctttagaagagcaatgtgctttctctctagctagggaaattctcttgattccaagctgttacaatgagattactgggctgctttcttcttccattaataagaatataaaaaagaattcttaggtcaccaggtcaagccccagaggccttctgggtagtgtgactctgacagtcatctttctgggatggtttagatggtgtggggtgaggggttgggaatggcgatgttcctcagctgtggatgagcatgatcataaggcatttccttgtaaggctggggaaatagtagtggctacctagctagatcaggtttaaatgcatgccacagttactcttccagtttcttgtgagaggtctctgtttgaaagatagagacgctgagtctttgtgactgaaggccatgattgtaatattgagcactctgtaggtctgttgaggggattcataacatacattgaagaaaatattttccttgctcctactaggttactcccgccatgattcttagaaagatttgagtctatccaattttttctattcctactctttttgcttgtcatttttatatgtgcttacgtgacacagagagcaagcatgctgtgctttgtacataaaaacattccatgaacacaataaggcattgagtgcatttcctatcctattttctataaaggtttactggtttcaaagtaatttcagactccactgatcccattcaaagcctttgattcttacttgggaggtatctctcactcaggaaactgaggctcagaaagttgatggagttagtgcaggattacctgacctagaagtggtggagttggcaccagaaggaagttctttggacaccacatcctgtgtttgtttctactcccaaactgccttgtggtatggagtttgagtcatctatattttctcacccaagtcctcttttgactaactgcagacctgtgtgagatgggcttacccaagtcagacatgcactttctgggcacagaagccaattgggccacatagcaagtagaagttagggctgggtgattgattgattggtatcccacatggaaagatttgaagcaactaatttgctctaatataaactgctacttactgtgcactgatgccagatgttgagctcatcacaccttattttgctgaattctcatatcattgggagatgcaggtttaggtaatagttttgtactgccaaggaagctgcttatctgacttcacaaagttatataactcggaaatagtagaaccagatttcagactcaggtcttctgcccccaaagtcgctgatttaactactatccagtgatttccaagccaagttgtaaggacattccaggcagaaatagccatacctgtaaatgctatagaaacatgaaccagcaaagcaagagaggagttgcaatggctagaattgtgtaacttgccttcagccacgtagccatggtggcagagctaggatttgaattcaagtctttgtgactcattgtcatgaggccatactgcctgtcaggaaatgggtttggtcctcacactgtaagtctagatagatcagtgtggtgaaggcatctgggtattcacttggtactgtgggtcaaggtactaccagcagtcacagatgggtcagcagcaagtgttctctagatcacatgtcctttccacaggatgagtctcttgggcaacaggaaattatctgatgacagaggtgagcagtatggtataatggaaagaaaatagacactgagtttgaattctggctctgcaatctactggctgtgtgacaagtgcaagttccttaacctctctgtgcctgctgttcaccctttccctcgccaatcatccacttcttttattttgttttattttttttgagatggagtctcattctgtcgcccaggctggagtacagttgcatggtcttgggtcactgcaacctttgcctcctgggttgaagcagttctcctgcctcagcctccctagtatttgggactacaggcacatggcaccacacctggctagtttttgtattttttagtagagatggggtttcatcgtgttggccaggctggtctcaaactcctgacctcaagtgatcttcccgtcttggcctcccaaagtgttgggattacaggcgtgagccattgcacccggcccccacttgtttttcatgaaaaactaatattaaatgtttcttttggagggctttgtaaggattaaataatatgtatgtcaaacatatggcacatagtagatgttcaatatatggcaatgctttattaatatgacttgaaaaaaattactgcttttcttttttggacatttctcataattatgtgaagctcttgtttgaggaacatgttaaatagtaagaaatggaattctaaattataaatctggtatttccaaacaggaaaaaaataattatatattttaaggtgaatttcactaaatgaggatggacatttttgagttgacttttatgggatttaaaaggttgtagtcatgttttaagttaatagaaactggtcgctcatgctttttctataaaggaaaccatagaaacaaaaataaaaaatagaattaatcgataaatctattattctacaactttaaaaattatacaaacaagtgtaaaatctatatcctcctcctgcagttccaccctcaggagcaaccactattaacaatttgttgcatattcttttttttaaaaccttactaatatatcatggatgtctttccattttatctttcatagctcaactcgttttaaaagtatttaacagcttgatgtatgatttatatatcataaaatccagccattgtaaatgtataatgctgttattttgtaaatttatacagtggtgcaatcatcacctactccagttttagaacacttattactccaaaagtttccttacacctgtttgcagtcaaccccaagccccagtcagaggcgctttctgtctttataggtgttctttttagaaattttatataaatagaatcacatagcgtgctttcttttatatctggctcttttcacttagcataatgtttttaaggatcatccatgttgttacatatatcagtagttcctttttcttgctgagtagtattctgttatatggatatacaatactttatttaacagttggttaaactatgatggatatttggttggttttcagcttgggaatatcaataatgctgctatgaatattcacatacaattctttgtgttgatgtatgtttttattttattttatttggtttgttaatattttgtattgaagttgccgggttgtgtggtaagatgtggctgtattttacatttccatcagcaatgtataagggcatcactttctccacaattctctaacacttggtattgtcagtctttgtgataatattctagtaagtgtgcagtagtatcttattgtgattttaatttgcatttccttagtgactaatgatttgagcactttttcatgtgtacattggccatttgtatattttctttgcagaagtgtccacatcttttgccaatgttatcattgggttgtttttcctcttattatttgagttttaaaatatattttatatgcaagtatattatcagatgtgttgtttgcaaatattttcttccagtctgtagcttgtcttttcgttttctaattgtttcttttgaagaaaaagatttttaaattttgatgaagtcaaaattttttcttttgtgggtcttgcttgctttttataaaatcttcatctaatgcaaggttgcaacaatgttctcctgttttcttctacacattttatatttttagtcttacatttagggatgtgatatgttttgagttaagttttgtgtatggtgtgaggtaagagtctaagttcttttttgcatatagtcatatagttctagcatcactgtcaaatagtctgtcctttcccccattaaattatataggcacatttaccaaagccaattgccataaatgggtttacttcttatatctctgttctattgatttataaatttatccttataccaataccacataaacttaggaatgctagttttatagtaagttttgaagtcagatagcatatattttccaagttctttctattcaattttgtcagtttctacaaataagtagataaataaataaataaaacctgctagttttttttttttttcactttaagttttgggatacatgtgcagaaagtgcaggtttgttacataggtatacatgtgccatggtggtttgttgcacccatcaacccatcatctaggttttaagccccacatgcattaggtatttgtccaatgctctccctccccttgccccgcaccccctgacaggccccagtgtgtgatgttgccctccctgtgtccatgtgttctcattgttcaactcccacttatgagtgagaacatgcggtgttagaaaacctgctaggattttaatggagttgtggagaatctgtaggttaatttgaagagattaccatctgaacaatgttgaattttccattttacgagtgtgacatatttctccaatttttagctcttcatagcaatgtttggtagttgtcagagtataggtcttgaacttcttgtgatatgttaattcctgaatgtatttgtcaggtttctccagagggacaaggccagtaggaaatatatatgtatatgtacatgtatgtatatgtatatattcatatatatatatttatatgtatatagtcatatatatatatatatatatgaaagaaagtttgttagggagaattggatcacatgattaaaaatgtgaagttccacaataggtcatccgtaagctagggaatgccagtagtgtggctcagttcaagtccaaaagccttgaaaccagggaagccgacaatgcagtcctgaataagtctgagggtgaaggcctgagagccccaggcaggctgctagtgcaagacctagagtccaaaggaagatgaacctggagtctgatgtctaagggcaggaggagaaaaggtgcctcactgcaaaagggagagagggaggaaggtaagcaatctgagtatcccccttgttccacctgctttgttctaatcacacccattactgattagatggtgcccactcacatcaagggtggctcttcctctcccagtccactgactccacatgtcaatctcctctggaaacaccctcacagacacacccagaaacagtgcttcactaaccagctaggcatccctcaatccagtccagttgatatctaatattgagcatcacactgagtatttcactttttgatgctattgtgaatgggattattttcttaattttattttttatcttttagttgctattaagtagaaatccagttgatatttatatgttagtcttgcatcctctcatcttactaaaattgcttattagttctagtaatttttttagcttgtagattctttaggattttctgcatatgagatcatgtcatctgcaaagaaagacactttaacttcttttctaatctgtatgcttttaatttacttttctcactttattgcaatggctagaagctcaagtataaggttgaatagaagtggtaaaagtgaacatccttgcttcatttctgatgggggaaagcattcatgttaccattaagtatgatgttagctgtaggtttttgtagatgctccttatcaggttgtagaagttctcttctatgtctggtttattgaatgttatatttggagggtaggggttcttttttctgcatctgttgagatgatcatttggtgtttgtactttgttctgttaatgtgcgtattccattaattaatttatggatattaaaccactcttgcattcctgggatgactccacatagtcatggtatataaaggaaagttttacatgctggaagatttcgtttgttaatattttgttaaggatttttactatgttcatgataaatattagtctgtagtgtccttttcttatgtatttgcttgactttggtatcagggtaatactggctatgtaatatttgttggaaagtgttcccttcttcactgtattttagacaagtttgtgtagcattggtaccatctcttccttaaatgtttgataaaatttcccagtgaagcatttggacctgtagtttttttattttttgtgggaatgttttaagcacaaatttgatttttcaaaaaaaaagtgcttctcaatttttcacatggctttggccaatttccataaccccaaaatggtggtttttgatagttttgtccagtttattagttttattttgctaagaggattttttgacttcacaccgccacacccagcagttgcctctctacctctttttaaaaaaaatctgtatagtatttcattttacaaacatgccataatttatttaataaaaatagttttttcacttttaaaatatagtctgagcagtgctgaagctaaccttcttctatatataactttacttacttttgctaataagatacgtgcatttttaattttaataaatgtcaaattattctccaaagtttgttgtcattaattatattgttagaataatctccaagaaggtccacttctgcatatattgccactaccatatacaggttaagcaaccctactctgaaactaaaatgcaccataattcaaaactttttgagtggcattgtgacgccacacatggatgtctaagatagtaacatttttgttttctgatgattcagtgtacataaactttgtttcatgcacaaaatcattaaaaatattgtataaaattaccttcaggctatgtgtgtaaggtatatatgaaacatatatgaattttgtgtttagacttgggtttcatcctcaagatatctcattatgttatatacaaatattccaaaatctgaaaaattctgaaatctgaaatgcttttgatcacaagcatttcaggtaagtaataacagcctgtagtattaatcttttatatttttgccaatatgaaaagcaaacagtttgatatctttttgtttgtacttatctaattggaggtgggaatcttctcatatgctctttgaccatttctttttattttatgaggtgactttttattcctttgcttaatttccaattatttttaattattattattatttttttttgagatggagtttcgctcttgttgcccaggctggagtacaatggcgtgatctcggctcactgtaacctccgtctcccaggttcaagcaattctcctgcctcagcctcctgagtagctgggattacaggcacacaccaccatgcctggctaattttcgtatttttagtagagacagggtttcactgtgttggccaggctggtcttgaactcctgaccttgtgatctacccacttcggcctcccaaagtgctgggattacaggtgtgagctgccatgcctggccttaatttccagttagtttggttctttttttcttatttataggatcttttgggattatagtgatactaaatttttatctgttttatgttgtaaagatttttttctattctgtcattccttccttctagttgtaactgttttcaatctttaaagaccctggtgttgtaatttatgtttttatttgtttttaaaacagaaagttgtacaagggattgatttaaaccaaattcgaggacttgggtttgatgccacgtgttctctggttgttttggataagcagtttcacccattaccagtcaaccaggaaggtaagaccatgtctcttccttttcccagtggtgggatacttggctgattaatccaatgggcccaggtggaacaggagggcaggcgtctcttgctgctgatagtaaaatttagaggtagagtgaagtgacacagatcatgttgcagaagtcaagagcttggagagcagttggtatgagtggggtggtgttgacgctggattagggggactaggctttctaaaactcaggagccacagtgcagagcttggtaaaggaaggatatgagattgttagctaggagtgattaaccttgaaacacacaggtggttttgatgttttctgagaagagagtgtcagtgcttgcagtttctttgtatacgatattcctattccgtgcttatctgagtggatgagccaagtcctttgaaaggaaatggaacatggtagacagggccatgtgacagatagaaggtagaagcagatggcctctctattttcagtagccagaccaaaagacattcacattaaatggtgttgtcctaatagacacttgtgagtacagaaatgagctgtttgaaatgtaaagtgctacttgggtccaccatcagagatttttcacagcagataaggttgtcccttttggggaattttagccaataacgtttgtactggggttacaaacccgaaagtctattaatatattaatgtaataattaatacattagtcagatgggtaatgtaaatgagtaataggccaggtttgagaaaaaccactgcacctgtgtgaagataaatttcaactgatatttaaccttgtaatgagcagatgacattagggagcagtggaggctgcattgcactggaaattgcatgctccatctgaagggaagggccagctctaggcattgtcagtcagctgttgccaagatagccattgcaaacatatttggggctagattctgttagagaacccttgattctgcacactgttgcagcagcatctttcttaactgttggctatgaggtagtagggtacattgatacacagtggaattagagttaggcggggactctgattgtagctctgctgttgctgagctgtgacaccttgggcaagccacttaactctgtgtttctcagttttcttctctgaaagaatttgaatgaatcagtagctttgctgtgagaatttagtgagagactgatacttaaaatgctcagaaaagtttcttccatcagatgatgaattttttaagttaagagaatattccggtcactactgtggacctaatgtatgaaatagtgattattataattataaggactataaatgatcatctatttgcatcccttttcactataagtgatcactataaataatcataatcactatgtgctgaaaatggatgcaaatagatgaatgattagagcacagtggtaatgatgaccattttctgcacagacacacacacttttttccctcttcttgcgacatttattaacacctcctgtgttccaagccctgtcttagcaaatgctggggcttcaaagataaatcaggacggttctttttcttggtggctgttcattggctcagttggcactgttctggcccaggacagggcagccttgttctgagccatttcagaaagcagagaccaaacctgggtagagcaaacctcagctctgcagcagcaagcattcactaattacaagatgtggccagccacagacctggccgttttgggaggctgtcagtatatcttttatgggctttatttaagtaaaggtcaggtgattgtttgggatgccatagatcagatgtctcttactgttgatagtgagatttagaggcagagtgtggaggctagaaatcaccgtcccagaagttaaaagcctggagagcaattggcacgagtggggtggtgttgggggcagagttagagggaacttggttccataaagcacaagagccatgttagagagcctgattttgggtggaactttagatactaagagtcctgtttcaaggattttgtatcatctgatctgctaaaatacatgtttacttatttatttttattctggctgtgcattagtatcaactggagatctttttaaaaattgccaattcatgagccctaccctcaggatttgtattcacttgacttgaggtggagctagggtgtcaactttttaaaaaagttttctcagtaagtctagtatgtagagaatcactggggacagattaacggagaattaaaatattaggaacagaacacttgaagtggaagaagacagttccttgttaaatttgcttaaatatgtaccctctttggatgctatttttctttcattgtaggtagaatggcttcctgttaacaaatcctctattaaaaaggtaactaggttatcactctaattataagtgttgaaataactttattccacctaaaaggttaaagtgtacccattcatcaaatgcatccagctgcaggtgccctcatcagtttcttgcctttcaacagattgtattaaggttagatcttttatctgaaatgaattatcctgtgcaagaaaatgaaattagaattataaaggtggtttgaaggttctttagagactcctacctgcatggcagcgaccaactcttgattggctaatgggagtaattgtgaggagcagagagtggggtcaggaagattccagataaccctaatcatgcagataacctaaaaccaaacccataagaccagcaaaagtattgccgtctttagatgttaaccaaaaaattataaacgaataaattaagtacaatagtttaagaaaattcagcattagtctatgataaaatagtctcatttgcctttccttgtttgactcttcttccttaaagatcagaacaacccctgggctggacagcagcacagttgctgaatgcttcctacccctgccactgaccaaactcagagccttaccctgattgtgtcatctcagccataggagctcttgggagggagaggaacaaagggtgataattggggctgggagagggagttatgacctagtctcctctgtgcaacagatacctaatgtttagatttttttgctgattcataatattttttcccctcaagtatgcctgcaacacattctgtgaacataaacatgtattttagcaaggtattaattaagtgaatatatggatgaataatctacccttaggtaaagtgaggtagctcaaatgtaactttacctccaattctcttaaacgacaacatttttgtgggtctgtgttctgtttcccatgctgccttattgtatagaacctctttctcactctttcctcacctgcctagccattggctagtcatttgaagaattaaataaacactttcctgccttttgaaagctttctgtgcagctccaggctcagctaactagagcctgctctttgctcctcctccacattcccatgtctggtactcttgttctggcagtcaacacacagtatagactctttctcctgcagacatatgttgcttaagggcagaactgtggcacattcttcttgatatcctagcatccaacactgtgcttggcatgtagtagatgctcaataaaagattaaatgaactttcagttttccataagagctgaaaaaaattaacttctcagtttttatctaaaacgaaaattattaattctaatacagtaatgattctgtacaattttcattgtattgttctgactgcattttgagagcatctttatgtagaggcagtagtagctgattggtctgtctttactataggcagaagtttagcaacaggtatttttaccttaaagtagctgtagatttgttctgtacagtacttaagaaacaatactgatattgtccccttcaacactcacccacccacacatacacccacatcctgattcattgatggttgtggaataggagctggacatcagtatttttaaaagttatcaaggcgacgctaatgtgcaactaggtttgagaactagagctttgagcacttctgttagatagaggaacaattctgtttacaaaaaattctttgacattcctgtggaaggtcccatgtactctgtattattttcaaagtattagtataatggtttgtggagcttttgtgggaggtgatatctttccagttaggcaactgagcccctgccttgttatgcccatgaccttatttaggtatcttcttacattggctttttttgttgtttttttttttggttttaattttaaacattcttttcaaagatgtggaagggtaaagaaagcaacatcttcctattcgcctaccactgaggataaacatgaaattttgccatatttgcctcagctccttttattttaaaaaaagatatttgtaacttcagcttttcacctcctgcaggtaaccattctgctgtagttgctgttcttaaacacattgtttttgtgcttttactacatatgtgtatacccacaacaacaaacagtatacaatccttcctctgtatctgaggggtacttgttccaggacctccttaagaccataacccacagatactcaagtccctgatgtaaaatggcatcgtatttgcgtataacctatgtacgtcttcccatgtacttcagataatctctaggttacttataatacctaatgttaggtaaatacttgttatactatattgtttagggaataatggcaagtaaaaaagtctgtacacattcagtacagatgcaaccatccatttaaaaaaatatattttcaatccacggttggttgaatccacagatgcagaactcacagacatggagggctgactctgtgttttaaagtatctcagctggtgtccttgttcatgttactatgtctaactctagtttattcatttaagaattgatttatctgttctctatgcagatctagttccaaaatacactttgtgcatttcccagctgtgagacattgggtacgtcttcactttcaagagtctgtcattgaaaaacaggggttaaaaacctgtatcagagggttgttttgaggattaaatgtgatgatatgtgtaaaatgtttagcacagggcttgggagacaaacacacattacaaacatttactattagcaagatatgtagtgctgcggttactttgccattaaataaaataatgtgtgaaaatataatacctggtttggtaactgctgggtttcttttctctttgccctaataatctctcgggtatattaattgctgttctgcaacttttgccatcagaggcatcagagggctgttaaaggatttctggcttgcccattggtacaggatgaattaacagaggctggggagagagataaggagttactgtgtggactacagggtggtaaggcaggatatgaggggcagtgctccttttccagctggttttaaattctcctccttatgattttctcctcctgagggcctactttctgagaagtacttgccatatcctttatgtgcattatcttttgtttaaaaacttcctgaattatacatcttcatctgtaactgtatcttcatctgtaactagcattccctgttagatctgcctaattccaaaacccatgagcttcccacgccagcaaacaagccaaccaaatgaggaaaaaaaaaaacacctacataaactaattttaattaaagtgaccagaaaaagtgggaatataagcagttaaatgccattgtttagctattagatgtattataccgtcaaagtatttatccatatttaaaggagacagatcttagaaagtattgtcttagtcttatttcatagacacctttcctgaatgtatgcccagaaaagtttttctagaacagaagggataagaaaggaagggaagaatttgagagagaatacttgataatataattaattggtagatgttttctgcttttaatgtagacatttattctaaggtcatggtcagagaacacatgactggacgggaaattccaggcctggggacagtgctttcctcagccttgctggtgtcctttcattttgcacactcttgatacataaaattatagaaagtacatagcattttgatcttgggaatccataattgttcccttgaattagaaggaagagaatgtgtgtccatctgcatctccctctcgtttctgctaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagaggtgagtgcatagggtctaagagaagataccaacaatagtagaggattcctgttactgtggacctgtaggtaccaggcaccctgctaaaatcggttatgtttgatttttcccagcaactaggaggaaggttgatcccattttattgattacagtgtagttaaatcacacctgtttttatgtgcctaactcatactaggcactgtgacaagtattgtacacattatctctttgaaggccaacgaccctatgaagtgtttgtgtgtggtgtttattttagggtgtctgttttgtagacaagaaaacgaatgttcatagagataaaacaactcactcaaagtgacaaagtaaatatgtgacagaaccagaatttgaacctaagactggctgactccaaaatcatttttttttaattttaaaatgtttcttttgtagagacttggtctcactattttggccaggctgatttcgaactcctggccttatgtgatcctgcaaaagtgatatgattataggtgtgaaccactgtgcccggccatccaaaatcaattctttttttttttttttttttttaagtatcaatttctcttttaatcttagacgtcgtggtggaaggaaaaatcagttagcaaagaagcaatctcagaaaaagtgtatctttttgatgcctttatgccttttttttcctctttttttttcggttattctttattattatactttaagttttagggtacatgtgcacaacgtgcaggttagttacatatgtatacgtgtgccatgttggtgtgctgcacccattaactcgtcatttaacattaggtatatcttctaatgctatccctcccccctccccccaccccacaacaggccccggtgtgtgatgttccccttcctgtgtccatgtgttctcattgttctattcccacctatgagtgagaacatgtggtgtttggttttttgtccttgtgatagtttgctgagaatgatggtttccagcttcatgcatgtccctacaaaggacgtgtgaactcatcattttttatggctgcatattattccatggtgtatatgtgccacattttcttaatccagtctatcattgttggacatttgggttggttccaagtctttgctgttgtgaatagtgccacaataaacatacatgtgcatgtgtctttatagtagcatggtactggtaccaaaacagatatatagaccagtggaacagaacagagccctcagaaataatgccacatatctacaactatctgatctttgacaaacctgagaaaaacaagaaatggggaaaggattccctatttaataaatggtgctgggaaaactggctagccatatggagaaaactgaaactggatcccttccttacaccttatacaaaaattaattcaagatggattaaagacttaaatgttagacctaaaaccataaaaaccctagaagaaaacctaggcagtaccattcaggacataggtatgggcaaggacttcatgtctaaaacaccaaaagcaatggcaacaaaagccaaaattgacaaatgggatctcattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaccccatcaacaactgggcaaaggatgtgaacaaaatcaattcttttaatacccagtattctattggagttcagagaggttaattaccgttccaatgagaaagcagccgaggtgggatttaagtccatatcttctgaccagagctttgctgttctgtacacttttagccccaacttattaatatttggccttgttgacatcttaggctttccctttctcatcccacctgcactcgagtttctcatccttaaatgatatggcaatctctggtcaaagcacttgcaggtggctcccatttccagatgttaggacttctttctgaagtgtggagaatggtgatgtcagcttaatggttcccattagagatggatgtgtgagaaagttcaagtcctttgggaatctcaaggacttgaaaacctctaggtggtctggagaagtagagaatccatctaatgagcatgacctgctgtgattcatttactggctctgagatttcaggtgggctgagtcttctattactcagattgtaaatggagatggggagagcttaggttgctgagagggtgcctaaggattgccatcacggggcaggagagtggtaggaaagaagggcttcagcaatcaaagcaggcttggctttttagctattttatatattgagctgttttgtaagttttaatctacataaaggcttctgtggttgctaagagtttgaaaacagagtttcttaggagtcaggagttttcaagaatctaattctgactctactgtcaacaattgtatgctttggtcaaagcacttcttatttcaggcctcactttcttcatgtataaagtgggagagttgtattaaccagtttgaaaacctgactcgggtatatactgaaacacaaaattggaatatagaactgttctgcgctgcccggtaccctgctttgagttgtataagcattagttgattttaatcctaatggtctgtgcctggtagatagcacaggaaactgatcctaaggaggttttcccaaacaggtgatagagccagaatttaaatccatgtctgctgggctccaaatctcagcttattccatcatgtcatgcagtagtaaaatccctctgtgaagcatggctcttggcgtaggaccaggaatgatggcagtggtcttcttcaatttggcctaaacttgttgctatatcaacaagtttggattggatatatcaccttttttggcaacacagaaagaaaagttatactgagttaagcaaagaggattgggcggagggtcattggttcagtgtcagggccttctagagcacttgccatgtggccagctccagcctatatcccaggagatctaaatgcatatctggcacgaacctctcaggattcttaccatctcgcacttgagataaaactgcactaaataaatcccataggaaatagttaaagtctagattacatggcagtgtttgtgaccctctgagaacatcttatattaatttattttaaaaaatcaattttctttcagaattttctgagtaagcctctagtgtggggtgtgttttggtaagcatgtacaggaattcttgctgagaattcctttggctttaacatgattgcaaaatcaaaattaaagagatttctaaagtcagttttagcatcttcttaaagcctgaccaggagggctatagtgcttctcagacttcaatgtgtaaatgaatcacctggagatcttaggttctgattcagtagctttgggatagggactgaaaatttgagattttgtatttctaactcaagttcacgggtgatgctaatattagtggcctgggaacttgtgaaaccacttttaattccaaaagctctgctcccctaccctgaaaagcatccacttttggggaatcagggaatggtacctttgtttttaatgctatgatgggagacacaggaaagtttgatagcttcagtagagctgctcaagtgcccgttcagtataaaagcatgagattctgtgttctaagttcatcaagctgtcatgtgtttactccttcttcattctttaattcttggaagtctgtactgagctcaactatgaaccagcaactgtgataggcactggggaactggggacaataaggactcaaccttaccattgagcagcacacagtccactagggatagtggtaggggagcataaggaatggggtggatgcaggagtgacatgaaaacagagccatcaaatgtactatgcactgtgatatagcaatatacaaagtgctttgggaaaaaggatttgcttcccagaggcaatagtttgacaggagcctcaagatatgagtagaggttttgcctagcagagaagataggaaagacattctgaagagagactgtggttcatctgtgttatggtaggtgagtcccagggcatgagctggggtgcttcagcaagcatagcaggagatgaggccaggtaaatagtctgagttcggcttattaagggcttatttggtgatagggattggttgatggttgttaagcaagggaggggctggcttaggtaactggcagacatgtggagattggattagggtgagaaaatgtgtgtgggggagtaagaactagagttttctcattcccctgatgatagcactctgatggctttgcattgctctgttagataaattccagaaactgaaacatggactagaaaatggtgcatgatgtcatttttacctcttcctctctcgtcactgtttgtcttttacatcctagctcactatatcccatctacaggaatccacttagagttttttgttacatgagtcttggctagaggttggcagactatggcacccaggccaaatctggcctactgcctgttattggatggcttgagaaaatgtaaatggttttacattttcaagtggttaagaaagaatcaaaaggatgatattttgtgacttatgaaaataatatgaaattaaaattttagtggccgtaagtaaagtttgattggaacacagccacactcatccatttatgtgttgtttatgtctgttttcacactacagtgacagctgagtagttgagacagagactatgtcgcctacagggcagaatatatatgtaccatctggaccaacagatgaaaagtttgccgacccctggtcttgacaatgctgagtctttcacctacagtgttcttccctctactcactgctggttcttcctcatcatttaggtttcagttttatttttgctctcttgaaaagcctttcctgatcctcaaatacatcagagtctcttgttattacactcttaattttacttcattatatctttcgtaaattgtaatgctacgtcaatttttgtggtgatttatataatgcttgctccaaccattgtaatctgcaggaggatagagatcatatccacctcgttctttgctatgtcttggtccttaaccaaatggctggtgcacagtaggtgctcagtacatattttctgaataatttgaatgactcaataactcaataaggggctgttacagtactccatgggagaactaatgagacctgaatgaggcactgtgagatggcaggagatgggtcctagaaatttttagaggataatatcaatagaacattgacactgattggctgtgaggagtgagtcagatggaggagccagagctgaccactcacttcgttattgctgtcatttatcttctccttgtccttagcctagagtcagatgtcagaggaagttgggcagaatttggggttttatctgtcttgagatgttctaggaccaccatagctcttgaacaaagtcacctggatcctagtcctgcaaatatggaatttaatcatgtccttttcatttaaagtttatgtgtttcaggttgacatttgtctccttaataagaattgtcagatgaaaggaaaaatgccatttgaatttttcataacccccagcagtctggcttttccatttggtctcaatgattctgactctcatcttaatgaaggccaaatgtaaattaagttctgtcaggcttgagcagctggggtctcctatctttataaacatgaaacattgtagggttaacaaggtgcagactgaggaaggtcaagagagttgctgagctgatgtggatcctgacagctcaatgttaatgggaggtaattaacgtggcttgtaggggctacatggagatcttccaagctgtcttttaactcatttcctcttttgccattgtcagcagagcagaaagctaatcattttatagtttgagatttttcttgcttattccaaagttctggaaccaactgtctggaatgtcacaggattttgttgatggattcaggaaatatacctgctgcttctctctcccctgtctgtgcccctgtgcttctgtcctcctgataacatactgggaaaatgaggaaatgattctccaattggtagattctttggggggaacctgggggtttggatggctagagaggtggtttgataacttcctgctagctgtggaagctgtcacttgagtgctttgcagtaggaactgctgaaaagaaaaccctgctgcaggtcagggaagcttggttcttctagttctttctgtaacttgagaggctggacgaagctaatttttaaaaccttatttggccttattttgtcactcttgttgatgacataataacaccttttctctatcttaaaccttagtctaatcttgaaacttcatgaaagatagacaatataagtttctttccttgaaatgccatcatttaaatagatggcagtatggtggaaactagtctttcttagttagttactgtctaattactattcaactgtgttcatcaggtcttaatagtagcactaatacaagatattgaggaactttgggagatataacacaaatctatacagaaaagtacaggatttggagccaaacttgcatttaaatttttctgtaccacttaccaattgtgggatcttggacaagctaaaatcaacttctctgagtctcagtgtgctgagctataaaatgaggacaatagtatcagtcttgtagagttatgagttagtgaggtatttgtaaagtggcttatatagtagatactcaaatggtactttattttcattatcattgtgtttaaaagtgcttgtttctactgatgggcatttcagtaacatcctatcactaactgagataattttaaagactaaaatatcctatttcatggggctggccataatgagtgatatgttttttcctgttttattaaggaaaattctagaaaccatcatcaaagtttctagagacaatcatagaaaatagagaatagaagagcacagaacatattttcagtcattcatttatttgaatcacccacatcctatgtgtaataccaattccaaaggcagccaacttcgagctgtaaagctgattaacttacttgagtaccttctacttgtttcccttgacatttaccagtgccgccagtctcagaatgtttttacttcacaagagttattttatttaatctttacagcagtctgtgggacagatattatctctttttatattaccagatgaggaaactgaagctcaaaaaagttaaataacttactcgtggtctcatactatgtaagcaaacccatgtcaagagccacaccattagctctgttccctcatctgctaccttatgggaacctgtgcactttcagtgtgggaatccagaagtggtctctgccaccaagaaattacagtctagttaaagaataaagatacagagcaaccaagcagtaagagcagaacaagaaaatagatgaaaataagagctaaagcgtatgtagtgcttgttaatacatctggtacttttctaagcattttacccatgataattcatttatttctcacagctaccctataattattgtatttttcttttcttttcttttttttgagagggtcttgctctgtcacccaggttggagtacagtagcacagtcttggctcattggaacctttgcctcccaggcttgagcggctctcccaccccagcctcctgagtaactgggactacaggcacacaccaccatgcccagataatttgtgtatttttttgtagagatgaggttttaccatgttgcccaggctggtctcaaactcctgagttcaagtgatccacccacctcggcctcccagagtgctgggattacaggtgtgagccactgtgcccagcctaattattgtcttttacagatgaggaaacaggcacagagactttaagcaacttgcccaaggtcactcagctaataagtggcaaggctgggatttgaactttggcatttcacatccagagtacgggcttatcaccattttgctctactgcctctttcagcgtttgctttgcaggctttgcataaactagtttagggaagaaatttgtgggtgatggcttcgggaggatctgaggctgtgaacaatggtcagtagcttcattgtttcatttaagaaatactgagtgtctcctgtgtgagaggcactttgctgggcgctggagatgccaaggtgaatgagtgggataagggccctggggtaggcttctgggaacttagagtctagtgtagagaggcagaaaatagacacacacaaagtaattttgttttctggaaaatgctacgaaggaaaaacacagatgaacagatttggcatagcgagtgtgggcctctcttgggagtttttgtttgacctgaatgatgagataggaaggaggagcaacagattcactgtgggggaggaaagcacctcatgagatcagcaaaggaggtcagctgggccaggagggtatgagcaaggcacagaggcgtaggagggggtttggcgaagtgggcaaaggctgctgcatgcagccttgaggccaggggcaggagtttgagttttattccaagatcagtgggaaatggttgatgggctttaaacatgggtgtgacacagtatgttttatgaccttaaaaaaatcattctggcatatgtgctaggtagatagtaaatatttgtatagcaacaacaaacttcatactgttttttttttattattatactttaagttttagggtacatgtgcacaacgtgcaggtttgttacatactgtaatgttaaagggaagaaaagttagaagactaatgaacagtcttataaatacatttgtttaaagaaactatcagtatggaaaaaaagactggccatatacacacaagaaaacattaatactggtacactgttcatggttggaagagtttgctactgttttagcacaatgctcatgcttttattacttagtaattttccattcaaagcttgtagtcatagctaacctttctggttgacaacacttcattattgagcaagggattttttttttttctttttgggcttattttcctaaaaagcaacatgctagggacttcacaggcagaattttatctctgccctttagtgacacagtgtaacagcatgctgttttactgtatctgtgtggcagtatgaggaaaccaagactcagaggacttaagtagcatccccaaagctacacaatagtaggttgtagagcccagattctcacctagtccagtctgcctccagctcctgggatctaactattgcctctcactgcctgcttttaaagggcactcatttcttcccacttgccagggctacaggctggcagaccactggctgaatctggtccccaatcaggtttagtttgacctaccatgtgcttggaaaaaaaaaataaacaattttaaattagtttccaatatttaaaaattgagaaattttatctgaaaattcagattatttattttcctgaataaataatgaaagaacttggcaatacagggtccacacttccatgcagaagggaacggctggagctgaataggggctgccttctttagaaggggtcggcattcttcattttgcagcagtcctcacccagcctgctacactcatttcctttttcagccctacccctctgagcacttgaatttgagacttaggctgtgggaatttgttcaaggaatctgtcattacttttcctctagcaagcgcttagagaaatggaaaggcattccagatggcgaatttcttggtccagggctctcatgattccatgcctgtattctctcacacctctgggtctttgctcaggtttttccttctgcctggcaaacttatagtaatttcttccttcaccaggaaaacttataataatagttcaaaacccagccttcactgcctccaggaagccttccttgacttagggtcctacactctgtcccctgtggcattctatgcttatctctaccctagaatttattgcattacattgtgctgtatttatctcagtgtccctagcctccagagcaatgtttaaattctaacattaataacttattatatattttgatgggtggatgaatgagcggatgaacttattaaatcatctcatgccatttttgatggctaggtgcatttgtccaatcatttcattccaaactaaaggttcactgtatgcccaacataagttaattttctcttcctcattgtggaaaatgagatttgagcattactgttcctttccatcctagagccaccccttggctgcagtcctgttaccggagtcacagcttattttgtatgcaaagtgaaggctctagactgagacagtaactcctctgggcctctccactgtgtctttggactcctgtgatggataccactttaagttgctcccttcaccccccaggagaatccaagactcatcttctcaatcagaaagactttctttagaatgtttataccagggccctgtatattggaccagattcctcccagcctttgaggaatgaagacagtattgtcagctgctgttagggcatgtgttgtggattttctctccagggtgggtactggacttgtaactaaatacacagaatgttgaggctgatggcttgccttcatctacctggacagtgaatcctttccttattatcctgtatttgcatatttgatttataccaaatatgtgttgcattcttttagttttatagtccagcaaagtaatttttaaaaggcagacaaaagaaaaaaagttgttggccagataccttgtaacatttaataaatgtcagctattattataatactttaaaaaattttactttatggctatggcagactttcataaatatttcctttatatgatctatgacatgaccttgtgggataaatattactacttctcacattttacagatgaatacaagcctcaaagaaatgaaatgacttctctacaggtatcaaatcttggtgaaggtcctttgggcttaaactggagccaaatgaagtcccttggatcttaatgaaggtccttttggctttaaattctggtatatgtgtgtgtgtgtgttattctgctgtaccatgtttcttcctcatttgggttggtggattttcagctccataaaagcagggaccaaatctatcttttcataccttactgttttatatccccagagccaaacacagtgtttggcattgaaaaaatactcaataaacatttactaaatgaattcatgtcccctggccagccaggagctagccatgtgactgtagtgctgaagaccacatgcctggcttacctgttgccagtcttcctgacggctgtgcagggatgttggccacctctaggagtcattagtgtaaccagagaggtacgaggaaggattgtgaagttaggcttgctttatgtacacatggtatgattctgtgtcgatcaaaaattgaacaaaattcttttctcatagtggctaaaatggaagtcacacttactggaggaaaatacgatctttatagaaacaacactgaaaaggacaatgcatttaatgtgtgttgtgatacagtaactcatagcgtgtaaactgtcaacttggaaatctagaggctcagggtcaatggatgtccactgatgcaaggaaggtggcaggctagaagtccaaaaaggtgcaaaatggtattcttttggaggagtaagtaaatctcatttctctgaacacctgggctgttttactttcttttttcctattatccaaagtgaccataattgttctgttattgtagggatatattcatttaatcagtgaaagaaacttttgtctggtaactactaggtacaaagtactgtgcttggtgatggggaggaaaggaggaagccaagctcaccctttatctcaaggaattcccatatctagtaccaagagcgagaggctgtgaaagccattacccgccctgccacccccccgccatgttttattatcaaaatttcaaacatataaaaaagttgaaaaacttttacagtgaatactcagagccatcacctagagcctgccatggacatttactgtccttgctttatgacttatgttgtttccatctgtctgttcctctactcagcttacatttttggaataagttgggagattgttacacttgggaaggcagtttgaaatattaaaagttgtttacatttctgaaatattaaataagttttagttaagatattgactttgttttattgctatctacatacatggccaacacctgtactagactttattaaatatccactgtgtgctttcaaatcttctatcccatttattcttatgaaaatcctgtgaggtagatgttatcacttgctttgcagatgaagaaattgaggatggagggagttaagtagattgccacttatcaactttattacctctggcaacgttggaatgcaaacccaggtttctgactctaagaaatgaatttgaaaaattattgtaaaggttagctggtcaaacaccagcctttatcacacaggtacccctgtctacagataagacatcattggagcttacctaagtaaagcaaagcaagcaattagaaaatgagagctctcttattttgctgattaattattcattattttcttaataatgactttatttttctatcatttttagtattattacttcactttgattagagaaagcaacttctgatggtttaagttaaaaatcccagataacacatttgtttggcataaatttttaaggtaaatatgaactctagaataaaacgttatcaaagttattaaaagtttagctgttcaaagttagactcaaaatgaaagaatcatacttgagactgggtgagatctgtttcccaccactatgcaaactctgacccagggcctcttttgtttgtattccagcacattatagttacctctccaagagctgactttgtcctcttctttgcattcccctgaggtatttgtagtgagaaagaatgactaaatgatggaatgagttcattacctcttctgaacccaggggtcttggaagtgctgacacagctaagacctccctggaggcttgtctgttcatccagaatggccactctggattcctataaaggctcctgtctctctgaatcctccctgtatggagaggctatggattagataaacttcagagtgtttagtaataaaaacaagcttgatctcaactctgtggccctgtcaatacccatacctgcaccctcttgaaaagctacatcagtgtagcttctaggcttgtaatctgaatgatcagtgtcttttggctcaaaaatgcaaagtgaaggaatattcagaggaaattagagagctgcctaagtggctctatcctacctggcctccgtttctcattatggctttgctaaagggtctgaaccgtggcatggacgtacattttttctcagtaacgccacatgtgtagagtattgatgcttacccaagcaaagcaaaacaagcaattaggaaatacagtctctctctcattttaccgattaattattcataattttattgataataagaactttatttttctatcattgttattattattattattattattattatttcaccactgattagtgaaaattattggtcctggactatcaccagtccctgttctggcatttgggaacaactggtgcgtgtaagccctgaaactctccttcgtgctggcattctgtgaacctgagagagatgagaagagaaccagggactagagtgaagcctactgcagttgtcttggcatgaggctgtgtggcttggctttggctgggagtcacagacaagcccacggacctgagaaagagagtgaatcactgtacaagtatttatcgagcacctcccatgtcctgggaagcagtagctggagagtggtgaaggagtactgagttttggggttcaagtggccagggctttcccccaggctttttacctattatctgcattatctgggcaattcagttcacttatgggccttagttttctgtctaaaaaattgtgttgatatactattatgtatcagaaggtatttgataaattgcagaatgctggtggtattgatagattttcagatgatagtgacagaaaaagttgattgttggaaagaaaattagtgaggtctatttttcatatacttacctttagaggcaggtaagaaatctaagagtgaagggaaatggaattcacattgtttgaagggtaggaaattttaaaaatagtgctttttaatcgtccggaagacttggggagagggtattattcctgtttgagtgggtgggaacagtctgagagacacttacctcatgcagctactgagtgggtagagctggggcccagctcagatctaactccagcctgtgctgtttctacagcagctcagaaaccaaagttcaggggagcagaggagctggagacagtgaatccatcctgaggcccccctgagtaaatgcttccagggcaattccacttgcactattattaataccttacagggtgtccttcacaaatttctcagaatgatggctgtaaaaatgggtgtgtgttttagaaataaaaatattgtggtgctaacaagttcctgccggagttgttcaaggacgttcattcattcagcaaatatttattgaaaatttgttttgttccagacactttgttaaatattgggaatatagcagtaaggaaaacagagtcactattcccaggatgctcatattctagaaaggagataagagataaagtcacagtacagcattagtgcagtgggaacttgggttactctagaaatacagcccagttaggatcgaggggctcggggaggtaatatgtaggttgtgggccagtggatgaattggaattgggtaataagcagttgaggtgaggcagtttgtaaaagctagtctggtggcagtctgaggaaatgagacctccgtggggctgcaaatgcagtatagtgagagcttagactgcaagaagctctgtgaatccgtcaaaagttcctttaagtcccttttatatattccatgctattaattacaggattctttgcaggggtgaagggggacctcatgggatggagccagttcaccctagccacaatcagagaaaggtcagaagctatttgtgacatttttcccgactcttctatctcaaagacctggacctgagaactccggagaagatgagctttgagcactcacgtcctcactgggcagacagagcagctctcctcatttcagttgtctcaagactagacagtgtgcctgagaataaagcagtgaattaaccccacttgtccaagagggtgggactgaatactagacagggccctttccgcctctcttgggtggtggggggtggcgtgtgactcagaggcagtgacatcagccatgacttcattcatccacaggaaagacagtgtgcagaccgcgaacacggctgatttctgccctcccttctcgatgctttgtcttgctggggacattgtcatggtcctgctgttatttcccacacattttattcacgtctcatgtttaagctgttctttttcttcaccccattctttttggtctctttgttcatcttttgcttttgtctttattttcttctttctcctatttaatttttcttgtttcattttctttcctgtacttcttctcttttgtctccattttccattctttccatttgctctgtcctttctcttccctctgtgtcagaaatgtatacaggaacacatcctcctgcctcctatttcttctctcctctgggcttcccactaggttattgctgtcctaacattcctaaaactgtgttcacaaaacactctccacacaaggactgatggtggctcccattcttttctgactcaagtatctaatacaagtccagatttacctcttactgcatctcaacacaggtctctcagactgagcttctcatagttccttctccatggccatggatgctgctgatgcttctgcctgcacttttactcaggccattgcctcagtgtggactgacctccatcccatcttcctcagtctttgccttccctctagacacatatctgacattgcctcctaagtaacccccttacttacctccttcccacagcactgtctccttcatgatcatacagaatccatagtttataaattatgtattttagaacttgaattattctgtactatttatacattcttcctgcatgtttcatatgcatagattctttgttccacctagccagtaactaacctgaggataggaagtatattcctgcctttcatcttctatgagcatacctagcacatagttggccacaaaccaggactgacagaccatttttttgcaaagtcaagaaatattttacttgaaaaatagttatttgatgctaattctggggagatagatgaatgaattatagttctttcctaaaaaaagagctaagggtctagtagaagagacagacccacacgtaatttgagaagaacaaggattgtggaggaaactaatgtttactaggagtgtacaagaatgggcacatgaacatgtataatctcactgaattgaattcggctaacaatcctatgagttaaatgttgctaccaatgaacaaagtgagactcatagacattaggtgactactagtcagaaataacaccactaataagtaggagaaccaacatttggactaaggtttgtccgactctaaagcccctactctttcctgaagagggaaggatgtagtgaaagtgacattctaagtaataataagaacaatcgtaggtaaaaagtgcttactatgtgccaggtgctgtaaacagattacctatatttgttcatttgatcccccatcaaccctatggcataggcactattattgtcctcagtaatttttataggatgaggaaattgagatgaagagtagttgagtagattgctcaaggccacatagctacagagtactagagccaggatattcactcttgcattctggctctggagaagaggcagcagaatgtagtgaggccctctacatagagtagcatattgcatgatcagaactgctgttggaccagtctgtttggagaatcagggactgtggagatgctgacaggtgaaggtgttgagaggtgaggctaaagaggcagccaggaatcatcacaaaggaccagtgccctcctcaaggacccgtgacaaaacatgcaattttcctagaaatattttctgtgaggttggaccgttagggatccatcataaggaagagtttaagttgtggtcttattctactacttgagttgtgaaggaacttttgagttgtggcctttgtccatgcccagcgggaaatcacagtggaactctgcaacagtggtgtaaatgaacaagtaaggatgcacatacccaaatagactccaaagaaatgccagttgaaacagtaaagtacgcctgtcctttacgggttggagatgattaagtttgggttgaaggacatttgggaagaaagaagaagggacatctgtgtgagccagcttggaacagatgccaggttatcctcaggtgtcccagagcgctcaacatttgatggagcactctccccactgcagcccccctctccattggtacttggcagcaattcagtggtgctgcactgacctgggagtccaagccaggaagtgaatgaatccattttccaattaaaatgaaacttctccaaaggacctgctaaccctgagagaagaaatttatcttcctggcagtctggcttgcctagaatatgtctctgctcctgaaacagactgagaaaagccattagcttgaatgaaaaaagagaaactgggacagttcttattcacaacctcattcatttatccattcattccttttatttctgcagactttaatttggcttccacatgtctgctcattcattcatttattcattcattagctaacatgactcatcatctatagatcagacaaactgctgtgtcctaggagtagagatatttaataaaaaacatagctcttgcctttgaggagctttcagtctagtgagagagacagacaaatgaacagatgatgggaaatgcagtgatagggatattcatagagtactataggggcatagcataagagcatctgactcagcatagggatgtcatgggtgatttcatggagtaggaaacaccagagttgagtcctaaatgtgtacacacatagacatatacatgctattgcttctgtttctctgaagaactctaatacagggtgatgaggtgggcacctcttcatgaattaattgggagttgaaattagaatggtggttgaatgtaaggaatgagagaagaggtagaagatgactcctttggtagaggtagaagatgactcctttggtaactggatcaactggcactggaaatcaaggaggaggaacacacttgggggaagatagcagattctgtcttggacgtgttgagttggaggtacagtgggacatccaggagacatgtctcagaggagagtttgaattggagtttcagatttggcacgttattcagcgtgtagttggttggaatcacaggagtgattgatatttctcagagagcatgggaacagtgaaaagaacatttggatgaggtaagatccctggggagcagctaaagaaaagagcagctaaagaaaaggagcccatgaaggagacagaaaagcactgatgagaagggcgtgagaaggtcccggagagtgagaggttgaggaagacttcctcatttctcccctggtcccagtctttgactttctttcatgtctgctccaagacctgttcaccctttccaaagccttctcttcctattaggactgtctccctctctcccatagatggtaccacccacaaggcatggcttgatccaggtcactgtggcatctctctcatctcctccagtaagaaatgcacttctgcattatattatgttttagagaggcagatgactgaactcaaacattgggctgggcattagcgatgcaaaatttggtctgactttccatttacccgttgtgtgggacctggggatagtcttggtcccttcctgggctttaggttcataatctgcaagcatagttttctgactccttgccttgcctgccttgaagaattatacaggtcagatgagatcatgcatgtcaaagtgctttgaaaactgtgaaactctgtagcagaagagtgaatcttgttgacttatcaggcactttatattatttcatttaattctcacagcatccttgggggaagatgctaggaatgtggctttgaggaaactggggcttaaagaaattaatttacctaaagctacacagctgttaagtggtgaggacggcaatcaaaatcaggtatgccagactccagagttcttagaccccatctacttcagccttgttttcctaatacgtacagtggtgtcacactcctgggtaaagtcagctttgctgagtatgatgagttttcattaaaatgatagcatattttatggttgggaaatcaactctagtgtggattataagtttttcttttcgtacaagaagagcaaagcccttcagggggaggaaagtaggggaaagggatgcatataaatccagtttttgaaaattaaataaactatacagtggaattatttcattttacaaataaattctatgatgttaccgttaaacaagtcctcatctaatgggggtaatgcgtcttgtctattcaggtttttgtttcttgggtctttctcggcagtgacataaatatttattccacttgatgtttaggcctctgcttgcatctctccccggaagcctttagaaaagcctttagaaaagcctccccaggtcccaaaccctttccccgctctgagccctgtctgtgattactcattagaggcagatatatggccacacacaaaatattacaataatgttatgaggctgactcatcaaaccttggtatcaggcttattacgttattgtcatatatcatcttattaattatctcttcctttgtgtacatctttctctcgaaaggacctggctttagattttcttatatctcccaaaactctgcattttttttttcatgagttagacttggctcttgcccttcagaagtttgtcatttcaaggtagatttaggtatatcaatgaataattagggtacagcatgggatggagaggttcacagaaaaggtgacatctgagctggatttgaatcaagggcagaggtttgataaagggagaagatgggaaagtcaattcaagtagagataccagctgtaacagaggactggaaatatgaaagtgtaatgcatttgggaaagtaaaagaggtgagaaccaaatggagggtgttaggagatgagcccagaaagtcatcatcataatgatcacagccaagttggagccaggttaagagtcctgagagccagactacagagttaaaatgggattctaggccatgaggagatgtcgcaccatctttaataaaggaatggaatgggaagctttatgtttttagaaagatgcctctagtagtgcagacctctcagcttatctgcctatctgacttgaaatatttctgatgttctgtctctgtgcatgggagtttgaaacacacaattattttattcattctgagaagtttctggctgaggtttatgacctactccatgcttccagcgtcatatttcttttaagaatgacattgaagattacgtctcttcctgaaactcttttctctctgggctattggcctgtgccctaatttggagtcttgaacatagagtgaggataaggtctagctctttcttgggtagttgtgctggaaaacaacagcatgagtacttggaatgtacaggcagtactatttattgagtggggaattagggagctgttccctcccttttgtttactgctcacagcagataacccagatagaatccctttgcaattacacagtagattacttggataatcctttgtaactggtcatgcctatcttctcatgttgcccctcgaccctggtgtcactgcagtagctgcctcatttccctcacgagttccctaggtgtctagaagcagcagaaacctcacagcttccctggagtgggagggaaagggtgaaagctacttctctctgtcctgaggctggcagggcggctgcagccttgaatcttggacatactgccctacctccgccctctgcttagacccacagctgtgtgagctttgagtagtagcctcctcccaacaaatgctgtggtttgatgaagtaataattttttcttttttttaaaaaaagctgttctctttggttgctttaagctgagggattgcttaactcaaaggattgttgttggaatgcagaaggcttttgtgccaagtcatataacccaaatcacttttctttttttcttgaaaagactagtttttgttagttgcctggtaactggaggatagaaagacttaactcattcagcacagagagctcctagtttgaactctattaggccatcacctaatgagatacatctgaaattggtgtgtgtcgagggcctgctccttgcactctctaatccgtgcaacattgtgcatgggagatgataagtacataggagttacatgagctgtccaggattgaaattgtacggaaatgtgcttagaagggcttttgtttgtcttttcttctgtaaagagtggcaatagcttccattatgacatttccaaaaggcccaaaatcacacctctgattggactgggaggttcagggtggtaactgtggcatagtggaaggaaagaacatttactttagagctggaagccctgtgactttgggctaagcccttgtggtctgacccccagttccttaatgtgtgagtattgtgtattacctacacgcctctgcatcactctgtagattaaatgagaacactgttgtaaactgtggaggacttagaggacgatcactgtgtcctaatgcaggcccagtggttacaagtagagaattaattcagtaagattgaggcctttggctgggattgtatgggccagagaggaggagggacagagagatttttctgcagaactagactaaaaatccatctatgggggtaatgtgctgttggccaatatggcatttgatgacaaagcacttgtgaatcaggtagcctaatataaaaaactgcatgtggctgggcatggtggctcacgcctgtaataccagcactttgggaggccgaagtgggtggatcacaaggtcaggagttcacgaccagcctggccaacatagtgaagccctgtctcggggaggagccaagatggctgaacaggaacagctccggtctacagctcccagtgtgagcaacgcagaagacgggtgatttctgcatttccatctgaggtactaggttcatctcactagggagtgccagacagtgggcgcaggtcagtgggtgcagcgcactgtgcgcaagccgaagcagggcgaggcattgcctcactcggaaagcgcaaggggtcagggagttccctttcctagtcaaagaaaggggtgacagacggcacctggaaaatcgggtcactcccacccgatactgcgcttttccgacgggcttaaaaaacggcgcaccaggagattatatcctgcacatggctcggagggtcgtacgcccacggagtctcgctgattgctagcacagcagtctgagatcaaactgcaaggcggcagcgaggctgggggaggagcgcccgccattgcccaggcttgcttaggtaaacagagcagcctggaagctcaactgggtggagcccaccacagctcaaggaggcctgcctgcctctgtaggctccacctctgggggcagggcacagacaaacaaaaagacagcagtaacctctgcagacttaaatgtccctctctgacagctttgaagagagcagtggttctcccagcacgcagctggagatctgagaaggggcagactgcctcctcaagtgggtccctgacccctgacccccgagcagcctaactgggaggcaccccccagtaggggcagactgacacctcacacggccggatactcctctgagacaaaactcccagaagaatgatcagacagcagcattcacggttcacgaaaaacgactgttctgcagacaccgctgctgatacccaggcaaacagggtctggagtggacgtctagcaaactccaacagacctgcagctgagggtcctgtctgttagaaggaaaactaacaaacagaaaggacatccacaccaaaaacccatctgtatatcaccatcatcaaagaccaaaagtagataaaaccacaaagatggggaaaaaacagagcagaaaaactggaaactctaaaaagcagagcccctctcctcctccaaaggatcgcagttcctcaccagcaatggaacaaagctggatggagaatgactttgacgagttgagagaagaaggcttcagaagatgaaactactccgagctactggaggaaattcaaaccaaaggcaaagaagttaaaaactttgaaaaaaatctagatgaatgtataactagaataaccaatacagagaagtgcttaaaggagctgatggagctgaaagccaaggctcgagaaccacgtgaagaatgcagaagcctcaggagacgatgcgatcacctggaagaaagcgatggaagatgaaatgaatgaaatgaagcgagaagggaagtttagagaaaaaagaataaaaagaaacaaacaaagcctccaagaaatatgggactatgtggaaagaccaaatctacgtctgattggtgtacctgaaagtgacggggagaatggaaccaaactgaaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcaggttacccacaaagggaagcccatcagactaacagcggatctcttggcagaaactctacaagccagaagagagtgggggccaatattcaacattcttaaagaaaagaattttcaacccagaatttcatatccagccaaattaagcttcataagtgaaggagaaataaaatactttacagacaagcaaatgctgagagattttgtcaccaccaggtcggacctaaaatagctcctgaaggaagcactaaacatggaaaggcacaactggtaccagccactgcaaaatcatggcaaaatgtaaagaccatcgagactaggaagaaactgcatcaactaacgagcaaaatcaccagctaacatcataatgacaggatcaaattcacacataacaatattaactttaaatgtaaatggactaagtgctccaattaaaagacacagactggcaagttggataaagagtcaagacccatcagtgtgttgtattcaggaaacccatctcacatgcagagacacacataggctcaaaataacaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaggaagagctaactctcctaaatatatatgcacccaatacaggaacacccagattcataaagcaagtccttagagaactacaaagagacttagactcccacacattaataatgggagactttaacaccccactgtcaacattagacagatcaacgagacagaaagtcaacaaggatacccaggaattgaactcagctctgcaacaagcagacctaatagacatccacagaactctccaccccaaatcaacagaatatacattttttttcagcaccgcaccacacctattccaaaattgaccacatggttggaagtaaggctctcctcagcaaatgtaaaagaacagaaattataacaaactgtctctcagaccacagtgcaatcaaactagaactcaggattaagaaactcactcaaaactgctcaactacatggaaactgaacaacctgctcctgaatgactactgggtacataacgaaatgaaggcagaaataaagatgttctttgaaaccaatgagaacacagacacaacataccagaatctctgggacacgttcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcgagaaataactaagatcagagcagaactgaaggcgataaatcgagacacaaaaaacccttcaaaaagttaatgaatccaggagctggttttttgaaaggatcaacaaaattgatagaccgttagcaagactaataaagaaaaaaagaagaatcaaatagacgcaattaaaaatgataaagggaatatcaccaccgatcccacagaaatacaaactaccatcagagaatactacaaacacctctacgcaaataaactagaaaatctagaagaaatggataaattacttgacacatacactctcccaagactaaaccaggaagaagttgaatctctgaatagactaataacaggctctgaaattgtggcaataattaatagcttaccaaccaaaaagagtccaggaccagatggattcacagccgaattctaccagaggtacaaggaggagctggtaccattccttctgaaactattccaatcaatagaaaaagagggaatcctccctaactcattttatgaggccagtatcatcctgataccaaagcctggcagagacacaattaaaaaagagaattttagaccaatatccttgatgaacattgatgcaaaaatcctcaataaaatactggcaaactgaatccagcaccacatcaaaaagcttatccaccatgatcaagtggccgtcatccctgggatgtaaggctggtccaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacatatctcaaaataataagagctatctatgacaaacccacagctaatatcacactgaatgggcaaaaactggaagcattccatttgaaaactggcacaagacagggatgccctctctcaccactcccattcaacatagtgttggaagttctggccagggcaattaggcaggagaaggaaagaatgggtattcaattaggaaaagaggaagtcaaattgtccctgtttgcagacgacatgattgtgtatctagaaaaccccattgtctcagcccaaaatccccttaagctgataagcaacttcagcaaagtctcaggatacaaaatcaatgtacaaaaatcacaagcattcttatacaccaataacagacaaacagccaaatcatgagtgaactcccattcacaattgcttcaaagagaataaaatacctaggaatccagcttacaagggacatgaaggacctcttcaaggagaactacaaaccactgctcaaggaaattaaagaggatataaacaaatggaagaacattccatgctcatggataggaagaatcaatatcgtgaaaatggccatactgcccaaggtaatttatagattcagtgccatccccatcaagctaccaatgactttcttcacagaattggaaaaaactactttaaagttcatatggaaccaaaaaagagcccgcatccccaagtcaatcctaagccaaaagaacaaagctggaggcatcacgctacctgacttcaaactatactacaagtctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccaggagaaagctgaaactggatcccttccttacaccctatacaaaaattaattcaagatggattaaagacttaaacgttagacctaaaaccataaaaaccctagaagaaacccaggcaataccattcaggacataggcatgggcaaggacttcatgtctaaaacaccaaaagcaatggcaacaaaagccagaattgacaaatgggatctcattaaactaaagagcttctgcacagcaaaagaaactaccatcagagtgaacaggcaacccacaaaatggcagaaaattttcacaacctactcatctgacaaagggctaatatccagaatctacaatgaactcaaacaaatttacaagaaaaaaacaagcaaccccatcaaaaagtgggtgcaggacatgaacagacacttctcaaaagaagacatttatgcagccagaaaccacatgaaaaaatgctcaccatcactggccatcagagaaatgcaaatcaaaaccacaatgagatatcatctcacaccagttagaatggtgatctttaaaaagtcaggaaacaacaggtgctggagaggatgtggagaaataggaacacttttacactgttgttgggactgtaaactagttgaaccattgtggaagtcagtgtggcgattcctcagggatctagaactagaaataccatttgacccagccatcccattactgggtatatacccaaaggactataaatcatgctgctataaagacacatgcacacgtatgtttattgcggcactgttcacaataggaaagacttggaaccaacccaaatgtccaacaatgatagactggattaagaaaatgtggcacatatacaccatggaatactatgcagccataaaaatgttgagttcacatcatgtcctttgtaggggcatggatgaaattggaaatcatcattctcagtaaactatcgcaagaacaaaaaaccaaacaccgcatattctcactcataggtgggaattgaacaatgggaacacatggtcacaggaaggggaacatcacactctggggactgttgtggggtggggggaggggggaggggggagggatagcattgtgagatatacctaatgctagatgacgagttagtgggtgcagcgcaccagcatgtcacatgtatacacaggtaactaacctgcacattgtgcacatgtaccctaaaacttaaagtataataataataaaaaaaaatccacctagttttcatcaaaaaaaaaaaaaatggcagggtgtggtggcatgcacctgtgttcccagctactcgggaggctgaggcaggagaatctcttgaacccggggtgcagaggttgcagtgagctgagatcgcaccactacactccagcctggcgatagagtgagactccatctcaaaaaagaaaaaaaaaaaaaaaaaagaaacaaacaaaaaaaaactgcatgggatcctcacagatgcctgctggcatctcaaggtaagggatcaggcttctggagacatttcctctcattcagtccttattcctctttgctggcctatctccagacttttcttttgtagagaaagcagggaatattgctatcttcccttctgagaccatgtgcatacttaagagtacctcagacttcccacaacatgttatttctagttgctcatcccacaaatatttgttgaattactagacaaactgctcagcttcatcttccagttcctgttatgtgaggagtacttcagaggttatagagggcttccacatgtgttatctccttagagaggagaggttggactgggatctccagctttgattggtgacggttagtgtggtctcaaaaagaaagaacgcagggactccttgctcctcctattcccagtgtctctttttggcaaaaggcttgagttctttgtgacattctacttgggttctgttgtcccacagtggctggctgtgtggctacaggctaaaagctgtcgttatataatgtctttaatgaccacacacaagatctaaagtagtttttttttttttttttttttgcctgaatttaagaagattgttgtgctttggcttgaagcactggttgttgctgcggtggtttggcggttcatatctggtcactggcctttgatttctggaacctttagaaagaggctgccttttctcctctccctgaccactgattgctgaaaccacaagacatatggaaatagatttcagggactagccaaaagccattctggtagtttgattcacatcgtctcaaaggctaccattttctgactgtggcttgttagatcctatacagagatactactagttcttagctgtgttaggaatatttagtatctttaagttttgcttgatttaacattaacatcttagaatgggcgttcaaagagaagtttagggcaggtccctttctagacacaagctttcacctagatgtttaggaagttaaaacaacaacagtaacagagaatcagcttgatactttgccttttagatctgaactcttttgatattgttttgatagggccagcacttgggatagtaccgtttatctgctgtaaatagatgttggtgtttatatagtagtgttagggaagcactatgtaggaggaactcacagaattctgataaaggccagttgtatataaaatagatataataatacccaggacttttgtgttgctctaaggagataacacatgtggaagccctttataaactgaagcacccctcacataagaggaattggaaggtgaagctgagcagtttgtctagtaattcaacaaatatttattgagttcctactgtgtgttaccctgcggcaggtactgaaatatgcctcttttggaacttctgcattgttgcctttaggttcccagagatactcctatgcttataattccttttatagctttttggagagggagtaatagaaaccaggacatggaaagttatctggatggtaggaaacctttcttgctagttcctctgtcttctttactattctgtttttgaaattctacctcttcaggtgtttgacagaaaatggccacttcatgcttttcaagtttatctcacctccagttccattcataggcagaagtgaaatggttccatttgggtcctgattctaagttcttgggagaagaaatctggttggtacaactaggtcacatgcctaaacctggtccaaccaagtgcttgtagtaaggggatgagagttaagtagtttctgcttggcagctgagggtcctctcagttggggtggagaagaggagacaatcatccaatgtcatggtgaacatgactgacaagatccttgacctcacagagcttatagtcagtctgtcaggaaagaaagacttttgtattagtctggtcttacactgctaataaaaacatacccgagactgggtaatttataaaggaaagagatttaattgactcacagttcagcatggctggggaggcctcaggaaacttacaatcatggtggaaggagaagcaaacacatccttctgtatttggtggcaggagagagaagtgcagagtgaaagcaggggaagccccttataaaaccatgagatcttgtgagaactcactcgctatcatgagaacagcatggaggtaaccactcccatgattcaattacctcctacagggtacctcctatgacacttggggattatgggaactacgattcaagatgagatttgagtgaagacacagccaaaccatatcaacattacacaaatgattgtgggggtggtatgggttgtatgacaactagacctaaactaacaatatgacttaccggctttgatttccaggagatcctggaaaccccctcaaggaatggtggtgtgtagggttaaccaaatgaggaaggggatgatgttgatcctgggagggcacagggtggtgggtgaggaatgaatgttttaggcagaagtggcaaagtaaagaaaatgcccagcagtaagaaaaagcctggccattttgcaatacagagaaccaaatctttaaaatgtacaatggcttgcttatgtggccattctctttgacttagactggaagttctttgagggcagggactatcatcttttttctattgcctttgtaaccagttggcatgtggagaattttatatggcaggggacatttagtttcattgggcagtttctgagtacagcttctttccagcttatatctgctctgaaatcttatatgtccatcaccattcactgggaaaatggattgcataccttacagactgtgcttttgatatggtttggctgtgtccccacccaaatttcatcttcaattgtagctcccataattctctcatgttgtgggagggacctggtgggagataattgaatcatgagggcagttttccccatgctgttctcgtggtagtgagtaagtctcacaagatctgatggttttataagaggttttccctttctctgggctctcatttctctctgtggtctgctgccacgattgtgaggcctccccagccacgcgaaactgtgagtccattaaacctatttttctttaaaattacccagtctcgggtatgtctttatcagcagtgtgaaaatggactaacacagctttctatccttccaggttggcaaagagggttttaagggaaattacgatcatttttggaaggatcaagcattgtcagtttttctttcctgtataagtactgcttttatattattcctacccccaccaagctcctgaacagatgtttcaatgggcattgttggctatgcttttgttttgaaaaatttgaaacattattgaaagaggagatggtagaaaaaccccctaattgattctaatatatatttaatttggcagaacttgagagagatttgctgggataaggcgggacatttctttgatctcccggacttcttatcgtggaaggcaacaggtgtcacagcacggtatgttaattacaagttggattgtgtttgcgttcttccattcttggatgtctgtctatatattgctttcttaactctctttgactggatatacttttggtacatctgcatgtgattttgcatacatgaaacatcttgaatctatcttcgacctccactgcacatgcccaaacactgttgttcctaagagccctggaatgtgagtatccaaggtgaagaccattcattaaaattggtcatatttgaaggagatatgaaaaatccagagtgaaatgtggatttttccaaaggcactttttacatgatgaataaaaggaaaaaataaacacacacacacacacacacacacacacacagagtcacgcattccttaaggacagggatacattcagagaatgtgttgttaggcaatttcattattgttgcaaacatcatagagtatactttcacaaatctagatagtgtattctactacatacctaggctgtatggtatagcctattgctgcttggctacaaacctgtagagcatgttactgtactgaatactgtaggccattgtgcacagtggtacttatttgtatatctaaacatagaaaagatatcataaaaatacaatgtaaaagataaaaagtagtatactcatatagggcacttacaatgaatgaaacttgcaggactagaagtttctctgggtgagtcagtgagtgagtggtgattgaatgcagaggcctaggatattactgtacacttctatagactttataaacactgtacctgtaagctacactaaatttattttaaaaatttgtttaataattatcctttgcttactgtaacattttttacttcataaacttttaaactttttgacttttttgtaataacacttatcttaaaacacaaacacattatacagctgtacaaaaatattttctttgtattcttattcaatatgcttttttctttttttttcattatactttaagttctagggtacatgtgcacaacctgcaggtttgttaattatgtatacatgtgccatgttggtgtgctgcacccattaactcgtcatttacatgaggtatatctcctaatgctatcccccgcctccccaccccacaacaggccccagtgtgtgatgttccccttcctgtgtccatgtgttctcattgttcaattcccacctatgagtgagaacatgcagtgtctggttttttgtccttgcgatagattgctgagaatgatggtttccagcttcatccgtgtccctccaaaggacatgaactcatcctttcttatggctgcatagtattccatggtgtatatgtgccacattttcttaatccagtctatcattcatggacatttgggttgattccaagtctttgctattgtgaatagtgccacaataaacatacatgtgcatgtgtctttatagcagcatgatttataatcctttgggtatatacccagtaatggaatggctgggtcaaatggtatttctagttctagatccctgaggaatcgccacactgacttccacaatggttgaactagtttacagtcccaccaacagtgtaaaagtgttcccatttctccacatcctctccggcacctgttgtttcctgactttttaaagatcgccatcctaactggtgtgagatgatatctcattgtggttttgatttgcatttctctgatggccagtgatgatgagcattttttcatgtgtcttctggctgcataaatgtcttcttttgagaagtgtctgttcatatcctttgccccctttttgatggggttgtgtttttcttgtaaatttgtttgagttctttgtagattctggatattagtcctttgtcagatgagtagattgcaaaaattttctcccattctgtaagttgcctgttcactctgatggtagtttcttttgctgtccagaagctctttagtttaatgagatcccatttgtcaattttggcttttgttgccattgcttttggtgttttagacatgaagtccttgcccatgcctatgtcctgaatggtattgcctggctttcttctagggtttttatggttttagttctaacatgtaagtctttaatccatcttgaattaatttttgtatagggtgtaaggaaggaatccagtttcagctttctccatatggctagccagttttcccagcaccatttattaaatagggaatcctttccccatttcttgtttttctcaggtttgtcaaagatcagatggttgtagatatgtggcattatttctgagggctctgttcttttccattggtctatatctctgttttggtaccagtaccatgctgttttggttactgtagccttgtaatatagtttgaagtcaggtaacgtgatgcctccagctttgttcttttggcttaggattgtcttggcaatgtgggctcgttttcggttccatgtgaactttaaagtagtttttttccaattctgtgaagaaagtcattggtagcttgatggggatggcattgaatctataaattaccttgggcggtatggccattttcacaatattgattcaataagcttttttctattaacttttttttcactttttaaacttttctgttaaaagctgagatacaaacatacacattatccaaggcctacacagggtcaggatcatcaagatgtcactaggtgataggaatttttcagctccattaatatcttatgggaccactgtcatatatgcagtctgttattgactggaatgtcattgtgtgatgtataactcgtgtgtgtgtgtgtgtgtgtgtgtgtgtgtgtgtgtgtgtgtatattttggcctctaatattaactaggagatacatttttcaaggaagctgattcagctggatggatgtgttatgtacttgtttgctttttatgtaaatgtacctcagttatcccatactgtagaagtatatatgttgaagtcaacaactatttttcagtaagttatgaatgttaaaaatagagcatatgctacacaatagagacttgtataaaatactcattgagtgtgaaattgtggctactataattaacagagtgagtgtatgtgtggggttacatagacaggttggacatgaaatctttaagtatgacgagcctcttgtcatgatgacctcagatttaaggagatgcctaaggtcaaggcaggtcttctcatcttgaaaaagatttagaatctgggttgaacaaacctgtgaagaagggaatcatttcccagaggatagataaacctctagtaattagggaggcaggtattgtatcttaaaatcagcttattcagagaggggtcagatcttaccctctttccttcttgtttgaattcaagggaagcgggaaatagcagtaccatttctcctatctcattcttttttgtagtgagttgatagggtgtgataattcagcagcgggggcttccagcagggagacagcagagaacatttcagaagcatgtcattcttaatgtcagcaaccccgaacctccttgcggtgaaacaatcattagccaaaggtcctggggcagagagatgcatatgcttgtgaaaatggcctctgcaaacctcaggtacatgccatctctggcaggaggtccctggaggagtgttctcaactttaccctggaaggtgtaattagtcaccattatggttatcatcagtggggagggcagtgtgtaggtgaggatatcatcttgggcattcctcttttggtgtgatgttaattgttcaaagttatttctgagagaatctttctctaggttttttcatcattgtacatccgtgaaagaaatgttttgatcattttggccaaatggtcttgtttgttagtcaagcagtgctagttgtcatgtgtatgggcaataccccattggcctgcaaatccagaggactcaaagctggaacaagagatggaggagaacgtggctttccttctctttttctttgacattttactcagcactttgactgcctccctgattctttctgatggctctgggtattctgtgtcccatttcctggtttccggtgccatattcaggcaccaaggagagggctttttgaagttagctgtggctcagataaagtgtggtggcatgcatacacacggtggactaacaatatgacttaccggctttgattttgccacactagttgtgtgaccttgggcaagtctcttcccttctttgattgtcactctttttgtctatagcatggagattgttatacctattttgcaaagttcttgtgagaatcctattaaagcaatttttccaaattagttggagtataggaattacctgaatgatttgttcaaaacatgtatccccaggtcttctagttttcagcctaatgaatcagaatctccatgggagatgtgggaatttgtatgttaacaagtgcctaggtagtatatgatcaggtaactttggacaacactgcctaacagaatatacatgaaggtaggatgtgacactgagtgagagattggaagtgttttaaaggcctaatgaattttttgaatttaaaagttgtaaacaaaaaataaaattctaaggccccccgccatctgaatggaccccttctcttggccaaaggcattccaaatttaacctgaaaaaccagttcaggccatgatgggaagggtgtgggtaagacattcccccttatacagtcctcccttttggaattcaggacaagccaaccaatactaacatcaacaaaccttaagtctcataagaaatgtttacagtctattctctctgaagcctgctaagtggaggcttcatctgcatattaaaaccttggtctccacaactccttatcctaacccagacattcttttctattgataataacactttcaaccaattgtcaatcagaaaatttttaaatctacctacgatctggaagcccctgctttgagttttctcacccatccggatcaaatcagtattaaccttacatgtattgattgatgtctcgtgtctccctaaaatgtatagaagcaagctgtgccccgaccaccttgagcacttgccatcaggacctcttgaggctgtgtcacgggtgcgtccttaaccttgggaaaataaactttctaaattgattgagatttgtctcagatacttttgggttcacaaagtggagggcgtcttgttaacttatcagaacatgcttgggggcttctagccttgcctttgacaatctcaaaccttgaggaagcagaaagtttaatgctcagaaatgatttattggctgtctaatcatccctgccatttttattggctgtgacactcatgactcattctattttcattagtataaattaatcatcccgttcccccacccaccccgtacttgtgagcaccttcagagacctcccttcccatttccctctcttccagagagcaaagcctgtggaccttgggtaccaggttcctcttgcaaaggtggttgccctttcccttggcccacttacagcttgcatctgtgtttctctctcttatttactcaatatttctgccttctctatttctacttgcatatcaaggtgaaacaaggaacccctctgagcttccttgattgtagatggaaataatgacaacacctgctccatggggttattgtagagaaagcttctaacacaatgctgagaaagctttttaaaggtattagcgatttcatttagttccctttctctatcagttttggcaatgagtctttacattaagcatagaggaaagagggaaatccttgtggtcagactgatctggtttcagtgtctccatcatgtgcagtctgtaagaacctggagcaaattatttacctccctgagccttatttcctcatccataagccctctcagggctattaaaacagttctctgggtaaaacctctgtttttacacaataaagggttcttttaataaaaaaaatccacattgtctgttctcttttctagagtaaggaagatgagggtctgaatttgaatatgccaattccaaaaaaactttgggtaataaaacaccaacttggcatcctctgggccaaggagagattgaaatttggtgtttatttggctcttacatgtgattattttgggaggctttggggaaaatgattgccaaaaaggctagagggtcttttttaaaaatacgttttagtagagtcaagactaacaagtgatcgaatttcaccctgtcttaaagctttcaaacttgtttttggcaatgacagtgtgtaagaacacctcctcccctttctctcttccttctccattttcctctcctctctttcaggttttgtttttgtttttttacccattctccccttttattgttctcatcctccgaaatatggcagctacttttctttatctgggtcactgagaaaatcaccatttggcccatgattagtttgtaattcagctccattctttttcttatattaatgaaaataattattgctatttttgttaataataataatggtaattatcacttattgagtgcctttcctttatctgtgctaggcatatttagcaaatgttaactctgttagtcctcatgaccatccttacagcaggtggtgtcattaccgctttgcaattcaagaactgaagcagaatgctttagtaatttgccacattcttgctattaagtgggttactgtctacaattttgatgacatgagaaatgggaagtcaaacatttgaatagtaggaattttttagtagtcagaaaaatatatgtataaattctccctctaaagagatttgaggtgactaataataataatataagaaaaagtcgtacaaaatagaaaaaaatcagaatggagtgaaaataatgataagataactgagctgaagctaagagctttagagaacctttagagaattcataattactaataactttgtttccaagcttcctagtggccaaagcaaagacagagcttaatcaagattaactgagtgaacagataaaaactttactgctgttcaagggaagtagaactttttctaacattgggagtctgagagaaattaatcctagatgatcaagggtagacaatataaattatttaaaagtatgtgctattaaatttagttataattttgaacaaaattttaattttaaaatagttttaggattatagaaaaattgtgaagacgctacagaattcccatatacttgatgtccagtttctcccattaatatattattatgatacatttgtcataattaatggactgatattgatatattatcattaataaaattccatactttattccgatttttttagtttttacctaatggcctttttaccatgttacatttagtcacgccttctcaggctcttcttggctgtgatagtttctgcgtctttctttctttttgatacccttgacagttttgaagtgtattggtcatgtatattgttggatgtccctccattgaaatttgtctgatgttttctcatggtgagacttgggtagtttgtttttcggaggaagaccatagagataaaatacctttctcaacctatcaagcgaacacactcttatcacaacttaacactattgatgttcaacttgatcacctggctgagatattgtcaggtttctccactctaaattactcttccaccccccaccccccaccatattgtactttttggaaggaagtcactatgcacagcccacacataaggagtggggagtagttatgcttcattttcttgagactgtagtatctacatatattactttgaattattctttatgggagatttgtcttgtctcagttcaccttttttatggctttgaactaaaataaattatttacaaggcttcttatgtacaaacaagagacactgtaagtaagtttggtttactggttaaatgttagaatttctgagacatttctgtggcatatgcgaaaacggttgaatttctataattttaggtttattatttcttatatttctttatattaaatttacatattctacttactcattttacttttcctctcccctccattataatgtataattctgtatgggttattagtaaatattctaccttttcctttaaagagatgaattcatggcttttagaaactgaagtctctttaaaataattattacgtttctgatgtgtgtggttctctgtgttttgggtttataagggatattattgtattgttattcatcttgtgggtttttaccagtctgtcaggagatgattatgttgggttattgatctgtagtcattttctaaatacaattcataggatctcaaatacaaaaccattatttagactcttattctactgatttttcttttgttaaaaaattggaaatatgctttgtacaacttatttttttacttaatatgttgtatttttcatattaatgtataaaaatatttttgacatctgtatagtatcctatcctatgtcagtatcaattttgtcaagggtttgggcttgaaatgggatcttattttaatttgcatttttgattattgaatgcaattaatttttcttatatttatcaaccacttatttatgtatgtcattgtcaattactaattatgacaattagtgttatatatttcaatgatgtttatgtcaattgctaatatttgtattgggagttcagtgttttcttcaattttggtgagaatttaaaaaaaaatttttttgcagtataatttccagaaaaatttaaacctacagaaaacttgagagaatggcatattgaacacccttataccttttacctacgttaatcagttgctaacattttattacttttgtgctctttagtgcacaccttacctacctctgacacacagacctgtaattattttgctgaaccatttgtaaataaattgcagacctcacagtattctccacctgatcagccaatactaacaacattttcctttataaccacaacatcattatcacacttaaggcaattaaaattaatcctcatactcccttacaggtatccctgctgttaaggattcagagggccactcactctttcttgctattggagttctgactgatagagactacattaaaacatattagctaaatgaggagtgaaaagttgtcttattatctcagaaaatactctttagcctctagtgtatagaacttctaatatactagatggataatacagctcagaagtgcagttaaaccccgtctgcatgttcaggtatgtgtacatacataggagttggggcaggaaggaagacccgatttgccaaccctatctcaagtctagcagcttagcaatatgaatccagacctgcttgggtatgattaccacatggcagtgggaagccatgctggtcacacttgggcataggaggtgaaagtgtgagctcattattatcaccttttctttaacacagtgacccttaaaatgtggcttaatctattccagtctcttaatgattacatgaatttcccttaccgtcttggagaaaattgagtaagaggatggggtgcaaagtcaactctgtgtctctggtgcttctctgagtggagagaggaggtcgggtggaagtctcattctccccagagagcagaggcagcagcaggagaagaagggagaaacttgcaccttaatacgtgcctgcctgtggtgactacagtccacatcccttccttggtacttggcctcttcatctcctgtctcattagtatatctgagataagagttgatttttttagaaaacatctttagatgtatatagtatacataattacatataattcacatactatatgattcactaatttaaagtatactattcaatgatttttgcagattacattacttatttttattaattttaataatacatatagcataaaatttgccattttaattatttttaggtatataattcagtgtcatgaattacattcctcatggtgtgcagtcattaccactatctatttctaaaacttatttatcaccccaaacggaagctgctactattaaataataactccccatttccctctttacctatcccctcttttttttagacagggtcttgctctgtcgcccaggccggagtgcagtgtcgtaattttggctcactgcaacctctgcctccagggttcaagcgattctcctgccttagcctactgagtagctgggactacaggtgtgtgccaccacacctgactaatttttgtatttttagtagagacagggtttcaccatattggttaggcaggtcttgaactcctgaccttgtgatccgcccacggctgagtgaacagataaaaactttactatttttatccctccctctcccctcttaaactctaatctactttatgtctgctatgaatttgcctattccagataccccatttaagtagacttatatagtatttatccttttgcgtctggcatatttcacttaacataatgttttcaaggtgtgtctatgctggagcatgtgtcagcctttcttttttatgactgaataatcacatcctattgtgtgcatatactacattttgcttgtccattcatcttgtccaaatggacctgttggtggacatttgcatcgtttctaccttttggctattgtcaatgatgctgtggcgaacattggtatataagtatctttgggtctctgcttttagttctttttggtgtatatctaaggagtgaaattactggttccatagggtcattctaagtttagcttggtgaggaaccaccagatgtttccactatggctgctccattttacattcccaccagaaatatatgaaagttctaattcctccacatcctccccagctcttatttccctctcctttaaaaaaattatacccattgtagtagatataaagtagtctcttattgtggtttaagaattgattttttaaaatactagaaatctgtgggatgaaagtaaaattgattgaatttatatcatcctagaagtaactttttttggcaaggataccccagggagtgtcataaaattaaaaattaaaggtgtctgagagtaaggggagaagcacagttacttctgatgtgcttgatgctaaagctccttgatttgcattgttttatggttgtgttgaaggatgatttctcagaacagtggtatttaaagcagctcttctaagttctaggaaggattcagtcatcctctctcaccagcttattttttagtatatttaatagtgctgagaaataaccagtaaatattagatattctttacccttatttttgagaaagaagagtgttttcactctctacagaagaaatatccttatctcttcactaatgatagtagaaataataggcatttcaaaataacagttacttaaacacataagggctcattctttcctgtgaataaatatagatatatggagtcttgggctactgtgatttccccataaagtcatcaaggacactagcttttttgatgttttttagtcctgagttctattttcaagatcacctcatggtccaagatggcggttgaagtttccattatcaagtccacagtccatgtagcaggaagaaggaagtgggtgtggtgcatacaaaggatgtgcctcacattggagtgagccttctttaaacaatcttcttagaagatctacgtcatacttgtgcttgtatattattgaccagcagctaggtttataatcaaactgaggtgaaggggaatcggggcagtgtaggcttttatctgggtgtcttcctatccaaatattggggttttcttactaaataaaaagggagaattgatatggggtgggtaaaaagacactcaaaatcataatttctcagcaatttacattgaccagtatcacagacaccaatttatagtccaatgatagtcacaaggtaaagggagaaggtggtgatcatgagggagatagtatataatctgagcaatgtaactcacaagtttcattattcattaatacattcattcattcacttattccttacatatatattagtaaagcatctgtgaggcattctctccctaatccagtaattgataggtacacatgtatttgactattcaaacccgtataagagccaaataatccttagttcaaagttttgctctgccacttttaagataaatccgaactcagttaaatagcttgtggatggggtgaggaagagggaccatttagaaacctagtaaacctgtggttcgatgacctttttctccacctcctccctggcttgggatttgattttggctacctgtggagagagtcatccactgaggggtctcagagacattgtgggggtgaagaaatgggtaggtgcccaggagatttcaggccagcccaacctgagttcagaggcttaaagtccagggagggcgagagaggatgaagcatgctgggtcagtcgggctggaggcagtgggggagtcggagggagtaggaggaagtaggaggtgctaacatcatgagaagcatgagttaaggcacaggttctcagggactgtgccttgcacttgtactcacttgttacatcactgactgtccctctctgctacattgaggcaaagtctgaggaaggttgaggttgcttctttctcttttcattagtaaagcaaatctggatagaaaagggtgagaagccccatctttgtcctttggaggaaagggtaaaactgtgtgacctcgacgattatgatgtgcactcttcactgagaaccactagtctgaatctgttccatttctataaagctttttccccagttctctgctgtgtacgtctagatgtggattttatgtggctgaaagatgatctctagcatgactgtcattttccaactgagcagcagtatagcttttcctttactgaacaattttctctgagaccttgaatcacttttggaatttaatttcatttgctttttcaatatgataaagtagaactctctctgaatttgattcctcacttacaaatagatatgatactatattctctgttgaaaatgttttggaactgtgaagatgctagagagttagatctcgtgtttcagggaacagaactgaaactcagaagggtttcattctgagggtgaagccagtgtgtggaataagagttaaattttaaggggtacattcctggatcatgccttgttcaggagtctttttcctgacccaagaaggcctccctcaggatacagtgggcatctcagtctttgtgaactcttaaattcatttcttacccagggtggctaactctgtcagtggactattttgtgaacttcatactttcggaatatgttatacttatgtgattcttggtagtctcaagaaccttggtagaggttcaaatcagtcaatctggttaaaggtatcagtattcagtcttggaatcaagtggcactagagctcttaaggcttggcggttttcaggacctacatcacaagatacagaagtggtgtggcttggagctcgtaagactcgtgtctggtccaaccaggtaacttggggcccctggcacccatatcagacttttctcatctgcaaaatgtgctgcttggagtgggtgatttatttagtacttcccaggcccaaagttctgagtctgtaagatgtagtggggttgaccagcatctccttttggattctcctttaaaactcattcctttgaaaggagattgctaaagtcaaaccttagaatccaaccctttgggctatgatttaatgttaaaatgctgtaccctttcctttcctcctttttctcctttactacttctattttgtttctttttcgaaaaaatataccttcttttaaaatttttcttcatttttccttcttctctgtaaattatcaagggcctttgaagagaattcttacatgttattaagaaattgcagtcagggagccctctgttcccagatcatttagaagattgcttttccttttgttaaatacaaaaaattgtcaacctgtattgttaaaatgtgccaaaaactgcattcaccaataaaaaatgtcagctctcattattgcccagatattattcttttcaaaagcggagcactcttgccaggctttctaaacaatcttcagctcattcatcttcctggttttgttacattttgaacctctctgggtctatataaggtggcagcctgtcttttaaaaattaatggattccaaatgccattcaaacctatttccgcccttaacctcctcctcttctccccaaccctgcctgttaggagtcttatgttctgtataaatattgagctggagatagtttctaaagaggtgtttggacctttaattaacattgacagcctgtctgcttaggattttgctctgctgtctccatggaaaagtcaggtaggtcagtatgtgggggagggacctctgcagtggatgtgttcctggcggctggccctagagacactgcactctgagccaaccgtgaagtcattttgaatttaaggagtcttgctaatccaaggcaatgtgtcttaatttgacaaagtaaaggctgcccgataagcaagcctcactacaagttctgtgaaacagggggtgtttgtaagtttagattgtgctagagaaatgtggtgatgtggaagaacgggctcattttctcctgtttactccctttcccaccccatccccctcctctctcccttctctcttacttactttggcccaaatcagccctgcagtctggcctctgcagtggcttgatgtgaaatttgagaaacatatgtagttttctatttcaggaaaatgatctcagggattgaatgtgtttttttgttggctgttaagctctgatcttgcccagtgtggttttttgatgatgggaaagaggcttcgaagtgctttttatcagaatttcatgtaataaaacttaaggtttggtttctttattttggcccccaaccccctcccaggctcaggacacaatgtcgtctattctgtcagaagtgggaagaagtacacattgttcatattacaatcacttctttgctgcttgcacacacatatataagaatggccactgtgtctatccttcacaaaagctattttaaatgtagttcagtggaggaccaaaggtctgcgtagtgtctcttacaaaggaaaagggatctgttgggggaaaagtctgcctttgttttgccttggaagggccagtatttttctttgttctagaggtgagtgccaataatgggcctagtgccctatcaagcaaacttcattaatccagccctgcaaagggtacactgatcagataaaagggacctacatcctcaaagctcaaggtatttgtttttaaacttttttcttactgtaaataaatatcactattgtacttaatctcatattcataattgtattccttttcttaaagagcctttacataaaagcttcaggccctacaaaatccgagagcatccttcatggaggaaggatagtagactcgagggtgagtggttgaactttggctctggtgtaaaatgcccaccctgggacttattgtgtgaccttgagcacgttacataccatttctgcacttcattgtcttatttatatttcatgggcttgttgcgggattgaacaggttcaagtgtataaagctcatagtacaacctgctaaggactcaacattagctattcctgctgctgtttttattatttgttgctggcgtataagacctaggcaaatggagctaaatactattgtctaccattaaaatattcaccttctggagggaatagtgcaagggtaacttcagatttgcattgaaaaacccatggactatcactttacatatttatttccttaccatcttcaacccttatccagacagctccaaatgcacattattcagaaaattggtgatattttcacagcactgagactaagctcatctcctgctggtccttatcactcaccagcctttcagccacatcagacatctcctcaatctctgggcaaaccaggccttttcatgtcttcttgactttgcacgtactgtttcctccccgcagagtatcatttgcccttttttctgcttgtcaactgctattcacccttcgagacccaacttaaatattatttgtgaattttgggcagttacacagactcttttgggcagttacacactactgtttcatttttcctatagttcttcaagaacttctctcattgtagtgtaattatttcttgacatacatttttcttctaacagcctaggaggtctttggatgaagatactacagtctattcacttttataaccccggtacagagtgcatgacacgtgttaggtgttgagaaatctgagaaatcgactgggaagagttttttttcataccattatattttaaaagctgcaatagtttgttccagaaaagttatatttttcccttggtgtatattctaatttaaaaggtgtttttaatgcctgattgatctccaatctgtaatgactttgtagcattttctttgtttccctgcattcagccttctgatttaagcagataatgcttggaaacacctgtttaagttgtatcttctttgctagttgtaacttcatgagtacagggaccatatatgttctgttcacagctctatccccaagtcctaatacagtggttggcagttctagaggtagaagaaattataataataatagtgcttgtattttatgcttaacagagcacttaacatgctggccactattgtgagtattttagatacattaaccccttcagtcctcccaatattcttatgttatatgtattataattatcatctgttttctacagataaagaaacagactcaaaagaggctaaggaacttgccggtggtcacacaatgattggcagagttgggattttaacctgggcagtctggctccagaattcaggctgtttgccataatggttccttgcctctgattagtactaattagcttagtacttgtttgttaactaattattaaaggaatccaacagagacctatttctctaatgtaaagagttcattcattaggcaaataatcaccctaagccagttgttctggaagtatggccttcagaccagcagcatgagcagcgtcacttggaaatacattggaaatgcaaattctgtggcctcactcccaccctactcaatcagaaactcttgggagtgggaccaaataatttgtgttttaaaaaaatcctccagaagaatctgatggatgctaaagtttgagaaccactggccaagactcagccattttctctggaattttacccctgatttttgcttttcttaagaagtcataattttgggtgtctcacttttgcatactcctgatttttgtgacattaatgtggggactaagctctaacctcagtgaatgtttttgctaaagtttctgagaaattttgaaggtttcaggtgtgtctgtagcttgacagtgtttgtttcttttgatttttttttcctgtgatagcttttaggatcaggaaatttaaaaaatatagtacctcctccattcagccctgctgtctcagactcccctaactggtgagtgaagaaggagcccagaggtgcagggataacagagaaaggggaagtagcagaatcagtgagtggggaatcaaagtttgatgttatcgcacttcctagaagtggcctcaggtcctttggactgttggtttacaaatggtagaaaaaagggacactggacttcaaactggacttggaatcccagttcagtctctctatctatgtgattctaggaaagtaatttttctgagcaacagttccctcatctttaaaatggggataatattactaatgttttaatgatgtgagaatttatggagatgcatgatgagcactcaattcatgcttgttgtatctatactgaaggaagctgtaagagatagagttagtcactagcatatttaccagtgagtgttctaagaaatggattatagattttgcagagcaacaaggaatccacagcattccacaatggctggtattccaaggatcgaaattctgggaggttcagttgcagagaaaactaggcaccagtttgaatgcattatgtcttgagtctgctttttttttttttttaaaagaaaggtatctaaaagtgatttaacaatgtcaggatttagacttaagtttttttctgttaaagaggccattgctgaaagtcaagacccaaggactgtacaaatattgatgcaactgtcagagatacatggtatttgaccttctattaataaagacaaattattgcatttctgtgatatttgagtctgcaggaacttcccttaattccactggtattccattccacggctaccagggctgctgggacaagggacgtggcgttgtgtttctgatttacgaggtggaatattagtctgatttactaaactgaaagagcaggttcagataacaaacaacatagtgaaacttcctgaataacagccacagaaacaactcatgtatttggtggtatcacaacaagtttggctagatttatccacagactagaatacaaaccatggaggaaagaaagcaggtaagcacaagtaaatagagggcaaggcagatactagtggactatactggatgtaggaagactttgaggaaggcttttttttgcagacatctgcagggtgtaggcagtgaagtgtttgttgtgactatttgccagcaccatcccacttcacaggtgggtgggtggttccttttcaccaagattttaatggcaggttgtgccccataaaagggcggggcagtataccctgtattagtttaaaaaaggtctcagcttacacgggacagcatttttactttttacccttgcctttgctcattcacagggagtacttcggaatcagcccatctaagcctcagacttcaaagggagctcattcctatttgacaacagtcatatccattttgccaactctttgacctttgaaatagcatctactcagtcaggtctgacctgtcaactgtctgtaaaaacccatccagatcaagaacttgatattttcaagaacacatctaaaggatgggggcccttctaattttgtttctccaggacttgttttgggagaagccagctgcttcttctggtcttaatgggatgggattatagatgggttgagtctgtgaggcctcaacttacatgatgatcctgtgtccttttattataggttgcacatgttttagccactcatggcagcatttttctccagctacagtcaattttgtctaattattgttgatcatgattttactgtaaaaaaaaatttttttttttgagacatggtttcactcagtcagtctggattgtgcagtggcacagtctcagtgcactgcaacctctgcttcccaggctcaatcgattttcctgcctcagtctcctgagtagctgggactacaggtgcacgccaccacgcctggctaatttttgtatttttagtagagatggtgtttcaccatattggccaggctggtcttgaactcctaacctcaaatgatccacctgcctcagccttccaaagttctggtattacaggcatgagccaccatgcccaggttgtaaaagtatttttaaaaagtgttttcagaggccatttgccatgggaaaatgggatatgttgaccttcctgtttacctccatttgtgggcttttggttgtgagcatcagttcatatccagttttggggaccactcttgggtatactttaaataattcagatgttgaaatttttcagaatgagaaaatctagagagaagtccagtttgattatactagaacctcatttgctgattaaattgtaaaattcctaattgcaacttggtcatgtctttgcaaaatagtaataataatattaacttctatttatatagtgactgtcttctcaaagaactcaaaacagtgtccttttctgtatccctgctattcccaaaacatgtttgtggcaatgtatgtggcttcaaaatgtggatgtatcattatgaaatataaatgcatgtggtgatggtatttattagaatcatatgttattggaagtacctaacattgggtgtaaaggaagcctggtcaagtttccaatagagatttacaattgggcctctttgtatctcagtttcttcatctgtatagtgggcataatagttcctattttatagagttattgtgatgattgtgttaatacatttaaagcattgacacagtaatgctgggatagtcctcaaatgctattgtttgcatcggttttagaatcagtctaataaatatgagtttaaatacccctttgtcccttgcttgttgtgtcgtcttgggcaataacagtaacagtcaacacagatgctatttattgaataatacttatatgtcaggcattatattaggcccaggatataagtgattatttatcacttattcctttaactttcttaaataggtatgattatactcattttatagatgagttaggtaaggtttagagaagttaagaaactttcccatagtaacagagttagattactggcaaagcggactctctgaattcttgtttttggttacctacttaggttcccctgaaccacagtttcatcatttgtaatagggatgacaatagctctttgtaaggattaaatattgtacataaagtatctagcacttactgtgcattcttgacatgatatacaatgatattatcctctccaattagagctttccatataatataatttttttctttgtgttccttatgccatgcatatatctttagagattaaaagacacttcttaagaatggattcttgcatttctgagaacttcagaatcacacttgtgatctgacacagtatatatacactcaggtattgatgtgtgtatgtgtactttccattctgttcagtctagaagtgtatagatgctcaatctgggtgctttgtaaggaacatcacaaatgttcaaaatcgtggatggacttgaacatgaaaatgccttggcctcaaagttttgcttttctgttctcaaagttgttgaggaaactggcttagttaaagctaagtgtttagaaaccaagtgtgttttggatggtaaggtggagtcagcattatatatattaatacatttttggtaccagaaacagcaacaatcccttagtctggtgtgtgcagatgtaatatgtttcatgatatttcagcctgtattttctgtcttaataagtgaaagcactgcagaattgggctgcaggccactgccccatttctctccttttgtagtcagatctcccttgtgaatgataaacacccactcctttcatttattcacccattcactcaacctcctacaatctaagctgcatgcttaccacctaccttaaagaacaccagtgattgcttattgtgacttacgtcataaatatgtattctagacatgacttctcacctgaatatcagtgtcacatccttcatagcctcaaaactttgaggaaatatcctcttatggcatactttaaaatttgtaattttaaagtaagcacaaagtacgttttgagaccttcatttttttctctaacaattctgttttgttttttttttttgtattctgtattttttgttaagtttatatcaggatgatttgtcattagtgttcttgtaacatattttggagttttccttgtgcaatgtggaaatagtaaggttgacattctgcttttaactcttctttataaactatgaggaattcccaaatagaatgttaccttgaaagactcttgacataagtagaactaaaccaaatattttatataattatttttattttttatttttgagatagggtcttgctctgtcacccaggctcaagtgcagtggcgtgatcatggctcactgcagccttgacctcccaggctcgagcaatctgccctcctcagcctctcagagtgcttgggattaaaggcatgagccaccatgcttggcctctgtaattcttaattattattttatatatgttatgagtatgagaactaagcagttccataaagatgagaattataatatctcattttagtagtattttgctttgtattatttgacattttataaaaattcatagtctcaaaaaatatacaatgttcttcgtcaagtagctaatactctctttcttagtgttcggtttaactattaatcttatcctgttaaattatttaaaatttcctaataattggcacataataacagtttttaatgtcagcattgataacatttttctgtcataatattcaactaagggatgcatcttcaatgtataaagcccataagtaggttttttcaccctagattagatctaaattgcttacctgtttttggaagtgaatattatgttattaacaataaattccaaactgctttgtattactgacattgtaacaatgtcttgatatgatggagacccttgctatcacattgtcattgatcatgcacattgatcatgcccgtgttgaaataggcaatgccagagacagaccaaagacgaaactggtagtgattttggtgaacattgttgccatgttaaacttgagtatatttcttgttgaacaaccccattttagagatacggaaaatgttgtgaggcagagatattaagtaaccctgcccagagtcgaatggttaataagtccttgccaggatttaagtgataaaacaaaactcatgcttttaactactatagtcttgtaagccactcaacaagtattggccagttaaactaatgaattccctcaaggaattgattctagtaatagagataaataatcaagtcataagtcatgactcaatgtgaaaagtcttgtgactaaggaatgaacagtacaataaaggaaacatgaggaacagtgaatcgtggtaggattatggagaggaggaggaaggaatgggggagagtggggcctcagagaggtgcaccaagactggggcccaggccttgcttccaaggtaccatggcgttctgtgtttttccttgtcttgggcatactattcagtgtttcgatttatttacttgtccttacctcccactaggctataagctttctgactgcagaggtaaattgtgtgtcttcatcacttagtgcaggaagtggtagctaatgagttggatatgtaggggcgagtacagtggacaggtgaagtcaggacatgatggacaaaagcatgaacatgaaagaagatgtgaacattcgttgcctctttaggaaatggtcgacagtgtggagtggacagagcacggacatgtagcttggggtattgtgaagggatgggtcagccgtgtatacttatctaccatggtaaaaagtgatattattagatttctgagtgcttgcctttccctaatgcatcttcatgtctttaaggacaaagatgtaggaccaagagtgggctacatcacaggagatgaaaagatctgtttgcatatttgacctctgctaattatcagcagtgtgatagtaggcgtgtcatctgacatcatcttgcctgttgcatagtagacatttggtaaagatttgttgaatggattaattaatataattatatgtttttgcggactctgaagaatttgagatacagctatataaaagagttactatttattggtacatattgcttagtatttggaataagcttggtaattattcactaagcaggaaacagggtttagggatttccaggcattagggacactgagccttgagacagggtagcagctctgtggttcagagtgactggtccaccaggaacagaaacaagctagtattgggaggtgagggagtaacattccttgggaggattatttggcaaaacgaagtaagaatcataggggcatagggtcatggaaaaggcttcattcttagtagagctctggagtacccatcaagtctgggtgaagatgcttacctccctgagagggcaagcatcaggaaagcctgggtatgggggtcccgggctcctgaggcccaggactcattgctaggatacagattgcactgtcaagtccagactgtcacgtgtgagtctaagcctattgttttggggcttgccatggtctggatggggcccctcttaaaggttatagagttgtggaagaaagggactgacacattttgatagtcaaagagtaaaagaagctatgagttaccagtgtgctggatgcttctgaaagcgtttgacaagtgctttttgagtttttaaattaaattacttttttatttttgtcttcctctctataaatcataccagagaaggtaacatttttctctatactgactttgacaagcctagactatgctttgtctatgtccagtgtacaaatgtagagaacccattcatttctttactcctcacatatttagtaaagtccggctgtgtgccctgcctttaggggacactgagcagaaagcagactcctccagacgattgcattgcagtataattagcaccataacaagagtctggcagattctagtctgtagtagcaaaatgaagagcaatcaggtctatccagggaatgaggaaatacctcacaagataggaagtgactgaactcggacttgaaggatgatcaagaatctgccaggtgggtatgggggccacctggcaaaaggacagcatatgggaaagcagaggcatgaaagaccttggtgcatccacaaagcgttgggcacgtgagtctagccagatcacaggttgtgtgttggggagcatttagagaagagaacacaaagtcctcacgtgctttactcaggctttgggcttaaggagtgtttctgatgtgggctctggagccagactgcatggctgtaagccccggcctctctgcttcacacctctgtgatcttggacaagtaccttaactttctgtttctcagtttcctcatctcagatgataataggacatgcctcacagggtggttgtgagaacctgaataacatcgtaaagcacttcaaacagtgtctggcacatcagttgttattaataataattatataagataaaattatataattcataatgatgatgtttaatttgtaacctgtagtcaaaaagtagaaccaaatacaacttgcaagggaactggatgcttctggaagagtttgataagtgttgtttgagtttataaagtaaattaccttttttactttccaggtaaaaaaatatacctttgggaggggaacaacacacactggagcctgtcggggggcggggccacaggagggagagcatcaggataaatagctaatgcatgtggtgcttaatacctcagtgatgggttgatggatgcagcaatccaccacgcacacatttccctgtgtaacaaacctgcacggcatgcacatgtatcccggaacttaagaaaaaaaaatacattttttctttccaggacagcgtcagtccttaagaggctagctcaaagactagaggaaaaatagactactaaataaatcaaaattatttagtagggtatagagttatccataaagtgctgggggtcactaattattaaagcagatagagcacaggtagttgttgagcgtagaacagcccaatcagaatgatgcctcagaaaggcagtagttggcctcccagagtggagcatggattgcagcagggggctgaggctggagggggagaagtgttgaactaattcaagggatgttggagggctaaaccagtgtctcttctgctaaatctgagcagaagagacagatctggaagcttctggtaaggtaggcttgattgagtttggtgagaagttagatgaggagggtgagaacctagcatctgggtgtctgctagatagatgctgctgcaccacaccaatgtccgtgtgtctgggtaccgaggtggtgttcaggacaggtcttctccacgtactgccgctgagctcacatccacgctgtgcatgctgggctgagttctcttcaggctgttttcagctgacttaaatgcaacacgtgatgatgagcatatttacataatgtatgcctggtgaaatcacgaaagattggaatttcccattttaattccattttaaagatgcttgttaagcaaaaggatataattcatttttcaaactgctgaaatgttatttggcctcttgaatcaaaggcattccgcaagtgttttctttattacatgccttaaactttaattagaatttaattataagatcctgaaggcatgagcaagaggagcagatgggatagtaaaagcagcttagtgagggaggattaaagattaaaagttgcttgttaatggcataagaaatgaacagagagctaaattactatgcttttgtgctatcctgatgctttttcgattctgtaacttattcctggttgcaggtttttcaattctgcaacttattcctggttggaagttgaagaatctcacaaattagatttttaattttttgagttgctagagtagatttgtacatagaaaacaggtaaaacctgacaaaaaggtgttttatggctagtagcaccttgtacaataatttctgcattgtaggggcttagtggtatttactgaattgaactaaaacttacatcatctcactagtaaacatcgaatgagcataaaataagatttttttttagagatggatggggaaggtgtgagtctataagtccaggctaacctgtcccatggaatgttagatacctactcaggaaggtaacttgtatgaacctcccacctttagcctaccccccagtcgaccttagtcatttgccccacttggttggttggctagaggagtggtagaaatttggtgtgggaaacactttgagactgctcctcatgtcacacagtgaggatgacctgctctgctctctggtgctatgttacgatgatctcccgttaggctaaattattctacttcttagtgctttttcccctagcttttttttttttctttttgaaatctgatatttagagtcctcttccccacttaattgcaagctcaatgaagaaaaactagagaacaataagatagaaaagaagacaaaaatgtagtgaaacaaaaagcattctatctcctattttccaggaacaaatgttttttaaaaagcttttttaagcctgttaatagacagttgattcttcattatttgcagattctttgtttgcaaatttgcctacttactaaatcttatttgtaaccctcaaatcaatacttgtggcactttcacagtcattcgcagaaatgctcagagaggaggataatttctgagtctctcgtcatgcgtgttcctagccgatggcaaataacacaacaccctgccttcttgtttcagctctcatagtgtaaacaagtgtccttttcgaagtctactcgtgccatgtttttctcatttttgtgctttttgttggcgatttcaccatttaaaatgcaccccaagcattgtgcaaaagtactgtgtagtgttcaagtacagtgcaagaaagctgcgatgtgccttacagagacaataacgtgtgtttgataagcttcattcaggcaggagttaagtgctgttggctgtaagttcagtgttattgactcaacaatatatattaaatgagttgtttttaagcaagaatacacatgaaacagggttgcgtattgatgagttggcaaaaatataactggaggctcagaggaacctagccctgtatttcccttaggaacaatggtccagtgttccctaatttaatgtttttggagactaccaaaaataataaggtcagccatgtatctttctccttttctccttgctcttgcttgatctttccatctcttgttacctcaatctgtgtgtatatgatatgcatatatttacttaaattatatatgcatatatttagcaattatgatatcacatgatacacgattctgcaacctgtcttttaacttatcaattgtgttggcctttgggctgtttgcactgagatccatttgtcacccttgccctgctctgcaagggtgctgtgttacagggggttgacccctgccccctgacaatttgtcatcagtgggagatggcaaggcaagagaaagagaagctggagtatttgtccctccctctgtctgccttgggcagcatctctggcagtggcccctctacagctatcccacctgcaggttgggtcctccatggctctgtcatcggctggttggtcctgggtctcgagctttagccctgccttcttcctttgtccttttagctgatgggtggaagaagcttcctgctgatgctgatctctgagtttcttccctgtcccctgggtagagcatcagatttaaaagccaaggcaagacaaaaaatgagagaatggtagcaaagatccaacactttacaagaccgcctgagaaaagggaggagggggtggttcgacaccagggcctgcacactgagtgtgtgatgttgcagctctgcaggcacagattaagcagctaagatgccatcaatgcttggaaagcagccggtgcctcttgtcctgagcttatttgtctggaatatgattcccttgaacctgactagctcatccacggggagagagaaaaaaaaatattctgatagttatcctgaccaggctctaacagggcctccttccctaggatataattttttctggcctctttccattcacttcttcacattaggacccttttcccccagagtgtgagattccctgagggctctaaaaactggaatgctatacagcattttaagccccctgtgttggcacagtccttattaaaaatgtattttcctcaagccatggctgcaccccctgaagtgtggattaacagaaaggccttcagagctggaagacatttttgaagaaccgctgtaccaagtggcattaaatatttattgcctactacatgtaaattgttcatcatcttgttttaactcttggaccaaaaggtttctcatctgctttctgctaaagtggaaatcacaggaaaggtactctttactttgctgtggtattttgttttcccaggaatacggaatatttctttgttctcataagtaatactagaaaagattgccttgactctcagcatttcattgggaggccatgtggtgtcatgatggagaaaaactcgaattctggggcaagtgcattgggctttgccacctgcaagctgtgttggcttgagaacctgataccatttatgtttgttgtgctggaaaaatgggacattgcataaatagcagatagcacaattcctggcacccagtaagttctctctttctcctaggtcttctatttgggactttgcaaatacatttctaagcaacctagaataaaatatgctattaatatgctgttaataataaccaaaagcactcagcttaatctttacttattaaataaaactgaaatgttgctcagacaccttttgctgtttttggaatgcctttgtagacacttttgatcttgcttaaaaaacataacagcatttcaaaggcttatcttagctattcttattcatacctgaaaacctacagagtttggataattttggcacacatatgtgtgcacgcatgtatatgtataaatattctgtctctctaaatatatatgtatatgcaggcacatgtataactctttaagaaatgtttttctaatgtttaattttcttaaagtctgtacttcacatcatttttttccccagaactgtttatcctcactccagacatgacccttggaaaggtggcagaaaaaacaaacggctggtgtgttttggggcagtctgcattccttttaactctctgagaccaggcttatgcatgggctttcaagctatttgtccagaggcccaaccactttgatttctgcttgaaaattagcctgttgttcaagctcaggagagcttccacagagctttcttgggttcgcgaactagagatctatgaagtgtttgcttttatttgtaactttaaccacggcagccttaactggacttttgttttcttatttaacttttatccatgtaaccttaacctaagttctttttcaaatctccatcctcccccatctcacaatttctaatccctcttttgtccttagatttttccttcaaagtcaggatatgacatttatatctatgctttaggaagtatctgaaagctaacatacacatagaattatgatttttttcttgggttgcttaggaggattaaacaaaggttttagaaggcagaattcagaaaaaaattgatagaagttgtgctgcagcttggaggggagtgtggattttagaaagcataaggacactttcatttgtccctttcatatggacttttatttcctctgcgagaggcccaggggcctggcctgtggatggtttagacaggaaaagactgaagggataactgcttccagaccttcagccttgaatgttcagccattattcaagccgttgagaaagggagcaagaggcataaggaggcttcgggagtttccatgcagcttctctgagttccagcttgtgtgcattgttctccaaatgtgtccccagcactactgaaaggactttcatacctcaactaacccttattgcaagcctgtgaaggaagagttttttatatatatatatatatatatatataaacagacaaggcaactaaagctctgggaggttacagaaacttaaggcctaagtagggttacattgagaccagattaatcagttagtagattgtctttctatttcatcatgtgcttcatttcctccttggtttacatgacccttctttggaaatttccttctggtaatatcttagttaaatgaaataactaagttttatggagtatccattatgtgttaggcattgttttatgcaatatgcatctatgtagtgcacattctgataggaaccatgtgaagaaggtgtattacctccattttagacaggaaatccctgcaatacagagggttaggtaatttgctcaagatcacacaggacacagtaggtgacaccaggatttgagcccaggtctgattccagaacttatgccatgcccactacaccagccgtccttattaagaggaaggccattggtatgaggccacttgaaatagacatggtagatatgtggcaatcaatgcaaaggtattgtctttcatgctctgttgcaatctcatttcatttctagcattataggtatttaaagcagaggtaggcttgctttcttagtttcagttttctgagaaacaaagatagtaacaacaatgatgatggatcttgttaccatatgtgaatatctgtgtgtactaggcacggtacttggtctttacacatgttcttctaggttaaccttatgacaactctgtgaagttttctcaaatttatatctgagaaagcactcagaaaggttgagtcacttgcttgcccacatcacactactagtaagtggaggagtgaggatttgaacctaagacctcttacaataaaattatgttctttccactcagtatatgggacatgtatccctgggggcacatgtgagaactataattggtctgtaagattattgatgatggtatagggatagggtgttaaagaacattgatgcccatagtgaaaaagtaattccctttcacttgtcctaccaaccatctggttacatgaaagaggaagtctcagttaggtgccagtatgccttttacaattctaacagagaacagggctcagactctgaggctcgggcaggtaattgaatctagaagaccatggtgacgttctttttgtttttattgtattttaatatcttctcattaaaaaatattataatgtgttcatatatacaaaataaatgtaatgtatatataaggttaaaagaataatataatgagtatccatgtacctatcacctattgaagcattagattaattttagttactatgggaaccttctgtgtcactcttcccatcccaacttctttctttctctcctaccaacatcttacataatcactgtataactatcaaaatcagccagttaacattcacataatactattactcagtctacagactttttgctagttttgccagttgtcatactgtttcatttcctggaccagaatctaggatcacacaatacatttactagtcatatctcctttgtctttggaatagttcctcactctttttgtctttcatgaccatgacgtttttggagtctggttaggcattttgtagaatgtccctcactttgggttggtctgatgtttccacaatattaaattcaaattatgtgtttttggcagggaagctacagaaatgatgttgtgcctttcacagtgcatcacagcaggaggcacatgatgccgatttatcgtatcacaggtgatgtgaactttggccaatttgttaaggttgtgtcttccagtttatccactgtaaagttactatttttccatttgtaattaatgattaccttgtagggagatactttgagattatgtataatatcatgcttcttatacctttgtccactaattttagcaactattgtaaattcttgcctgaaacaattattcctgtggtttttccatatggtgtttttctatgattataattctttctatatttattaactggaatgctttgtaggtggctttatcctcgccacacacttatttattcattcagttgtttatttgtatcagtatgtacttacaaattcttattttattgtctggattataatccattagtatcattattttgttttgcaaatagtccttttaaccaatggggatcccttcaaattagcttttctatctttctgacatgtctccatcttttttaaggcatttttgctttctggtgccagaagataccactttgtgctttacttgctccaaccctgagagaagcctcctcttgctgttctgcatccattcctctcagtcactccttcatgcactataatatgatttccactctccccagtgcactgacacttccgtcacttaggtcattgctaaagcagtagatattttaattcttctattactgcatatcagacatctcttggccccatatcagatcttctcaggaggacagtaaagggaaattgtaccatctcttgttccagctgccgtgaccaagtttgcatagactctgaaaaacttcctacagtataagctgacagtacctcacctcatgctgcatgcttttccatagggcaccccacgaggttccatggggtttccttgtggttgctacctctggatctcactctgttcccacacatgtacaacctggatagagaattaatgcctcctttctctctatcgtggatggttctgagatacagttcatgtggcttggggtgtggagaggttgaggatgatcctatgggatagagaacgagtcacttctagtggggccatcttgataccacaacttcatcttgcctccccctccttattatttgttttattccctttgtctatcagtcctctccttctccctaagattgcactacctgatgcagtagaaccctcttccttgggtctgctgtctcggggacccaggaaaagatgtgcagtgtttaaactccttctctataatctcttaactttcacactatcacattttcattcatttattccaattcattcattcatttacaccttatttattgagactttccctgtgtgagacattgtgtacaggtagacaaaaatcttgatcttatagaagttattgtatttgggggagcagaaataactaaataaaaccaattcagctgaattataagtgcttttaagaaaatgcaacagggagagggcagagagtgggccacgtggggcctggcattgggatggttaccacatacactctgaggaaatgacatttgaactgataaggggtcagcaagaagaaatgggctgagagaagactgatctattcacaggaaagaggaagtgcaagagccctcattttctgttttgcactagaactgctttcctatgattcttcagattgtgccacctttcttccaactcccatgcatttgcacagattgtttctttgacctggaatgccctctctgacttaccaagctggcagatttctatccttagctcagatctcatctaaagcagctctccacccccagggacattttaagtcctttttctgttgttggtgtgctgtgctttgagcacagtattcatttataatagtgatgtcagtgtacgccttagaattgttcacctgcatctctccttcttggactaggagcactctgagggcaggactatgtttgtttactttgtattcccaacaaagtgcttatagggatttaaatctatttattgatgagttggatggatgaatggatgagtacatgggagaaagaggaaaaatgatatatgaattgaaataaataaatgaaagagccagtgaataaatgacagtgacctgaccttaaggcgttgtcttgtttgtgggtgagacaggagtataaccattcagagtactgtgatgaatgcttagagattctcagtgcatgaataacagtggcagtcagcaagttctgctcatagatgcatattgtttcagctatttcatgcttatttatttagtttttaagaaattcatttaggtaccaaacataaaaaaaaacccagacttgcagctttccagatttggggccagacacatgactgtaatcccagcactttgaggggccgaggtgtgcggattgcttgaggctaggagtttgagagcagcctgggcaacatggcaaaaccccgtctctacaaaaaatacaataattagctgggcgtggtggcacatgcctgtagtcccatctccttgggaggctgaggcatgagaattgcttgaacctgggatgtggaagttgtagcaagccgagattgcaccactgtgctccagcctgggcaatagagtgagatttcatctcaaaaaaacccaaaaaacagatttggcagtgctggacccttctacatggagctggggacaaaaatctgctggaaagtaggaaattattagaataactaactgtattaaaatatgttgaattcttcttgtcatgactgttttgacatttgtttgtactagttaagggaaaatgaaacttcaggttgacagcctttaccttccttgtgccataattaatttgctctattctgtttgttcaggaaattcagcttttgaaggcccagaaagaggactaagggtgcaggtggcaaggaaaggttgatttgtggtgacctggcatactgtattccatctttaagtcctcaccacaagtaggcctttatccaggttcttgttacctggaaatgtgtgttcatttggggtatctagatgaggcaggacttcaaggaaggggatggataatgcacttaatcttcatcttcacataaggatagctgctctttatcttctccctctggaagctgccattgtgaggcagcattaaggtgggagaggaccctctggagttcatccagaaccctctgggggcacctgtgtcccttctgtttgtcagtgtatcagccatggatcctgcgtgaaacaggtggcacatttaaatggggtaatccgagaagagtggacaagtgtagggaaaccacatggatagtgcaagatgcttggctatctaaagtggggctggtactctctctgggcctaaggaacaaggagaggggctacgagcaggccctggggagattgttttgtggaggtacttacctttgtgacctttggtggagagctgcagccatcctacactttctcctagtccactgatatccctctgtgtcctccattagctgaacctggctggaggccagaggcagaagagccctctggtgtgctccacacccatcagcatcctggcttacaaggcagggtggagaaagttagagattgaatttgaagagcacatggaagatgtctgggacatctgggcattctttctgtgtggttggttcttgtggtcagatatttgtggaggagtgaggtggtggtggtagtggctgtgctttagagtcagtgagtctgggacaggatcacatctgccccactcgctaacggagttaccctcagctcaaggtcagcaggcaccgatttctttgccgtctggtggggccaagggcaaatgcctatctcaaaaagctttgggaagatcaaaaatgaaaatacttaagtgtttttttgcagatttggaaaaggctgaaagaagttttattaaaatgtgagcaatatacctcaataaagttgttttcctatataagacaaataaaactgtgttgtgatttcacaacaagtgttgatttttttcttcattatatttttctgtattccagattttctgtcatcagaaaaccagacatccataagtgctatttagaaatatgttagtactgccttcaaattattactgttggctaatattgccttctctgggttactgaggtatgtgaattcacagctgcagcatagctgacttgactatggacagactagagtgaacgtgtatgtcatttcttacgatgtgcccatggattcaggtctagtgccccatccccaggaagcctttggcccttcagatgcttctcctctgagctcctgcagctcctgggctgcccctagcagttatcacactgttttgcggttttctccaccactagactgtggtctcctctaggtccaggactgaattttattcatctccaggtcagtgtctagcattgtcttgtaaatgctgtctttattcatgttgcccagcttctaccacacggctactggaagttctcaagctcataacaccgtagcttctacaacagagagcaactgactgtgctttctcctttctgttttcaaagccctgggaaagaattctgattagtttcatttgggtcaagtgtacctacatcccttattgaaccaactatacccatggagaggtatattacagtgatctcagctttggtcaagtgctcattcccagaggaatctgttgtgtggccaatagggtaggatctgtacaactatgacaggtcttatttaaatcaattagttacagtggagaagagaatgaatcagttaggaatgctttcagctgcagtgacaatgcaaaaaagcttttatttaaatcagttagttgcagtggggaagaagcatgtatcaggaatgcatttgcaagggagcaaaaattggttcttgggggatgaaaaagatcttagatattacaatcatttgtggccttctaaagcccatccttatgtaacagcataagtagatacacaatctgtctgtggtattgaaatttcacagtggcagggaaaaggaaaagactgtctggaaagggtctttagtgggggcgatagtgaaaaaaaagtttgagagtgatttatgatgacaataatcatacctaacttatttagtagttatgcaccaggaactgttatgaatgccttacatatactatattaaatcatttcaccatatatccatttgacagtgaccaaaacacaaatagtcttgatttcccactctcacacccctaaattacaagtacaaagatgatttgaccatgtcaccttcagcatatctttaattctttggacttttccctcatgctagctgcctcatggttgtaggatagttgctgcatctctggacgttacattctcctttgatgctggaagaattggtgagaagagcatgatgagattttttgttttgttttttaaatgagaggagcaaaacctttcccaggaatcttctcttcctactatacttctgcttaggtcttattggctggaattaagtcccatggccactcttagcagcaagaagcagggaaagtggaaaacaagattatcatggttggcttaaacctgcacattccaatatgatagttactagctatatggctatttaaatttttttagagagatataattcatataccctaaaattcaccattttatgtatacagtatagtatttctagtatattcacaggattatgcaaccataccccagtatccgattccaaaacattttcttcgccctcaaaagaaatctcatatccgtagcagtaagtcctcatatccctctacacctagccattggcaaccactagcctactttctttctctatggattttcctggacattttgtttggcttctttcacttggcataattttttcagggttcatctatgttgtagtatgtgccagtaatttttttatcagttcctgttttaattgataatactctgttgcatggatgtatcctattttgtttatccattcatctgttgatggacatttagattgtttcactttttagttactgtgactaatgctgctgtgaacactgattgatgtacaagtttttatatcaacatagttttgatttttctttgaattctcttgagcctattagaaggagtggaattgttgggttttatggtaacaccatgtttaaccctttgaggaaatgtcaaactgttttccaaagtggctacacattttgtacatcctggtaggaacatgtaaggattccaatttctccacatccttgtgagcacttgttattttttgtttgtttttattataaccatcttagtgggtgtgaagtggtatctcattgtggttttggtttgcctttatgtaatgactactaatgttgagaatatttaatgtgcctattttccatttgtatatattctttgcagaaatgtctgttcagatcatatgcccattataaaattggattgtctttttattgttgaattataataggtacttaaatttaaattaattaactttaagtaaaatagaaaacttagttcctcagtcatactggccacatttcaagtgctcagttgctgtgtgtggatagtggctatgttattggacagttgcagataaagataatttacatgattgcagaaacttctgttggacagcactggcttagaaccaccatgattgatcacttatagctgggcatatgacttctctaaataaaattgaggttttgttaagctaaggaaggattggtactccagaaagagtgaggtgtcctggtcccagaaaaggaggttatgcagactcagtgtataactcctaaagatgcatcagagtttaccaagggaagaactggggcaggggttgagtgggagggcaaaattctagaccagggcttggcagatgtcttttgcaaagggtcagatagtaaatattttggctttgctgactatatgatatctgtttcaactattgaactgtaaccaaaaagtgtctgagacagatttcaatcgatttagagaggtttattttgccaaggttgaggaagcacccgagaaaataaacacaagttacgttaggatctgtgactggtgttttgtccaaagaggattgtgaggacttcaggatttaaaagggaaagagtgagcaggaagggaaggaggaaagaaaaaaaaaagtttgaggggcataggcgatgaggcaagtggttacattcttgtgaggctttgattagtgctcaccaaatccacagtttacatgtgaaaagaggagtgggggaaagtcatttatgctcagtaaatctacattttacgtaagataaaggaagcatgtgaagttacagcaacccatttgagaacaaaaggatggcagttttttgattttttctttttttgtgtgtgtgtgtgtgactcagttcccaagcttaacttttctctttaacatagtgagtttggggtccaaagattttattttcctttcacacaactttgtccttatagtgaaaaagcagcctaagacaggccataaatgaatggacatggctgtgttctaatggaactttatttacaaaaactggcagcaggcacatttgggctacaggccagggtttcctagggacaatacatagaaaagtatggaagccagaaggggcctggcatactgaaataaagagaatggtaagacgtttggtatggctgaaaactggctgtaggagctatggctgtagagaaggctaggaatagagactggaaccagattataaagggtccgcaatgcatatcaatgttgttttgttctggttggtggtggtggttgtggtgctagtggcagtggtggttttctaaaatcctctaagtggcaagaagccgtcaaatatttttaagtaggacattatatgattatggctttttagacaaccctctggcagcattgtgaaaagaatattggaggaaatgaggctagaggtaaaaaaataccagttaagctttgtattttgtattaaaataaagatctggtaattatcttgctaattgcatcagtagagacatagaccaccaagctgataattcttatcctgactaacctactcactatgagctgagtaaaaagcagtattgatttaaatgagttatgaagagtggggcttggatatgctctttttatatcccaggggaatcaccctggaaacctagagaactggttccaagtattcatctgagaacatctgtgactctcagaaagttatgagattggagttgtacggggaaactcgctgtggccttggaagagttgacttctaaatggggtagtgaacttattctccgtggctcagttctaaaaggccctaagaggagaaaaggattcttgatgaactactaattgatgattttaggtccagagttaagcataatatggaggtttgcctgagagtgtctgccgtcagtgaagatgaattatccatgtgggcttagaaaatcacacatgcaaattatgtgtcaatggatttttttttcaacatgctaatcctagcctttgagtacacagcatattttcaaagccaattttgcaaacaactctatggtaaatgctgctaagctgttgataagttggctttccatttgtaagcctattagttcagaatcttctgaagtttaattcaaaatgagataatgtgtagtgatttgacagttttcattctgtgacgatgctcttcaagaaagcatcttggcttgttcactagttgaatcctcaccagttcctgaaattatgaaatgtaaatttgttataagcagccgctttgggcccttcacaaggcagaattgtaccttatccctgagtggaaataaatgaacatctcatgtgtgtagcttctctctctctgtacatcctgactccaaatgctgtgaggcaccagaaaatgtctcctgaatctgattttgggtggctggatcaatgtccagagggaattaggaatttttccaatggtggtacagatagaggtgataacattagaaaagactgacccttgacaagacccacattagtgaagtcgttattcccaaggagttgggtatgtacttcccacgtgttgtgaaaacagggctctattaccttgccagcaataccccaaaggcagaggctgtatttgtccttggatctcagtctttgacattgttttgggaaggtatgatgagaggcatgaggaaacctcatccattttgtgagtccagtgtacttaaacggtagagactgactccagggcatttggagttcacagaatttgtcaaattatttttcaagcttgtagggttcaagacttccccaaatgtatttttccaagtgcttgtaccctggtgtccattaagggaaatgtactccatatgtttctaattcttctaccctgaaatgatcaaaatattatattgctgagatctctgaagactagaaagatccttttcaattttttttttctctttgatgacactaacagaaatgggtgatcccagtaatcacaaagaggctcaaattcactcccaaatgcccggccaccaagaagctttggacataagtattttttgggggtatttgtgccaactgctgttttaggacatgtttctgataatgctttacacttaccagaaaagctgtttttgaaaaatccagtgttgtcttacaatcattaatttaaaaaaaaaaagtttcccaagtattttcttagagcaaggagatctctttctgatgaagaatacactctagcctaaaaagccacttaggtggaccagtttctttgattaacaaaagttacaaaggggaaaagaagagtgttagagaggatacctgtaacaaaaagagacaggagacatatggaacactcgtggtgtgtcacccttatttgaaccctcattcaaacaacaactgttaagaaaagtaaaacataggaggcatatatcaatacagaatggctatatgatgatattaaggaattattctttttaattatgatattgataattagctattttttgaaagatacctccttttatagatacatgctgaaatatttacagaaaaattttttaaaagcctggaatttgtttaaaaagaatcagggtgtggtatagttaaaactcctccctccctccatctctccctctccccctctctccctctccccctctctccctctctccttttctccttccctcactcccttttcttcttttttccctcccctcctccttcccctcctttctcccccactgccccagcttctcttcccttctgttctctttttctggccttcatttgggctgacaagaagaggatgcatgttttatatcaggttggcaggtatacttgagatatattgtcttggcaatacaaaggcctgacacttcctagggacccagatgggtattgtagatgtttagggcatgccttgacctctgagtagccttcttgggcttgaggtctcatttgactagactaccactccacagtcagccactgtggtctgttttttaaaaacgttgccatgatgagaatgtgaaggatttgggttgaagttaaggacacttcctttttattattagtctggagttttaaaggagatacctgggatcccacccttactttgttactttgatttggagtcagcccttggctttgagagtgtgctgtgatattggtctgatttaatcattgcctatgtagaaaaagagattagatcactggatcccaaactagcctcagaaagtaagtcattgatggcaagaatcacctggagagattttcagtttaattcttaaaaaatttagtgacgatacttggataaccctctgggaattctgattcagtagtcctgggtagaaatagaatctaaatatctgtaattttatcaggtttctacacgattctcatgttccaatagtttggtgatttaccaggttcaatgccttttaatagattcagttgctcaggagcagattgaggttgtatttccatatagtcctaccttgtaaaaaatggatgtgtcaagttttttgttggtgttattgtttttaattgttattttgacttgctgggctgggcgtggtgattcacgccagtagtcccagcaactttgggaggctgaattgggtggattgcttgagcccaggagtttgagaccagcctgggcaacatggaaaaaccgatctgtactaaaaaactggaaaattagccaggtgaggtagtgcgtgcctttagtcccagctactcaggaggctgaggtaggaggactgcttgagcccaggaggttgaggctgcagtgagctgtgatcatgcgctgcactccgatttgggtgacagcgagaccctgtctcaaaggaaaaaaaaaaaaaaggttacttgcttatgaataagaccttccatatagcagttattatataagcactaggtaaatattaataaatggcaaatactaaaaggaaagacaggaaaaggaaaggcaactgatatttattgaaggcctactattatagtaaacttgactcataatttatattttcttctttaattttaaccttggcatgcaatgattattacccaattttgtattcagtaaaattaaagcccagagaagtttagtatttttcctagagtcacatagtaaacacgtggcagcaggggtgtttggatactattgtgccaggcagcctttccgaacactccagcctatttctcaattctttcttggctccagaggattgtgtagcaggaggggaaatctgttcagagatcaggaaactggaccaattgggcaagctgccagagcttcctttactggattgtaccagcaagtttgtttttctctgtccaatactgggtaaaggtcccaccgaaagcctttgtctctgctcagaatgcctggtatgatctctgggaaactatttggcaaaggagtgtggcagctgaagcacagaagcctctcctaggtggttcacccatatctgatttttttttctttggcaccttgtaacagacctgagaatgttgaaattttgtgccaacgtggacaccattcagcatgtcagatttctctgataccgtgaagatcaatatgttggatgcaaaggaaaagtcccagcaatagattccagccctcactgccacttacctggtatattacaacagcctccatactggtcttcctatctgcagcctgtcctctgctttccggcccacttttctcagggggatcctctttcaaataaaggtctgattatgttcctccaatattaaaccccttcagtgactccccagttcttgaggaaaaaatgctgagtctctgagcatagcactgaatacccttcctggtctggccctgtttctccgcatgcttctcccactccacccagcttctggcaggtcatactaccgtggctcaccaaagatgccttggaaaccaggtactttcatgtctctgtttctccagctggagtttcgttccttctttgacctgcctggcaaactcctatgcattctttgattcctactccttcatgaagcctttcagcagtttctttcttagcacaactctaccaccttgtctcacctgttcacagacatctgcctgcctccctctctaggctatggtgccctccaaggggaggcaaggtgttgttttcaaatcattcacagtacttactacataggccacttacagtcagtgtgtaataactgaaggaggacttgagtgaataggcaaataaagatggttaccatgataggccgagatctgaaaagaagctaataatcaatgcatgaagatgtgtgaggaacttgtgtgtcttcagtaccattctaaataccatacaaatacaggtgccgccagagtgcttgcacatggcagcttcacagcccatttgagaagtagaattaatacatgtgaagaatgaggccgggcactgtggctcacgcctgtaatcccagcactctgggaggccgaggcaggcgaatcatgaggtcaagagattgaaactgtcctgctcaacatggtgaaaccccgtctctattaaaaatacaaaaattagctggacgtggtggcacacgcctgtaattccagctactcgggaagctgaggcaggagaatcgcttgaacccgagaggcagaggttgcagtgagccaaaatcgcgccactgcactccagcctggcgacagagtgagactctgtctcttaaaaaataaataaataaaataaaagaatgagtaagaaaaccaagaaaatatgcaatttagttcagcttgtttggtgctggtaatactttatttttcatgtgtcgatttttgatctccaccttgcactgtgagctccctgaggacagggactttgtcttggcaattatgtcttcacacttggcatacagtcagttttcaagatatgtttgttcaatgaataaatggatggtaggcaccattcagtgctgtttagggtcaaaggaaggcatgatttgtgtgggttgaagtggtcaaggagggcttcacacataagccagttatgaaggatataggcattgaagaagcactaaaactggttgtgagctttactcttcagagagtcacagttttagaaaagctcttgctctattggaaagaatatgggttttagaccaaatacatctagaatcaaatttggactctttcccttatctgctatgtgatcttgagatctctgagtttcagtttccttgcccataaaatgaaatcaatattacttcccttagaatatgcttgtgagccgtaaaagcgatatcatatataaagcatgtagcataatgcctagcgtacattaggctctcaataaatggtaagtaaaagctgatatataggtatagtgtgtctgaaatacctgggaaacatggattatttggatgacgtagtaacatttgattaaatttgcatgattattatattggcacataacaattagaattataatagattccagtatttttatggccttttaagtgtgttttggggatttctatcacatttctttacttttttaacattggaaaattggaaatggatatttgcccccaaattgtctgatatatagatctcgcccttcccattacacttgtgaagggaaggcttttctggcaggaggagcataatgcgtagaggagggaaagggaaatgagctttccattttgggagaaaaattagagctactcttccagtgacaaaccgcattgcctggctttccttctgcaggctctgcctcatgcctgtgttcctatagacattggagttaaagctctcattcatggtcatgattctcgcctctgtctaattcttttactttgtcgtgtaccatctctccttttcccactgttttttccagccacctctgtttcttttggtttccttgagcatgtcaagttcttttctggcctatgttctttgaatttactgttccctttgacagacattcttttcctctggctcttttcatttttcagaaaatcagctgactccttaccctgtggtggtattggagccaaataatggaattgatttttcagtgtttattccacataattccaaggaatatgattttaagagtgttcacaattcatatttttttttaatttttgaaattgaataagtttcaaatacgaaaatttaggaacatgatacaaaacttttctctgtgcaccactggagtactgcttttgaaatcaattctctctgtcctggattacccttagagctcctgtctcctgcatggaggagggtggagggcatttaacatgtccatctctcaccccattctacctgagcttccagcaccaccacctctgggcagttccgcttttagtcagcagctcccagttcccataattttgacttctgtccttgctagtccagaagaaatggctcttctgggattgaattcctccctttccccagcagaaatggattggggcagaggaattgcggagctccatggcatagagggtcctggaaggcttgtcattagggtatccagggtgggaaggggagtgaagggaggggaaggaggaaggaattgagttgggaagagtcaaggaggatgaatgaagttgctgactgatgtctggaataacattatttcaccctcaaaaataccagtaattcaggactgaaaaataaatttcacaatatgttttaatttcaaaaagtgatagtgtatttgacattcttatccagcctggtctcacctcaggagttcccccattggagaggccatccctgaatttctaactcacaggcctcccctacgttaatatatttatgtcctcctggcccttgtttactttttacttgtttacttttgcttttgtttacttgtttacttttgctccatgaagtcagggacctgcctgcttgctccgcaatccctagaactgtgtctagaaccttagttggttgcagtaaatatttgttgaatggatggatgagatggttgtagcaatctaagttgctttggatgagattaacactgaaaaaaaaaaaaaaactggttgcctgcaattctgtcagccagtccaggcaatgctaatacagctttgattattatgatcatgattattattttgttttgaaacctttttcagaggccaagcatgctggggacttgagggacataaaaatctttcaactgattatgccacctgcaaacaggataagcctgactttctacctcacccacctcttgctatcacagatatgaatcaacgaacacacaaaaaaggttttcaattctccctttggaaagagggcacatttaatattctgagtcaggcaaggaaagactctagccacaaagacagctgggaactcaggtccatagcaggcacccaggacggaggtgaagagaaggcgcctccctgtctggtgacagcagctggggcccttgctgcctccctccccacaaaaatccagttgggaccagtgcatgctgggaatctgcctgcctgacagaaacagatggcctcaggtggtgactgatctcttggtgacactaactgcatagctgctgctttactcatgaccgaatgagacacgagatggcggaggtaagagttggttaccttgccgtctcctcctcagctgaaatgactcacattgctgtagcttaaatttcagtccaggctctctggactcggggaatttctttttgctcatgctcctgagaaccagagttctccaggaacatctgtagtctctgtcttcaatcaaagcatttgagagatgctttatttttcccctttcctctgtacctgtcacagaagggggcctgtctgaataagatggcacataatctgctgagtgcagcaacccctctgtgcagccttgaggaagaagacaaggcagtcaaagtaccttccatcatttcctggaaaatgtgtcggtagcttggagaggcagagtgggagatggaagtaacactgcatgaggagttaggtggtctatgttcaggggccagggttgtcacttactagataggggacctttagccagtcacttaactccaatggccttctgcttcatatcatctcttatgtagggtggtgggactggattaaggacagcagatagattagctgtcagtcttactgattggaagttgctgtccagagtacagtatgggggatggctgggaagcccatctcagctaagtgagaaagagcagtcaactattggtatttgccaagtgtgtgacagtggcacatctgcctgctattatgagacttgatggtcatttctgcctctgtggttttatgattccaagtgtcctgcaagtgattctagagggatcatgaaacattttctggtcttaataattactcagggatctattaacaatggtgaggaacatactcacaaccagactttcattgagagtttaccatatgtatattatatcacttaaccctcatccttacggatagggaggctcaggctcatagtgattaaatgacttgccaaggtcactcagctaataggtgatggagctggaattcaaactctggtctgtctgcctccagaaccgaagcgctgaactgccaccctatactacttcccagttggagaatacctcagtacagtaattagatgccagtgtgtatggctttgcctatcagtacacagaaatcagaaaggtgattgagagattcattaatgcctccttgcccagttcttttgagcatatcttatttgagaaaggtgcacgtgaccttgggtcagtttgtctaactctgtcagtctcagttatcttatttgagaaatggggctatagcttttaagttaataatccagataaaacatcctatagtgccccagatgtcagtagcactcagtacatgttcatattatgttgccccaaggtcacgtggctgggaattgagctgaggactgcccacctccgaagtctatgatggcaccttttggttttggtacaagtgagtcctgagtggaccacatggcagcattagaggtgcttttgaatacgaaaggtggcgtgaggatccctctcacttatgtctgttctgttgtccagaacttagtgaaaatcctggtccttacccgctagagtgaaaaaggaaggaaaccttaccattctttctgtgtacctttctctggctggggctttctctggtctaggtgtgctcagcaaatatgacaagtagcaggccactcattttgaccacgcccatgtggcagacagctttcttcactttcacgcaaatgaagtacaagacaatcacatgtatggctgcactgaatgtaaaagattaaagagaagtgatatgccaaatagatgactgggagttgacgtttagcaaagtaaatctcttggtggccctggtaaagttaatttcaataattctggttttttttttcatcttagaaacttagaggttaaaaaataataaatatacatgaggagatttagagtgtatgtggaaacagagatcttcggaggacaagtgggatatttctttatagaaagagttttccctcttgatttttttgcttggtaagtttctttcaaatcaactcaattcatttggtgctattgcttttcttttgtgaaaacgattctggggatttgatcaaaaccgacatgaaaatacaaccctcaaatggtaaatatcagggaatctggaatttgcattttctaggctaaagtaatttactggccaagtttgctgtctcctcactcccccaacacatgtacaactcttaaatctcattcccctttaggctccttctctctcagtttatttccagcacacatgcatatgcatccatgcatacacaggtgtgcacatatgcatgtatacacacacacagacacacgacacacacgtgacgcacatattttactctgtgctaataaataggccagtattggctaggctgggcctcaggactgtctggtttaaatctaagctgcctgggagatctggagtaataagtgagtgacaacaggtgcagattttgttacacccttctgaactcagcccatagttctttctttgattcttttcacccaacacccttgcttcaattgtgtccaataaattttatagctgcatgatcctgtttcagagctgaagggagatttttccctccacttggctaaatggtgcctaagtcaaaacaccacttcctgccccctcctcacactttaagaagtaataaggaataaaccccaggccataagctgttgctgggtcctgtatcttcagttttgcatgtgaagagctaattttctggtcccattttagaaaagccaagaattaacttgcagagaattagccataattggggagaaaataattacttggctttttctgccctgtgataactggagccactggcaaatctttcacagcagtgtcaacgcctacttctgtttaaaacaaagtattgcaccaggggccttgaaagtcacatctgaatgttctctgtggtacattttggtccaaaccaccctgaatattggagttggattcatttcatgtcttttttggtgtaaaatcccggtgcagggagacatttcatattacactggaagacatgaatgtcttttgcaggtgtcaggtatgctcatgggccctgcatgcatacttaaggttgggtccaattggatttttttaggagcagtctgtggtctaagctgagaattttttctcataagggcccattttcctctagcatttttctgttttgagactttgcccagctgcctctattccctagtatgtagacttaataaaaaatctcttggttcataataaacatggaaaggagatggtacacgttttccatttgctagtagaggtttacctgaatacagttggtcatatatctcagtgtcgtcagagtacaacaaaatgtcatgccttcccatgatttcagacaccactcttcagtaatgacttatctgaatatcagccctgtacctctcctgagctccagccttaagggcacacttttcattgggtagccctacctgctgacccatagacaccctaggctcaactcattttccctaaataaatttgcttttctttctgtgttttctatcatggtaaaggtgctgtgatccaataactcaaacaagaaaccttgatggcatgccttccatatccattactgttagctaagtgggggacaatctatatattgcctcagatatcactgggatccattgccctcctaactaggctccctgggtccagtcatctttgcctttcctccaacttctcccccatgtcacctacctcctcttttctctacccccaccaaaacagtacttcatacatccctagtattgtctttaaatgtaaatctgatattatttaactatttgaattctttagtaacatcccactgctggcaggaaacaagtcctaacttcctagtataaggaatataaggtccaatgtgatccagctgctccctgactctccagtcttacctcctgtcacactaccatggatcaagccccatggttccctttattctctttcaactctgtattttcgcatatgtgactttcttctgctagtaatgccctttcttaattggcctgtacctttgactcctacacttctgtattattaggctatagcactagatgtggcttaaataagttagattatttgtttatctgatagtccggacgtagatgctttccatgagatcatccaggaacccaggtagcttctgcattggactgtgcttaacatgatgcccctttctgcatgatccaaagtggctttcaaccacagcttccttcaaggcagcaagatggagaatagatgaagaaggaacacaccttctcccttttggtgctgtgactaataagaaatatatttttagtttctgttccaggtttgtgacacagagctcctaaaagccttgtaatttccagagtgatcaacattctaggagtatcttttgttgtactatttagactttgactctggttcctaacagagcttctaaatcccttggggtttcctaagcgatagagcatcttttgctttaatgaggcgactcttgggctcctggataacttcagaatgggagttggtcagaatgggacttggtcactagaaagaccatgtgatggatagcagctcagaattttcagccctactccccacatccacccaatccaccaggaggggagagaggctggagattgagttaataagcaatcatgcctgtgtgatgaatcatccctaaaaatccctgaaagatggggtttggagagctcccgggttggtgaacaagtggaggtgcctggagagggcatgaaagctccccaccccttcccacataccttgccctatgtacctctttgtctggctgttcatttgtatttgtattctttataataagccagtaaatttaagtagagtgtttccctgagttttgtgagccattatagcaaattatcaaacctgaaaaaagggggttatgggaacctccagtatgtagctgatcagtcagaagtatggaaggcctagacttttgattggcatctgaaatgggagcagtcttggattgaagccttaacctgtgtgatctgcccttactccaggtagttagtttagaattgaattgtgggacacctggttggtttctgaagagttagagtattggttagtgtgggaaaatccctcacacacgtgatgtaaaaattgtcatgagtatgcagaaaaaagtttttcccctttagtggcagtttccagagtttgtaaatatctctgcttcccaatcttttgtgcctcctgtctgtctggtactccacctctgtagtaatggcagcagcagcaattctagtagtagtcacagtggtgtttctctagtagaagctgtaatagtagtaggaagaagaggtgtaggagtagtatcagtatcataatttcccattcctagtttcagaagagattgaaaggctaagtgacatgcctgaggtcacatagttaataagtaaacggcaaagctatcgttctgactgggagctctcttacttcagagctcaccactagactgtgggtagttttcaatccagtcacactaaatgccagttatttccttacatgattacctctcccacaagattcagaacttcttgaggaaaaggacatatccaactgacctttgtatctgtagagcctagctccaaggctgggcgtatccatcagttttagacattgaaatcagggtttcttaaccttggcaccattgacattttgggccagataattctttgttgtggggctgtcccattgtgcatgacaggatgtgtggcaccatccctgacttctacccactagttgccagtagcacatatccccacccgcagccagataaaccaaaaatatctccatgcattgccagctatctgctgggagacaaaatgtccctgattaagaaccactgatttaaattaaatgaaggccaaggagccttgagtagtgttcatatccgaaaagggcattttcagaattgttcaggctgctggatctctcaaagatgatgatgtattttccaggcctcatgtgtctggagcacaggttgcctgtggtggtggctgcaatgatctcagtgtgccaggccttcacggggaataccagagagggtccctctggagcagctcttactgggtcatggagaccatctgtctggcatggtaccacctggcaaaatctctttgccttaaccaaaaatatgcttttgtaaatttcctggcaaagcaggggctgcattctgtttcctgatttctctcttttatttccagatgtgtcactggtgacacatagagcccaatgagaactctgttggaaactcaagtttctcattcttcgccagctccgttgtcatgattttcccaccgtctaagccagtgtaggttacgttacccacgtgctggttagtgcttggatgtcagttttcctttttaaattctagatctgtagcatgctttagggaggaaactttatggcttattacacaaatggagttaacccttccctgctttgcagtgtttttgttagtgacagagacatgaattcaagatctgccatttattatttgtttcattttggacaacatgcttagcttctttgatccttgatttgtttaccttcaaaacagagtaacctacctgtcctgtctacctccatgggattattattaaaacacaataagataatctgctcaaaaggcttaaactccctagtatgatttactatcagtataccttttgcacccaagaaaactctacagtatcattgttcatgggcaccaaattgtaagttcagttaaggcagactttgtgtctttttctgccagtttctaggacctagaaggtattcagtaaatatatggtgaatgacagtatgaaaaaaattgggaagtcagattctgtggttcattgtaccagtgggggctggagggaggtaagtgaatggtttgtgtggctttgtgtcatttgtatttgtgacagacattccaagcaatagcattttcaagggttcacaagtgagtgcctgcagaggcaggacacacttaacactctggcagatatgcgacaagacagggtagggaggggcccaagggaactagagagggcatacccagctgtcttagtcattttgggctgctattaaaaaatgccatagactgggtggcttataaacaacggaaattatttctcactgttctggaggctaggaagtccaagatccaggccccagtttattccatgtctggtgaggactcacttcctggttcataggtagccatctcctctgtgtcctcaaaagacgggaggagtaaatgagctttctgggatccattttacaagggccctacttcttcatgacctaatcacctcccaaagccccccccacctccaaataccatcaccttgaggattaggtttcaacacaggaattttgagggggggatacacacactgtctatattgccaacctaaagacattcacagttacacattttgaagtctctgcatcagctaaacaaaatatgtctttgggccaatttaagtcttcagacaaaaatttacaactccttattgacagagtacctaatataaatactgggacagatgcggggcagataaagatgaggtgctcaggatccggcagcagtgatagacaggaaattagtgagacaatgagaatatccaagatacatggagagcttagcccagcactgtccaatgtcctttacaaatgacaacttgtatttaatcctcacaacagcccaatgtgagttagtggatattatgtcccctgttttataatgaggaccctaaggcacaaagaggttgatattttgccagaggctttgaagccagtatctggggaataataaaatgcaacgtgtatgtccaatgacaaaggaaacacagaagccccctcttagatctcactacttctactcctgcccctccagcccctccatttgaagatccctgagggatctgaaaatgcaactttgatcgtggcacagaccagtcctgaggttggtgcagtgacatccccatgccacagaggccctgtgccttctggacgctgcctctcttgccagccttgcccgcccctcatgctctatgctccacttcacttgcccagacagacaagcactttgcccctttgcagccactctcccctttgcctgtgtctccttgttatgcagggcctttcttattcctcaggcctcagatcaatgtcacctcctcagagtgggcctttgctgcccacgctgcccaaagatggcctactgggtcactttcttctttgccacttgcttatttccttcctcacgtgtgtgcctgcgtgtgtgtgtgtgtgtgtgtgtgtgtgtgtgtgtgtgtgtgtattttctgatgcctccacttgactgtaagctccaggagtgcaaagatttttgtcacgttcactgctgcatcccattgcctgagacagtggccagcatgaaggagatacacgagaaagcaatgtgtgtgcactgagtgagcgagcacatgggaggagctgacttcatggggcagattcagtcagagagactgtggctggcctggtgtcacattggtgagaagtggcacagtcgggatttgaactgatcatgacagcatctcgcttgaatcccatcattgcctccctaccgcgctcaggttggactccctggtgtttaccatggacaatgaatcttgatgtctggcccctgtagcacttctagcctcttcaccctcaattgtctgcacatcctcccttgcccctttctatctgcactgacttcaccgtccctcagtcaccccaccttctttctttccctgctcttccttatgttctcttcccacggcaggcaccctctgcccttctgtttcatggggctgtctcttcattgtccctgaaatttgaacttcagtcctcctccccccgcaaacttcttccaagcccatggactagactagaaccccctcaagtgcccctcattgcatttatcatggttgtaactctatagttatttttgtaatttattgtcttttctggcttttctgcccatggcccctacaacaacagcatgttcatctcattcttcttctgccctggctcgttaggtaggaggtgcttacataaacgtttgtcaaggaaatgaataaatgaataaataaatgaataaattgctggatgaatgaatgagagtaagtgaatgaagagttcctgaatttgcttttatgccacctcccttctctgggaaatttcacacaggataggatttctctggcatagagcaacacttctctttgtagatctcagcctgtgcctggagactgggtaaagttgaatgacggggtgcaggaagccttgtgttgtcttgtcacaacacaggaagggaaagtactttggcttttactgttgtaaataggactaaaagtagctcttcgggggtgatctttgtttaccactgcctaaggccactgtccttggagaaaggtcaggaggtgggtgtttacaagttctgtccaaactctcccatgacactatgccacaggccctcatttccctgacccattgttaattagagcagaggaggaacttcagatgctgagtttgtctttgaagaaggatccagaccctaggatgtcatcctggagactttgctcttccttatccttcatacctggtcctccaccttcctgacagtttctcttcttcctcatggttattgggagatagaatgggtggcagatttttattgtttcctgaggagccctgtgctttaatttccattatgtgtgaagatgtctgccatgaccaccaggttgggtgttctgctagattggtgtttgggagccagttgtagacagagtcaaccagaatataaaaagtgtgagtgcagagataaacccactcctgccctataacgacagtaacaaaactggcccagtggtagagctctcatcacaggccaggcactgcgctaagcacgcagtctgcacccctttagactggcccattctctggaaagtttcaaacatacacatcagcaaagagtataatgaaatcctgtgtacccattacgtgtaggggctgaaaatgtatttgccttgatcctgctttcaaagcaatgggtctagtgactgctttgggggaggagttagggaagtgcttaactcatattaacactgatattataaatttacagaatgcagctcgctctggagattatatctggttatatatgtgcacatatcagtgattgctatagtcccctggtaaggggatatatatttaacttaaaatgttctgtttggagtttttacataaatgtcactaaatacatgaatatttcagacccccttcccagtctagagtagtattgggttaagggaactaactgttttgagggaatctgagccaatttagtctggcaggaaaatcatgtagtgaagtagtgaggcccacatggcctctgaccagtcagggagagatactgaagttttacaagagaccatttaatgagagattatccataaaacttgatgcacagatttcaggagaagtctttttagtacttatgtgtgtgtgtgtatgtgagtgtttaaatgtggcaggctaaagtgaagaaatacgactgctactgatagtagctattgtttattgagggccagtatatgggtcagttgctgtgccaggaggtcctttgactacagtctattcctcaccaaggcttttagttcattgttattaccaccattgtagatgtgagaacatggagagtttcagagagttgcccaagactattcacataacaagtggcagggctggaatttcaatccaagttagcctgtttgcaaagcctttgccctttccattagactacatagcatcttaaaatattctggctgcttacttgagaggtaagtatcagttgggaacttactcacttccttctttgtttcaatatacaacccagaatgctttacaaattctgcagaattagccagtgctcatgtttaggcatatcatagattttttaaaatggctaatgttgctgttcctctccttgtgctttggaaaaaattttcagagtccgatacctattgtgacaacttttctaaacactcaaagtgccaagttcatcttgttagctgttcttccaccaggcaatcaaaactcatgttagttccctgtggattcattatagtccccgggaaaccaaaagttttgcctgtgtttggcacataccagttaattgcctaaattgtaacttctgagtattaggaattatcttaaaaactaataccaaaatttggtatgatgtatttcaattgagggggaaaatatttggaaatgaatttattttgactctggggtaatatcttttgcttcacatttagaaatttacatactgggttacttccatgacctaaaacaacttccaagttttcttatttcctcagtacccctagctttgttctggatgaggccagtctctgttccaacgcatgatttaaatatacacggttctgcatctttgtctataatgtttataatatttactatctcatgaattttttatatctacttcataatctactctctccctctatttttccttgcacttgacagcccaactggatgttgtctcttaattctttgtcacttcatggcagtttataattctttaatgttacttattatatttcagctacactgcagtaatggatgggcccattttctctcctccagcgtactgaatgggactgtgtcttgtctccgtgtgcctgacaccttgcatggaatttgcacctcatagccgctcaatagattttaattaattgaaatttaaaagggaacttgtgtggttttgtttaaacaagaccataaattagaaacaactattttcatgaatttgaaattcccagaaacattattctttaatactgtacttttgtcgagactgaagagtttggctttatagtaaatgaaatgaatcacagaatcattgaaccagagtaacaacaatactaataaaaacaccagaaatcatctgtgtaatccattcctctctcttaatgccagacagttccccagccaccttaaaatgatagaactctcctttccttaaagatccttttaaagaagactgtcatcttttcccattccacatcatcatgtcttctagccctacaagttaggcagcttctcctcagatgatcgaaaccctcccttactgaaatttatgcttattgctttcataaagatgaaaagcagctgcttttaactgaaaatagttctcttcctaaagatggttattccattattccatatccttctcttccctaggcataattttcctttccatctgacattcctttttgttctatatttccaaaccattgaatactactctctcaacttacggttttttgcctaagaaaacttggactgggtgtgattagtaagtgatcgttgattttagatgtactgagaaatatgtctcacaccattaaaactagtcgatccagccaggctggtgggtaactggaatactgtgacctcaaatgatatgtggtggtatcttttaaagcctgccatcaaccattcccatctcagtttctccagttgcttaatttataagacataatttatttgttataaactgctttgcaaggttcaaaaaaaaaaaaaaaaaacggaaatgatacacaagagaattagattgaatttaggccattttttccccctcatatctggtttttaaataagccctaagagtgctctcaattagaaaaacacatggtaattctaaaggagataaaaaaggaacatgtacactccaagtgcacttttatcttttcatatttaagaaaccccacaaagctccttcttgcaaattaaagaggatagcaagcaggcagctttctttcctcatttagtttagcaagcatattgatttacatttgagtaggggcctctgatctcttttgtttgtgggtggctttgtttgtttttaatatgaactcatttaaaaactaagcttatggactgagttgcaaaggtagagcttcagtccaacactcaaagtagtcttcctatgcaaaaataaaatagatatttatgtatgtggtagtaggtcaaagaagacatcagtgataactattgattcagtaaatattaaacatctactatgtgtcctccttactaggaagactaaaatgtagaatgtaccatccttgcatctagtgtgcagtgtagtatgggagagagaaataatttagcaggtgatcataatgcaataaatgctatgataggaagcaattaaggcacagtggaggggcgaataacacacctttggatgaattcccagaggaattgacaccagaaggtgattaggatttaccaaggttaagaaaggtgaaggtgtttcaggagtgcgttaccaagtacagaagtgaatggaagtgtgacccattcaagatactcttgagtttgtttcagccagagaacggacaaacaagggaaaacttaagtactctatcctgggttcctcaggatgcacactttaaggacgttttgcgtttttctctggtatttatttattgaagttctcagaacctccacagagctaatttctgtagccttttgtgctcccataaagctttatatatgtacccacatttaaaactttcttacaatactttttgcatttcctccatatgtctattttcccatctactctctgagctaatcaagggagaagacctagtactcacgtctatctatctgcagtgccatgctgagtgcttgcagaaatgtgtttgggaatcagtgcatctctctatgaatggctagagcattctaagtggttttgcttctaactgtgcaggagggcacagtttgggcccaatattggtttgcaaattcaagataagaaccaagaatttgattcttaactcaattttatgttgacttgagcaggctgaactgggttgcttatgccattatttcatttagttcggataatggctatcaaattagctgacaacccatctcagttccctgtagtattcttagcagtgtcttaaagtgggttttcatttgaacatttctttattatattttctttctcagaagtagccaagagatgatgatgatgttgatgctggggaaaacaatggtaacaagagcagctgctttttattgggtatgtgctatgtgaattaaccctgcacttaaccttttaatgaatttatgagataattactactgttaccttcttaacagatgaagaaaatgaagagcaaggaggatatcttactcactagtgaatgatggcttcaccatgtctgatccaaactgtactttgtaatgccttcttcatagcagcactaaaatctaaaagtctggaagagtctttaggagatcagttattccatttcacatctgggggcaggattatgcttgaactgaatgccttggtccactgcctgaaatgtatcctctacaacctttgtccacctggtgaactcctactcatatttcaggactcacaattcaagctgctactcccaagtgaagcttccttaatattcccaggtagagttgccctcttcctctgttgttcctcttaaatatcttgtatttcactcatgaaattcaccaatcatgcagagggtatgtttctagaggcagtttgtatagttgtgaaaggtatggactctgcagctaattgtttgggttccaactctagctctacccgtattagctaaataatatggtgctctcttcccctgacagactgttaatcccttgaggccagataatatttacaagaatttcttaaatggctaagtcacaaaattgtcatgttttttaccttaatagcaagtctgaatgtatcctccttctgaagagctgatgtattgtttctgctggtttctgcatcttgatccctgaaagatattgaaaacctaattttaaggccattttcctgtttgtttgtttttgtttttgtttttgtttttgtttttgttttccatttctgtttcctttccctcttttcctgtccttccttagagacaggacatcttgaaaggtacgaaatcttcaggtctgtacttctacttcaccaacttccttttaatgtttttacctctttgtcttgtgtggaaaatcttaatctgactctttctgctttgtgtcaaagggatactgttcatgttaaaattctcagctctgagaggtatgtgagtaggccgttccttgggtgatgggacagttgacatcatatctgagaagagcatcaccatggtgccctttacttatggccgttgtcatgatgacagtcatagccacctggagcacagtggcctgacaaagacaggaataggaagagggaaataattcgtccaacacttttgtattttgcacaatgggaaaagagtggcatcatttctagatcctaaaccaaaattgatagaaaaagaagactagaatgataagatctgctaaatattctcagggggttgaagtatcaaatatctgcagatggtatcactgagcaaaatcaaggagagcagtttaggatttttagtatgagggaaatgataatgcttttcagtacttcttagagttgtcagtgtctcataaaagataaagaatatttgttgagtgaccacaacttgctgggtactgggctacactacagtatagtatagttattactgagaatttgtagagataatcctagcttatcaaggaaatatttgttttataatttgttcaggtgcttatttatattgaagaatattctcaagttaagatgatttttttagatactccagaggccagaattaatcataaagggccctaatagccaaaaagaattgaaatgcactaggccaattggcagacactatttcagtctgctctctttcatcctttgccaggaattgtacattatctctttaaggcagagcagccttggatgaccatatattaatatgataacttgcttttccttgctccccaccccccaactagtggctttagaatagctttgctatttttcacttatttcttggcagtagcactagatcccaggcttaccgattatgcacactttagataactttgggtcagctcagtactgaacaaatggcaagtcaggaatgccattaagactgaagaatgttggaagataaggattatatagacaccactgtccttatacacactgtgttgtcctgtaattggataggccaaaatgagttgacactggaagaggtattttaatattggagcttataaaatgtttagaaatgttttcctatctgagtcagactgagataggtatgtatgttttctgtctcttctgagtgacactgggaaatagttatgattgggaataggccttggtaccaataacctcatatatacactagggtagaccttgcagaggaagctggcaccagggcatgggaccgtgaagcaaaggggttcagaagaactagagagtggtccaataatgagtcttcagatggccagaggcaaaggctgagatcaagcctcaggtccaagaagccagaatcataagcctgaaataattgagtgagaaacccaacattactagaatggagaagaggctaggggaaaggcaggagcaaacccaagggctgggggtctgaagatgttaccatcacaaggcagccccattttaatggcctctagccacagggtttgccattaaaaactgtaggagtagacagatgcttgatggaaacccttgaccccgggtctttgctcccttaatgaaggaatctaaggcaaagtagagattctttttttaacatttaaactttatttttaattgacagataataattgtacatattcatggggtacatagcaaagtttccatacatataatgcatagtgatcagattaattagcatatccatctcaagcctttttcatttcttcgtgttgggaatgtttaatatcctctttctagtgatgagaaactgtataatacattattgttaactgtagtcatcttacagtggtatagaacagggctccccaaccccatggggttctataccactgtaggatgactagggttaacaataatgtattatacaggtactggtctgtagcctgttaggaatctggctgcacagcatgaggtgggcggtgggctagtgagcattaccacctgagcatcacctcctgtcagatcagcagtggcattagctcctcaaaggaacaggaaccctattgtgaactgcgcatgcaagggatctaagttgcacgctccttatgagaatctaatgcctgatgatctgaggtggcacagtttcatcccggaaccttcctcctcgcaacccccacccatggaaaaattgtcatccacaaaactgggtcctggtgcccaaaaggctggggaccgctggtataaaacagagtttatttctccttatctagttgtaattgtgtatcctttaacagatctctccctatctttttacatgtcctttgataccataagctctatggacaccctataatatttcttcattatacttacccttcatagtaattactagagtgagctcttcatggatttttctcttttactagactctaagctccacgaaggaagagataatatctgtgcctggtacatagtaagagcctaataaatatttttggaaggagggagagaaagagggaggagggaaataaatggctcttttgctccttttcttcatgccagggcaacactcagcttctgaggtatgcacagcaaggatcttgctgagatgggtgtggccacttgcttgcctcacttccagccctgggcacatgcagttctttctacctggtgcagtcctcttcctccctgctctggcacttgcctctgcttccacttctgctgctgcttctttttctagtctcctgcagcctaatcatcctcttgacacattctttctttaaccatctgaatgccttcagtatggttcctgtgagctctgaatgttctggaagccattgttttgttttgataattttgaatattttactcttgctcattatggattaactttacagctgaactctcaaaaccagacttcattttcccaacttgagagaacatctcattgttgtccctgtgtccttgcctatggcacacatctcccgaacacccttttttaccagaacatcctcacagcaaacctaaggcagctaactgctttctacagctctgtgtttcttgacctcttccatctgttttattttcatatttttcctttgttaaaaaaaggagataacagacaagaaaaacacgagaaattaaatacctcaaaattactgtacattttcacttggagtaaccagtctttgtaatgttttgtaaatatctttccctgagtgggcctgaataagcatgtagttaacaagcatggacttttaattgatcagggcaggttttgaacttctgtcctgctctttcctaatgatacaacctccaatgacttaacttctgagcctcagtattctcttctgtgaaatggaaatactaataatagtatcctcacaagtttgttgtgatattcagtaacccacataaaatttctatgcataatgcctggcgtataataggcactaagtaagctgtcacttgttttctttactttcctgctttctctcatattgcctctaattagtaccgtccttattttttaggggacagatccaaatccgtgaatccaggggcttcatcacgatcttggaatattttggtggcaactttaagatcttttgttttctgactcttagatctctttcttttggtggcatgggaaaattccctcaactcgattatttattcagttctttcatgctccccatattgtcatggccacgtttgaatcatgttatcggcaagtctgaccgaaaaagcaatttaatattgccctgtgttgcatcattgcatatattatttcagcctgtcacgggcctgtcagcaagtcttgatgaagtacagagccaatagtaacaggcctgaaatctgacagctctttaacagaagctgctccgattggtgcagtggtatttcttcagaaattaaggccttcttggtctctttgttgatacaattagcaatccaatctgagtcattttatctcccaatgagctgtatcttcagggctggtaattcagtctgttgcatggcttggaaaaacagagccatcagaggcctgtgatgtaccaaaggctgcagccaggaatatcttggtaatttatccccactctcagctctaattattctgttcttcactggctggttcgattgagactctccaggttcagccttccctaagcagagaacaaaaggtttcccttgaaagttggggcctggcaatgtcagtacagtgagctgcgtataaataatgcagcagtgccggcttcatttttataaaatcttggtggagaaatgcatgagaatgatcaggcccctggaactcagcaggcatgtgcttttgatgtgcgccttgctctgagtaaaagcaggagaataaaaagttcttgtttgtgctgaggctacttcatggtctctggctcggattttggtgaccctttcgctttgtttctgatagagtctggaggctcctacctaactaggaaaactctgatatgtatatagagggaaataccttcagtaactattttctgattgaaactaaagatgatgaaaataaagatggtgattatagtagctttacttatattagctttacttacattccctcattttaatcttcctaaggttagagttatctggctaggctattttctctataccttctgctctcccaattagccttatatcttttcttttttctggtcagattccccaaaaataaatattcagggtgtgaacctagcagccaaagctctgggagctgagtcggggaaaggagcttgagggctggcctgcaaaaaagcagatactgaatcagtctctttttgtcaagatactctacccttacctggaccttttatcgcaccctatctaagggtggatgctatggtttggctgtgtccccacccaagtctcaccttgaattgtagctctggtaattcccatgtgttatgggagggacccagtgggagataattgaatcatggggctgtttctcctcctgctgttcttatggtagtgaataagtctcacaagatcagatggttttataagggggaaacccctttcacttggttctcctcctctcttgtctgctgccatataagacgtgccttttaccttccaccatgatggtgtggcctccccagccacgtggaaccatgagtttattaaacctctttttctttataaattacccagtctcaggtatgtctttatcagcagtgtgaaaatggactaatacattggaccttagtacttttcttccgtagtgtgggagaagtagtaccctggttgctaatagtgaggtcacatgggatctaattacttcctaaacatactttttgtaccatctgctgtttttagcctcatttttatcctcactttcaggggtggtgagcaccaccacctcctgaactttttgggtctctgtagggtaatcattttgcttctgggtttttcctgctgctatttaggttttacctttctcaagtctaccaagagagttactactaccatggtttttggcttttagattttcgatgctgtcatcttctatcctgttctcattgtgggtttttgcctctttgaaacattcttgtacaaccattttgttggaatttttaaagggcacagagttcaacacgtgtagtcaatctggcatctttaatcagaagcctctttttgtttttgtactttttgaaataggaaagaaggtctgctagagatctggcatgcatttgtgtcttgggcagtaggtggtgggaggaatgtgaggtaggcaaaaccaggagagcattgttggaaggctctcctggttccattgaggttaatggtctatgcaaggaacccagtgttctgcttcatgcactccaggagtctaacttttgtctcttctccagcctgcatacagagcagtatctaaagatctaggctttataatagaagccattaaaaaatgattaggaacctgaaagcttccttctataactgagatctgaaggtttttattcattcacttaattaacatgcattgtgctctcaaaatttgccagagtagcattgtgcttattcatccatataactggatgaaaaaggcagatatggaccctgctgtgggaggttgtggcctgaccttatatactgaaatttccagaaggccagatagagcatcaagaaataaaataaaataataacattcttttatgataatgagatagatccttcagtgcctcctggtcttccccactcatacacactcatgcctaaaatagtccacggttctggactcctttagtgggccagatcctttcatcaccatgggctgctgagaccactggaatttcaggcaaacctataaaacaggggcagctttaggtgaccacattctgtcatgaatccttgatttcatatacagtttttgcattacatgtttgctagtcctaggccaaaacaaaaggagaaaagatctaattttagctgagttcgagttgcctttctaaaaattatgatttcttctttatgagtctttttggtgaattgacccttttctcaatatgtaatgtacctgtttattcctggtaacatttcttgttctgaagtctactttgatattaatatagccacctcagcttattatttgtatctgcatgccttatctatttatttattttttgagactgagtcttgctctgtcccccaggctggagtgcaatggcacaatctcggctcactgcaacctccaccttccaggttcaagcaattctcctgcctcagcctcctgagtagctgattacaggcgcacaccaccacgcccaactaattttttttgtatttttagtagagatggggtttcaccatgttggtcaggctggtctcgaactcctgaccttgtgatccacctgcctcagcctcccaaggtgctgggattataggcgtgagccaccacacccagcctgcatgccatatttttgcatctttttactctttatcttgcatttttatattgaaaataagtattttttgtttgttttgttttgttttgtttttatccaggcactgcgactcacctcacacctgtaatcccagctactcacaaaactaaggcaggatgattgcttgaggccagcagatggagaccagcctcagcaacatagtgagacccccatctctaaaaaataaaaaaaagaaaaagtaatctgggcatggtggtgtgtgcttatagtctcagctacttaggaggctcaggtggcaggattccttaagctcaggagttaaaggctgcagtcagtcctcatcatgccactgcactccagcctgtgtaacagagtgagctcttctctaaaaagtagaataagtttcttttaaactccatatagttgggttttatttttattcagctttattatctctgccttcgcactggagattttaggtcatttacatttattggttgggttttaatctattttctttttctgtcttccatatattctatataattattcccttttcctgtattctccagattacttaaatatttgttagtattccattttatctctaaaaagttttacctcttgccagtttctaatatgcgtctttcacttatcacagtcgaccttaaaataattttgatgcctcattatatataatacactttcatatcttcctgtgatttgtgctattattctcatatgatttgttcatgcattggattgtataaagatttaaattcaatttttttaaagaaatttatgtctgttgtatttactcacatatttagcagttctgatactcttcattcctttgtgtgtgttcacatttccatttggtatctttaacccatgtagtttctgcatgaattataaagtattctccttctccctcctcctatatgagtatacagaattgagtttgttgattgtattaacaccctttaattccccagtagtaataataatagctattattactcttatagtttacatgtctcttcacattctgaaagtacaatcacatatttaaatagaattgtcttttttcaaatgctttttaaattttagaagctcttgtttcatatatttcatactacattgtttggttcataaaatattatgaatggtagttttcttggattgagcattttgtcattatgaaatattcttcttttccttgttaaatatttttgatcttgattctactttgatacttatattgtcatttaaaaatttttttgtttgtatttgttgtagaacatttttgaaagaaaactgaatcacattttaaaaaatctgaattataaacaaggtatatagcttaattttaaccacagtatgattaatcttatcttttaactggttgtggaattcagcccattcacatttgatgaaatactgagataattgaccttatttgttccatcttattttgttttctatttatattacatcactccccattccctttcctttttgttttgtgtggtttattggtttcactggcttgttaattttttctttattcccttttattccttgttactttgagagtcctactaagtgttttgtttctactagtggttacattctcattccttataaccaacaataaacttatgttctgcctaaacatgtatatgtatttcaaggaacgttttctgtgtaccccttctctagactcttacttaatatttgcttacttaatgtttattttcagttccagactgttactaagttttttttgttgttgtttgttttttttttgtagaacagcaagcctattgtattttaagaaaactcaatattacagattcctgcttacattattattatccacttagatttcaatacgtatatgcatatatttttatgcatatatgtatatgtttaagcatattatgcacatacatgcatatatatacatatatgcaggaaagagacacacagagtgagaaagggtctcagtgtctactggttcctctagtctttgatttccaccatattgagaaagctgctctgaatcaattgttatttggttatactctttctcaagtattgtcctcagacagtgcttatgagtttactttttgaatccttgtgtgttgaaaatgttttttttgcctcttacagctaaataatattttgtctgggtataggattctttaatcagtttctcgtaatagtttgtacattattctagtgtcttctacattccagagttgtagatgagaattcccttagctaggattaatcctttgtaagtaacctattctttctgtctggaagcttgtataattttctgtttactcttgaaattcaagtgtttcctggatttacttcctggacttaatgagacttttaatctgtgggcttaaatcttacttcagttcagtataataaaatacctagccctgtattcatttaattacagtatctccctcatttgttcttttctttttttttttttattccttttctctctcctaaaaaacacaaaatctgttctggaatttctgttattctcatgttaggcttctggaatctgtcctccaagcctcttatctcttccatcattatgtcaatctctttgtatctttgctacttgtagtagcaaagtgggagagatggtgaaatgaatgagcaaagacagttactatggtaaattaagataaagataaagataaaattcagatgtcatatgtcatatttcatttacttggtcttccagagcattaatttgattttcattagtgtcagtgattttttagttcttctgtggaaattttaaacgtaaaatcagtatttatacttccagaaagaattttttgcattcttctgatttctcattgttttcatcattaaaagattctaccatatttttcatcatttctacttctgtgggacttgcctcttgtagatgttctatgtggtctctcaggtgaactactcccattaagttagttaatgtttttgttttgcctactcattgataaatgctattttgactttcatataggtttttagtatctattctgcattaacaagtctgaaagcagtgaaaggtacatcagttcctgccctggcacttgggctggcagtcacccaaccggccaacagcaagtggccccttctttcttcttagagcacccttggtggaagcagcactcctctctagctgccaatcttagaagcaactcagactgccagtgtagccctgactctgtagggcccctatctctaattctaattttacaaacctttgggtgggggtgactagtaggtacagcttgcctaaaggtgaatagttatccaaagagggcaagttgctaaaacacttcaggaaatgtcaaaactggtcttaatagaagactcccggaggggtaagccctttgttctgctgctagtaccttgcctttacccactaataatatgaacaaagtcctatgttttctttccctcctggagagttttggagtacctgtggcttcaattgtactcactaaactttaccagttctgctgcttaatagcacgtccatattacccatcagtttgatttaaagaaactcaatgaattggaccctaatattgtttgaataatcccaatgaaggagggagttgccagaggcatctgtagccataaaacttctgtagtcatcttcactccaggcatactctcttattttaacttcttgtaaagaccaagacatccctaactttccctttattggggaaaaaatctgcttggaaaaacttagttatgctgtgaagtgttgagtttttaaactattgctgtattatgaaccacaaccaatgcttgttagtttaatacagtaatcatttatttgactcatggacagctcatttaggctgtgctgtcctaggtgatccttctggtctcagttggactcactcactggagtcttggctgactgatccacgttgatccaagacaacctgggggtatctgatccagattgagctcagctggctattgccctgctccatgtttctcttatcctcctcatgggaccagtggactagcctagaatgatctcatggcagtgccagaggtgcaagagaacaagcagaaacacatagaatctcttgaggctcagactcggaactggcatgcagttacttctgcttccttattttggctaaattcagtcatgtgacagaatcagaagtcagaggtaaggaatcagaatcagaggtaggaaaggaagccctgcctacaatgtgggggacaggaggaggagggtgcagtactacaaagttacatggcaaagagtgtgggtatgtggagacatgaagacttagggccatgaactcaacctttatcagctgttgagaaatacagtgcaatattttaaacttacaatggtacctcaagagagagagccacgagtttagcttggaggtagtagagaaactttcacagaggagctgacattggaactggaccataaggacaacctggagtttaccaagcagacaaagataggtgaaaggagtaataatccattaagatggaaggagaagtcaaagtagaggcccagcactctacagacaagaatgggacatctggggatttaggagttaccctgtgtgattggatcattggaaacaatccttctatactgccttttgctccctaatattactcttgccagggagctatcgtacctccccaaaagttggaatttcagatgtcatatgccaggaggagttagcatattgtatactcttcagaacatgttacataggtgggctgccttctccacttattagagatgtatgttgcttaaaaaaccgtgaataatttagcatgtttctagaagtgcttgcattccttcagtatatttatgccacttagcatagctcaatgtgttctgtgatctgtgccacatgtaaaaaaatcattaatgataagtgacatttgttggctttcaaaagacatttaagcctcactcagtgctacctcctctatgaacccctccttgatatttcctccctgtctcccaccagattatgtcaggttcttctgctaaaggctttcatttctccctctacttccttcagagtattcatggctgtttgttagtatatgattttagttgtgattatttgatcaatttctgtctccccaattaaactttcagcttctgtgactgcaaaagactagatattttgcataccactggtttcctggatcctagtatagtgccaggatcatagtaactgaatattaaacatttattaagtgagtgagtgaatgcatgaatctatgtgagtgactgaatgagatacatctagactattgtccttgtgagataggttttgggttatctttaaaattgcatgagctcccaggtttaccatttacctaccatgtaatggacaaacgattcattctttaatgtttccattcagtcagtgttcattgtggcttgtcataatcctgaatgtgaatgaggtatttgtgatacagagaagagtaaggctgattctgggctgacggagttgctggtttagtgggagagatggtgaaatgaatgggcaaagacagttactgtggtaaattaagataaaggtatgtccagattggaacttggagaagaagcttttcactcagtctgcccttcattggggcttcctgaaaaaggacaatctgagctgagtcatgaaggctaactaagagttagatgcataatggggatgactgttccaggaagaatgaagcaaaagggttcagtacacagggaagtgggaaatcaaggctcactatagcaaactccaaataattcagtattgcagaatgagaaggcaagggtggggatggccagaacggagtgactgtggagatggacacagtcatatcacaaagggttctttaagccctgctgtgcattggactttgtcctgaagttagagcgtagcaattgaaggatcttaatcagagattgacataaaatattttattttataaagtttgccctgggtacaatatggagaacagattataaggcaataagactgtaggggagcaatatgaagaagcagttacttacccagcatgataagggctatggtagaagacatactccatgctctgggaaatcagaagaggagtgcctaacccagaactggaatctcagcctaggctaaagtaagagtttgaattatcatggtgaagaagctgggatgagttttcccaacagatgggggtagggcaaaggcactgaagtatgtcagaacatgactttcttcagagaactgtaagtaactttttattgttagactacagaatattaagggtaaattgagaaatgtagctggaaagcatctagcgttcaagtcttcctcctattaaatattgccttagactgggatgaccatactctttattatctccaccagacactttaaaaacttttttttatcatagaaacttttgaacatgtagcgagagtagtataattaacacccatgaacccatcactctgtcccaacaaccacccatgaccaatcttgcccttagccacatgccatttacttctccttctcatgttgcttaaagcgcattccagataccatgtatcttatacaaacattttcagtatgtatctctaaatgataaggagccttttgttaacataaccacaactaccaatatcatatctaaaatttcataatttttttatcaaatagcaaggttataatttctaattatctcacaaatgtcatgtaaacgtagatgtaaatacgaatattcatatacagattgtttaatcaggatccaaataaaggactgaaacttttttttttttttttttttgagacagagtctcaccctgttgcccaggctggagtgcagtggcacgatcttggctcactgcaagctctgcctcctgggttcaagcaattcttctgcctcagcctcccgagtagctgggactagaggcatccaccaccaagcctggctaattttgtatttttagtagagacggggtttgaccatgttggccaggctggtctccaactcctgaccttaagtgatctgcctgccttggcctcccaaagtgctgggattacaggtgtgtgccactgtgcccagccagggctgagacttttgaaagtgaaggaaggtactatccataattaacaggtatccatggagactttttacctaagcagggatgtgtcattatctacactggcttattccacttctttaatacctctgcagatacctggacgggtattttgcaaaatataaaggaagcctcactcatatggtcagttctatctatatctcttctattttcttaggtctctctgctccctggtgtgtaagtggacatattcagcagagaaaggctgggacgacagtttctggaaaatgattggtttggaagactttgttgcagataattacagcaaaataggtaaaagaataaaacatctgtagagtgattatgtgcattggaggatcttgatgggtttgttgttattgtggtttgtatgtttcttgtttttgtatgcatgaaaatacaggaatgaagttcactttttccaagacaaatgagttaattatgatgggtaggccatgactagtaggctcttgccttaagatttatatgaactgagtagagatacatgctatgaaaatctgcattgaaatatagaatcagaaattgcgctgggcatggtggctcacacctgtaatcccagcactttgggaactgaggcaggcagattgcttgagcccaggagttcgggaccagtctgggcaacatggtaaaaccccatttctacaagaaaaatacaaatgttagcctggcctcgtgcatatgtctgtagtgtcagctactccggaggctgaggtggggggattgcttgagcctgggaggcagaggaggttgcagtgagctgagatcgtgccactgcatgcagcttgggcaacagacagagcagaactctgttttgagggggaaaaaaaaatgggctagactgaggaagatatttgcaaggagcagcttgggaatagcatactcaaggggctgtgtatggactgcttccagtcagtactacgaaaataattttacaaattaggttcacaggacaaggcaaggctgtgaacaggtaaaaaataaagctaaaagatcaatattagaaaatctagaaaaaagcagaaactagaacgagtcagtggctcctaactaaggccttagggtctcagactaaggccttttatgtgggtggtaaagtacatcttctatgtcccaagcacatttctctgtgcttgtatgtaccttgttttatatatttctcacaactactgacaaaagcactgttgcatgtttacagatgagaatcagagagattagtaaccttgcctaacctggcatggaatcaataaatggtaagtcaggatcgaaattctcccaatgggaggacctagaaggaactaatattttactggaacacaaatttcagcttcagttacctaatggtttaagtgatttgtaaaatgtatatgccctccaaaaaattagttgttttttgctgaatattcccatggtatgttgttaaacatagctttattagtgtatatattgattacctgtatatgtgtcttgattcctcactagactgtgagctgtttgacataaggattttcacttatttacctttgtatttcctgtcctagcacaaggcatggcatattttcatatctcagtgactttttgattaaaatattgagatgcttggtactaggaggttggcactctttcctttaaaaatctgtaatgatatttactgattttaacattatctttggcaattgggtataacttcaactctgattttctgattatttttatatttttctgctcctctttcctgcctcacacatgacacatgtttaattagtatattagctctgctaacgtagcagtatctacaagaaatattcattagaagtccataatgttaatctagcagaaaatttccagagtaactttattagattttttccctgttaagttaatggatttttaatggatttcctaaggagacatatcattaagcagaatattgctgtacgtgaattagaacttacccatttatcaaaattaattgtgtgatgtttcctttgattttcgcttctggacacttgagcttgtagtttcagtctgaacccaaagtagaagatatttaagaggctgtttattctcagttgtgactttcagaaactcctctggaagctacctctagacattctttagcaattcttggaactatgaaagatgaatctcagaagcctccctatgaagtgttaaacatttccagtggcctcattgcccgtcaagatgtgggcaatatagtgtgaaaccttttagcagatttgagcattgagcgtcctggatttgagcattaatacaattaccataatttgctccatgtggagcttttagccaagcctttaccaggcttcctgggcccatgcagtaaataaatgctttccctgaaaactgaacacctcagcaactgatggtcttatggaggaatatttttaaaatgaattatttatgaagtgtaagttaaggatcaaatgcaatatttatatggtgcatttcaaggacaggagaaaaaatttacagggttttaagtaataacatgcaagtttctaaagctaaaatgttactacctaatgccttctttcaaggaggtatttggatggcttggtttgggaacattcacaaagtaaggaaaaatagttttgtgcatcaaaagaatatagtagaaatttctttacaattgaatagaaatttctttacagttgaaactgtacaagttgacttaatgttcagaattgatggagaaaaatgaaacagattttgggtaggagattatatagccctactgacaaaatgatctgtgttcaatgaaatgatccaacaaactgatctgtgtcaataaattttgacctttaattccacatgaataattccccagttacctatctaatcctaaacatctatcaaaagcaaacaggaaggaagagatcagcagggagaaaggaccttaggaagataagcaacatcccacctgttctaattgattatccaggtgccatttcagcatgccgcggttgcctttttaattcctgggaaaatctctttgttctactattggggtagcccactttatgaaaagtcgtgtgtgcaacatggctgaattatagagtgattatctgcattactaacagggtttgtcatataaagggattcagtgtattagcttatagatcattcctttatttgggaccagggaagccaggcaaagaaaaatgtaaattccaagtccaggaagttagtaagtgttaagtgagaggcagaaatgaagataaagggcaggagacagtttcttgagtggagggaggctgctttttaaatgggtttcctcgacccgggaagcacaaggggtgggggagatttccctttcctagacaagggaagccatgacagactgtatctggaaaatcgggacactgccgcccaaatactgggcttttccaacagtcttagcaaacggcacaccaggagattatatcctgcgcctggctcggcgggtcccatgcccagggagccttgctctcactgctagcacagcagtccgagatcgaactgcaaggtggcagtgaggccaggggagaggcttccaccattgctgaggcttgagtaggtaaacagagcagctcggaagctcgaactgggtgcagcccaccacagctcatctaggcctccctgcctctgtagaccccaccactgggggcacggcgtagctgaacaaaaggcagcagaaacctctgcagtcttaaacgttcctgtctgacagctctgaagagagcagtggttctcccagcacagtgtttgagctctgagaactggacagactgcctcctcaagtgggtccctcacccccgtgtagcctaaataggagacacctcccagtaggggccgactgacatctcatacagctgggtgcccctctgggatgaagcttccagaggaaggatcaggcagcaatatttgctgttctgcagtatttgttgttctgcagcctccgctggtaatacccaggcaaactgtctggagtggacctccagcaaattccactttatgaaaattcctgcagctgaggaacctggctgttagaaggaactctaacaaacagaaaggaatagcatcaacatcaacaaaaaggacatccacaacaaaaccatcatcaaagaccaaaggtagataaaactataaagatggagagaaaccagagcagaaaagctgaaaattctaaaaaccagagcacctcttctcctccaaaggatcacaattccctgccagctacggaacaaagctggacggagaatgactttcacgagttgacagaagtaggcttcagaaggtcggtaataacaaacttctccgagctaaaggaggatattcaaccccatcgcaaggaagctaaaaaccttgaaaaaagattagatgaatagctaactagaataaacagtgtagagaagaccttaaatgacctgatggagctgaaaaccatggcacaagaactacgtgacacatgcgcaagcttcaatagccaattcaatcaagtggaagaaagggtatcagtgattgaagatcaaatgaatgaaataaagcaagaagagaagtttagagaaaaaagagtaacaagaaacgaatgaagcctccaagaaatgtgggactatgtgagaagaccatatctacatttgattggtgtacctgaaagtgacgggaagaatggaaacaagctggaaaacacatttcaggatattatccaggagaacttccctaacctaggaaggccaacattcaaattcaggaaatacagataacaccacaaagatactcctcaagaagagcaaccccaagacacataattgtcagattcaccaaggttgaaatgaaggaaaaaatgttaaggggagccacagagaaaggtcacattacccacaaaggaaagcccatcagactcaccacggatctctcagcagaaactctaccagccagaagagagtggaggccaatattcaacattcttttgttttgttttgttttgttttgttttttattttattgtattttatttttttcttctattattattattatactttaagttttagggtacatgtgcacaatgtgcaggttagttacatatgtatacatgtgccatgctggtgtgctgcacccattaactcctcatttagcattaggtatatctcctaatgctatccctccctcctccccccaccccacaacagtccccagagtgtgatgttccccttcctgtgtccatgtgttctcattgttcaattcccatctatgagtgagaacatgcagtgtttggttttttgtccttgcgatagtttacagagatatagatcaatggaacagaacagagccctcagaaataacgccgcatatctacaactatctgatctttgacaaacctgagaaaaacaagaaatggggaaaggattccctatttaataaatggtgctgggaaaactggctagccatatgtagaaagctgaaactggatcccttccttacaccttatacaaaagttaattcaaggtggattaaagacttaaccgttagacctaaaaccataaaaaccctagaagaaaacctaggcattaccattcaggacataggcatgggcaaggacttcatgtctaaaacaccaaaagcaatggcaacaaaagccaaaattgacaaatgggatctcattaaactaaagagcttctggacagcaaaagaaactaccatcagagtgaacaggcaacccacaaaatggcagaaaattttcgcaacctacttatctgacaagggctaatatccagaatctacagtgaactcaagcaaatttacaaggaaaaaacaaacaaccccatcagcaagtgggcaaaggatatgaacagacacttctcaaaagaagacatttatgcagccaaaacacacatgaaaaaatgctcatcatcacttgccatcagagaaatgcaaatcaaaaccacaatgagataccatctcacaccagttagaatggcagtcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcggctctgttcacaatagcaaagacttggaaccaacccaaatgtccatcaatgacagactggattaagaaaatgtggcacatatacaccatggaatactatgcagcctatacaccatggaatactatgcagccataaaaaatgatgagttcatgtcctttgtagggacatggatgaaattggaaatcaacattcttaaagaaaagaattttcaacacagaatttcatatccagccaaactaagcttcataagtgaaggagaaataaaatcctttacacacaagcaaatgctgagagattttgtcaccaccaggcctgccttacaagagctcctgaaggaagcactacacacggaaaggaacaaccagtaccagccactgcaaaaacatgccaaattgtaaagaccatcgatgctaggaagcaactgcatcaactaacgggcaaaataaccagcttacatcataatgacaggatcaaattcacacataacaatattaaccttaaatttaaatgggctaaaggccccaattaaaagacacagactggcaaatatgataaagagtcaagacccatcagtgtgctgtattcaggaaacccgtctcacgtgcagagacacacataggctcaaaataaagggatggaggaagatctaccaagcaaatggaaaaaaaaaaaaaaaggcaggggttgcaatccttgtctctgataaaacagactttaaaccaacaaagatcaaaagagacaaagaaggccattacataatggtaaagggatcaattcaacaagaagagctaactatcctaaatacatatgtgcccaatataggagcacccagattcataaagcaagtgcttagagacctacaaagagatttagactcccacacaataataatgtgagactttaacaccccactgtcaatattccacagatcaacaagacagaagcttaacaaggatacccaggacttgaattcagctctgcaccaggcagacctaatagacatctacagaactctccacccctaatcaacagaatatatgttcttctgagcaccacattgcacttattccaaaattgaccacatagttggaagtaaagcaatcctccgcaaatatgaaagaacagaaatcacaacaaactgtctttcagaccacagtgcaatcaaattggaactcaggattaagaaactcactcaaaactgcacaactacgtggaaagtgaacaacctgctcctgaatgactactgggtaaataatgaaatgaatgtggaaataacgatgttctttgaaaccaatgagaacaaagacacaacgtaccagaatctctgggacacgtttaaagcagtgtgtagagggaaacttatagcactaaatgcccacaagagaaagcaggaaagatccaaaattgacaccctaacatcacaattaaaagaactagagaagcaagggcaaacacattcaaaagatagcagaaggcaagaaataactaaaattagcagaacggaaggagatagagacacacacacaaaaaaacccttcaaaaaatcaatgaatctaggagctggttttttgaaaagatcaacaaaattgatagactgctagcaagactaataaagaagaagacagagaagaatcaaatagatgcaataaaaaataatataggagatatcaccaccaatcccacagaaatacaaactaccatcagagaacactataaacacctctatgcaaataaactagaaaatctggaagaaatggataaattcctggacacatacaccttcccaagactaaaccaggaaaaagttgaattcctgaatacaccaataacaggctctgaaattgaaacaatatttaatagcctaccaaccaaaaaaaagttcaggaccagacagattcacagccgacttctacaaagaggagctgctaccattccttctgaaactattccaatcaatagaaaaagagggtatcctccctaattcattttatgaggccagcatcatcctgataccaatgcctggcagaagcacaacaaaaaagagaattttagatcaatatccctgatgaacatcgatgcagaaatcctcaataacgtactggcaaaccgaatccagcagcacatcaaaaagtttgtccaccatgatcaagttggtttcacccctgggatgtaaggcggttccacatatgcaaattaattaacataatccatcacataaacagaaccaaagacaaaaaccacatgattatctcaatagatgcagaaaagactgacaaaatttaacagtacataatgctaaaaacttaataaactaggtattgatggaacatatctcaaaataataagagctgtttatgacagacccacagccaatatcatactgaatgggcaaaaactggaagcattcccttggaaaactggcacaagacagggatgccctctctcaccactcctattcaacatagtgttggaagttctggccagggcagtcaggcaagagaaagaaataaagggtattcaattaggaaaagaggaagtcaaattgtccctgtttgcagatgacatgattgtatatttagaaaactccattgtctcagaccaaaatctcctcagctaataagcaacttcagcaaagtctcaggatacaaagtcaatgtgcaaaaatcacaagcatttcctatacaccaacaacagacagacagagccaaatcatgtatgaattcccattcacaattgctacaaagagaataaaatacctagaaatccaacttacaaaggatgtgaagtacctcttcaaggagaactacaaaccactgctcaatgaaataaaagaggacacaaacaaatggaagaacattgcatgctcatggataggaagaatcaatatcatgaaaattgccatactgcccaaggtaatttatagattccatgccattcccatcaagctaccaatgactttcttcacagaactgaaaaaaactactttaaagttcatatggaaccaaaaaagagctcacattgccaagacaatcctaagcaaaaagaaaaagctggaggcatcatgctacctgacttcaaactatactacaaggctacagtaaccaaaagagcatagtactgctaccaaaacagagatatagaccaatggaacagaacagagccctcagaaataacaccacacatctacaaccatctgatctttgacaaacctgacaaaaacaagaaatggggaaaggattccctatttaataaatggtgctgggaaaactggctagccatatgtagaaagctgaaactggatcccttccttataccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaccaaaagccaaaattgacaaatgggatctcattaaactaaagagcttctgcacagcaaaagaaactaccatcagagtgaacaggcaacctacagaatgggagaaaattttcacaacctgctcatctgacaaagggctagtatccagaatgtacaaagaactcaaacaactttacaagaaaaaataaaacaaccccatcaaaaagtgggcaacggatatgaacagacacttctcaaaagaagacatttatgcagccaacagacacatgaaaacatgctcatcatcactggtcattagataaatgcaaatcaaaaccacaatgagataccatctcacaccagttagaatggtgatcattaaacaggaaacaacaggtgctggagaggatgtggacaaataggaacacttttacattgttggtggtagtgtaaactagttcaaccattgtggaagatagtgtggcaattcttcaaggatccagaactagaaataccatttgacccagcgattccattactgggtatatacccacggattatacatcatgctactataaagacacgcgtacacgtatttttattggggcactattcacaatagcaaagacttggaaccaagtcgaatttccaccaatgatagactgaattaagaaaatgtaacagatagacaccatggaatactatgcagcaataaaacaggatgagtacatgtcttttgtagggacatggatgaagctggaaaccatcattctgagcaaactatcacaaggacagaaaaccaaacacggcatgttctcactcataggtgggaattgaacgatgagaacacttggacacagggtggggaatatacaccagggcctgtcgtggggtgggggaatgggggagggatagcattagaataaatatctaatgtaaatgacaagttaatgggtgcagcaaaccaacatggcatatgtatacatatgtaacaaacctgcatgttgtgcacatgtaccttagaacttaaagtataataaaaaaaaaacatacaaacctattatacttttcccttcttaaatttatccctttctttgatcttacatttccctgtaggctacatcttgttactgtaattccttttattatagagttactacaataattgtcttttactgcctctacttcctatgatgacattacagttacactttcttccccaccactgtactgaaattaaaaaaataataataaaatggatttcctccatccctatgagactgtactttgggtgtcagatgacaaaaacacagtcacttggcacattttagatactgatgaaatattcattgaatgagttaatatatgtttgaattaaggatttgattttttttaagtcccttgttggcttcaattgtttctttcttgttttttttgttttgttttgttttgtttttttttgagatgtagtttctctcttgttgcccaggctggaatgcaagggcatagtctcggctcactgcaacctctgcctcccggtttcaagtggttcttctgcctcagccttccgagtagctgggattacaggcatgcgccaccatacctggctaattttgtatttttagtagagacggggttgctctatgttggtcaggctggtctcgaactctcgacctcaagtgatccgcccccctcagcctcccaaagtgctgggattataggcataagtcaccgcgcccgactggcttcaattgtttctaaaccacaatggactttcgtaaattttttgaattaaataatactactagctaacaggcaatgaatgtatttccttaattcagtgttcactgtcatctttcatgaacaccttctacataagacgggtccctgcagaagatacaccctatgttgagtgatagtgcaattctatttcattcctgtagcaaatctctcagagacttttctatcttaggaaatatcacagactccttcacagaaggaaaacaagaattaatcttagaaaggttgggcatttcactttttcatagagtaaaataaactgaacattaaatgaagctacactttagatatttttgtcatgtaggctaaaaatttgtaagtaaagaatcttggctgggcgtggtggctcacacctgtaatcccagcactttgggaggccgaggcaggtggatcatggggtcaggagatcgagaccatactggctaacatggtgaaaccctgtctttattaaaaatacaaaaaatcagccaggtgtggtcgcgggcgcctgtagtcccagctacttgggaggctgaggcaggagaatggcgtgaacatgggaggcggagcttgcagtgagccaagattgcaccactgcactccagtctgctccactgagcaagactctgtctttaaaaaaaaaaaaaaaaaaaaaggatcttgactaatgaactaatgataggtatatgctggggacataaatgtgccagtgaacagagccacctcaggcaagggtgcagtattggctttggtcacactgaatcaaagttcagggatcttctgcctcttgttggaatctggctagactttggaacctgcacaatactgacttatccacccactggctggccaagaagctgagacaaagagaaaagaagccacctatacttgcctgaagcaagctgcacttgatcagattgattcatgaactcagagcccacaggcctgagtacaggtggctcaagaagaaagtattagttcttttctgctgctataacagaatacttgaggttgggtgatttataatcagcagagattaattcagctcatggttctggaggctgcagtgcccaagggtgccgataacttctgggcatctgataagggccttcttgctgcatcatcccatggcaaagggtgcaagagtgtgggactgcacacacaagaatgagagagggcaagagggggcttggctttatcagaagtgcctcctaagacaatggcattaatccattcatgagggcagagccctcatggcttaatcacatcttaaaagtctcaccttttaatactgtcataatggcaatgaaattttaacatgactttttgttttaatatgctgagcttttattcatatttttttttaacttttaagttcaagggtagaagtgcagttttgttacataggtaaacttgtgtcatgggggtttgttttacatattattttgtcacccaggtattaagcctagtacccgttatttttcctgatcctcttcctcctcccaccctttgtcctccaccctcccaaaggacccagtgtgtgttatccccctcattgtgtccgtgtgttctcattctttagttcccacttaaaagtgagaacatgtgatatttggttttctgttcctgtgttagttgctaagaatgatggcctctagctccatccatgtccctgcaaaggacatgatcttgttctttttttatggctgcataatagtccatggtgtacatgtaccacattttctttatccagtctaccattgatgggcatttaggttgattccatgtctttgctattgtgaacagtgctgcagtgaacatacatgtacatgtgtctttataatagaatgatctatattctttggggtatatacccagtaatgagatttctgggtcagatggtatttccatctttaggtctttgaggaatcgccacattgtcttccacaatggctgaactatttcacactcccaccaacagtgtatcaacagcgtttaagtattcccttttcttcacaacctcaccagcatctgttattttttgactttttaatagccattctgactggtgtgagatggtatctcattgtggttttgatttgcatttctctaatgatcagtgatgttgacctttttttcatatcaatatgacttctgaaggggacattcaaaccatcacagagatacatgccaagccttcatgaactccacttcaggactgtggccccacttcccatttaacacggcctcatggatactattatacaatcttttcagtctcagggatccagctaagtgattccttctcccatggatggaataagggagattataaaagcaggaaatgggagcattcacaccaatactacctcattttaggggaaagaagaggaaattcccttttgtaaacaaaccatagaggtttccaccaacaacatgcattatgtccagtgctggaagcctgaatccagtgatgccatccatagttgtgggtgttgtaaaatccttttagagcaattaatattcaatgttctgaatttttccagtaaaagtggacatgtttacaaggattcatgtcttcattctttatagtgtgtggcttgtttttcattttgatttgaatgagccatataattcagttatttctgtcctcagagctttgctgaagtgctgcttcatctttgtatcatgtgatataagtgccaattttactaatttatattgagagctctggagaaatctttaactacaggtaatcccagccttttctaggttaaatggggcccatcacaccattacctcccctctcctgagggaggcttatatggtttgcctctgcatccccacccaaatctcatctcaaattgtaatccacacatatatcaagggggagacttggtgggaggtgattagatcctgggggctgtttccccaatgctgttctcttgatagtgaaggagttctcagagatctggttgtttgataaatgtttggcattttccctgcttgttcttgctctctcctgccttccttccccctctccttccaccatgattctaagtttcctgaggcctcccaagccaggtggaatggtgagtcaattaaacctcttttcttcataaattacacagtctcaggtatttctttatagcaatgtgaagatggagtaatatagaggccatccctgtgggtactctggactgagatttgcttttgcctgtcaccctgagcttttgatcttaccttatcctcttattatccttctcttccctgtctaagtgacagaaccaggtcttcacagtacttgaaggcaagtacctatcctctgagtattgatgccttattttactctttagtatcgaatttctgcctgataaagaatgacttggaggtctccatgccagttagccatccatccagtcatgcatccagccaaccacactccccaagtgtctcctgtgtgccaggtgctgggctaagtcctagggatacaaaagtgaattcatcatggtctatccctttggggatctcatgtctactaggggtaggggcaggtaaatgaatcagtaatctcaaggtttttcagtaactctacagatgtccaagatgccatggagaagcagagcaggcagtcactggcactggtggtggtatcaaggaaattttctcatgaggtggcattttatgtgtctggaaaattggagtggtagtgagaagtgacagcgtgctggcagtcctcacagccctcgctcgctctccgcgcctcctctgcctgggctcccactttggcggcacttgagcccttcagcccgccgctgcactgtgggagcccctttctgggctggccaaggccggagccggccccctcagcttgcggggaggtgtggaaggagaggcgcgggcgggaaccggggctgcgcgcagtgcttgcgggccagcgtgagttccgggtgggtgtgggctcggcggaccccgcacttggagcggtcggccggctccaccggcccagggcagtgaggggcttagcacctgggccagcagctgctgtgctcaatttctcgaggggccttagctgccttcccgcggggcagggctcggaacctgcagcccgccatgcctgagcctccccctgttccgtgggctcctgtggggcccgagcctccctgacgagcgccgccccctgctccacggagcctagtcccatcgaccacccaagggctgaggaatgcgggcgcacggcgcgggactggcaggcagctccacctgcagccccggtgcgggatccactgggtgaagccagctgggctcctgagtctggtggggacatggagaacctttatgtctagatcagggattgtaaatacaccaattggcactctgtatctaggtcaaggtttgtaaacacaccaatcggcaccctgtgtctagctcagggtttgcgaatgcaccagtccacactctgtatctagctactctggtggggacttggagaacctttgtgtggacactctgtatctagctaatctggtggggaggtggagaacttttgtgtctagctcagggattgtaaatacaccaatcggctctctgtatctagctgaaggtttgtaaacacaccaatcagcacccagtgtctagctcagggtttgtgaatgcaccaatcaacactctgtatctagctactctggtggggacttggagaacctttgtgtctagctcagggattgtaaacgcaccaatcagcactctgtcaaaacagaccactcggctctaccaatcagcaggttgtgggtggggccagataagagaataaaagtaggctgcccgagccagcagtggcaacccactcgggtccccttccacactgtggaagctttgttctttctctctttgcaataaatcttgctgctgctcactctttgggtccactttgcctttatgagctgtaacactcactgcaaaggtctgcagcttcactcctgaagccagcgagaccacgaacccaccgggaggaacgaacaactccagacgcgccggcttaagagctgtaacactcaccgcgaaggtccgcagcttcactcctgagccagcgagaccacgaacccaccagaaggaagaaactccgaacacatctgaacatcagaaggaacaaactccggacacgccacctttaagaactgtaacactcaccgtgagggtccgcggcttcattcttgaagtcagtgagaccaagaacccagcaattctggacacagtagtttaccagaaaagaggggaaatggcttccaaggcagaagaaacagtgcaggcacagacatggaggcatggaagagtgcagagtgtgtgtgaactgttgggtgtggccagagcatagtggacctgaagcaaggtggagaggagtagttgtgggcaagatagagtttatggggggctagtttctgatggaacttctaactttcctcaaagatggggccaccgattagagactcaacatggcaggagtcactctattcctttcaagagatggttctaattactactcctgccaatgcagtaaataacacttgagggcagtaggagccattttagaatatttgtggctcctatgaagctgtttgtgtgtcggggcaggtggcaagcccatttcttttcttttctaaagtcacataccttgccccttagctatcctcccttccataaaggtttgttgtgaagctggaatgtgatatcagatgtcacagggcagtgtggtttacgaagcctgtagaaatgttcttaccaactgtaagtacaccttggcacctggaggacaagaatattcactcctgcatcactctgttccaactgtgttcacactccttagattcgcagaaggactgttttcagctgctggcccttccaggaatagccctaaagagccagaagggcaaaggagtaacattgaccacatcatggtgatacaaggtaataactttcagaggttttgctgtggaaatgttcctcctttcaatacggcatctgaaagataattggaagtcccccaaaagtgaggtcacccccaacttctcttcctactgctggagaatcagcgattgtcagagctgaaagggatcatagagattttactgtaatgcactcattttatagacaaaaaactgagactcagggatgtgaggtgaatttccttggtcctgcagcattttaatgacagaaatgagaccagaaaccaggtcttctgactcttagtcctgtggtggttctactccttcctgccacttctcctgtttgagttttttggcaatgtgaggacatttagccaatctggatactgacatttgaatgaagctaaccactagaagaatgtcaaggagggaacgatttacataggtaaatttacccaatccattgtccaatcttcagtcatgcaaatgtaggaactggactttgcccaagtcagagacctttggatctaggaacacactgatcaagcccttaagtgactgatgtagataaacgagaataaataagtaataagttcacagttgcctatggtaatagttaagagattggtcaccagggtcagatggacttgacttcaattctgactgtcatctgtaatgaaatttctgccatatgtaactttgggtgagttacttgatctttctcagcctcaattagtatattatgaagattagtaagtatatcatgaggatgaaaggtaataatgcaggtaaagttcctagcatacaataggtcttcagaaaatgaaagttcttactactataatgattgtccattcctctgaattcagatttctctctaggtgatagattatctgccaaagaccataaccccttgaataatcccaggtaattattgccaacttctagatttggaatttttccttttttctgagcttcttccttggattcacacaacctttttccaaccaagatacaataagattaattagatttctgcttctaaattataatcacatttcataatcacaaaccttccttgagaggcatcttaattggaattaagggttttcctgaattcgtcaggtccacatgactggcaatctttagctttttttccatgaatagaggggtgcatatccacaggcaaataaaaaaaatacaggatatgttggttaacaattaactagttaattaataatggctaatgttcctacagtgctttacaacttagaagagtttttcttttcatgcactattgtgcttttttcttccaccaaacttgtaaaataggtttgatttcagttttacacttggggaagccaggattgatgagctttggtcttttccatctcagtagaaggtgtcacaattctccctgtcattcaggacccaaacctagaagtcattcttaatgcttctcttcttcctcttacaccttacatttaatccatcaacaagtactttctgctttgctccaaagtggacccggaatgaggcattcctgcccctcttcactattagtatcgtagttcaaagtagttttatttcttgctggatttgtgtgctagcctcttaaatggtctccctgtttctgtccttccctctgataatccattctccacacagcagccagagtgatattttaaaaatgtaaatcagatcatgttactctcctgcttaaattcctccagtggctccccattgcagctgggaaaaaaataactccttgccatgttcaacaaagtcttgcgtgatctctgtctgacttttattgcttaccatgcccccacgtagtcaccatccaaccacaatgaccttctttttgtccctcagacatttccagtgtatatagcttttgcgttaactctgccttctgtctggcatggcccttctcaaaatattcacatggtctacctctttctctttgttcagatctcagcttcaatgtcatcagagaagagctttcccttaccacccaaacactctcttctactccagcagtattctgtttccctgttgtattttattcttaacactcatgactatccaaaattaatcagtcttgtctggatgctttataggtattaactcgtttaatgcctttaaccagtctagacaggtactactatattcattttactgatgaggaaattaaggaaaggagaggttaagtaagttgctcaaggtcacacagtaagtaatggaatcagagacaggtctgctccagatcctgcacatctgtccatgtagctgcagtctcctggcctgggctgcgctgatacagctgcagttctcagactaagttcaacaagagtcccagtcctagtccagtgatgcctgaagtcacatgtttcattctgggcctcacattcatgaagaccactgacaaaaaggccccagggccccagatgaaaaacataatttaaagccagtgaatttgagaagcagttgagcagttttgggttttctcatcaaattacctgcccaatgtcaaaatattagtaaattatagatctagattttaattgagtgttgtctgacattcccttcctcagtgctgacttgagattactcaagatgacagaagaaaagtgctgcctcagaggttctttcctccctctctgtctttgaaaaagcacagggagaagagggctgaagatgtgactgtccagtaattggaaccatctcggctcctctgaaattctaggagaagaataagtgaacagtatgatatcttgcaaagcttcatgtgccttaatcacattaaaattcacaattcagttttggatttatttttccttgttttttgaaagttattgacttgggacttgcttctggatctcagttggacatctgacctcatgccattattgtcatccatttagaggtcatttatttcagtgttcttgaaaggcagccattcccagtggttggccttctctattgcatgtgacacatcgcagctcttctgcttagcttttcttggtcacacagctatcaggtggtgactttggcctccaatgtggcccttacctctgactttgtagctcctctgcagtactcttcactctggttctgtggagttttgactccgagatacccatgaccttttaagtttcccagcaccagctaacctttctgagaatctgcatcagagggctgcagtggtcagggtggcaggtcaccagttgactaatggcctcctccaaggtttgctggcagacactgcgttgccatgaaccctattgatcccagaagtttgcctgctgcttagacagtctttgcgggcgtgaggaggtagtgagtcatggagccaccacccctgctacccatctgttcttgtggtgaggagaacaaagatgatctctttgtggtatcataaaacctagaaagacattaaaaattccgttaaattttcatacgcttttagctgttgaaatgtacaatctattatgaggggggaaaaacccactgtaattttccccccactgcccttacttcagaggctacttaagggaccaggtaatgattttacgatgtttattaatacttcatgttctgcttccctcccccattcatttatctttaaattgaaagcacagaaactgccagggatctttaaaatccagagtttttgcaatgtcataggttgttctgttatggatattgtatgtagagatctattgttgactcagagctggggatggggttgggggtggtatttatttttaaaatgcactttggagtaatggaaataacatgagttttggagccagatatacatgagtttgaatcctggccctgccatttactacctttgtgaccagtatcaaacaagttacctaacctccgaaggccactcagttcaaccacttgccagattgggaaagtaatacctctctctgagaatttggatgacctcaaacagagacctctcaatgcaggcctcgtgggaacaatcttatcttatccggatatccagataatttttagtttttcttagttgttctgagtaattacttttattttctctgtctctcgtgggtatcatgtggagtaactgtcaagatatccctcacccctttggttgcttgagaattgacagcatattgaagcctcatctatagtagatttataaactatggtataaagctataacctcacctcaatttattttgttcccatgtttggtttatttaatctttgatcccacttacctcattttatatttgcctactagttataagctgtctgaaacattttataacatagcatgtagaaatatgtctggaacatagtaggtactcaatagatatttggtaaatgaatgaataagtaagcattagagatacagatacaatatgtttcagaggataattaaataaaagagggcaagataatgagtttgtgcctttgagatatccaaataaaaacatagagtagacatttggatctatgctaggaaaaaaggctagaaatagagatttggaagtcataagtgtagatgatatttgaagccatagatatgtgtgagagactctagagggagaagagaaatttcagtactttagaggccaggtagaggaagatgtgcctgcaaaggaggctaaggatgtacctgccaagggcagggagataatgaggagattttacaaggggagggaacaatctccaaggatgctgaaaaaggaagggagataaggactggacactgttcatttgatatagtgactcggggaccttagtgaaagtcacttgcttataatagtgaggcagaagataaaagtcgtacagcagccacagctaacactgagcacagatgctgtgccaagtgcttaatgtggactgttacattacaacaacatgagatgtgtagtcatctcaccccattcccattttttacagaggataaaaatgaggcataaagaagttaatcacccaaggtcatatagctgggttcaagccaagacaggtgtcaggactcagagtcacagttgagaaaatgaagccagaaagtttagataactcaagaaatttggtcagagtgtggggggagagagagagagatggggtggtcactaggggaggaagacggttggaaataggtagagtgttccactgtttggttgattgattgttggaagatggagatttgcttgagcatgtctgattgctgataagaagattctagtagtgagtgatgggttgctgatacccagagagaagggagaatcagtactgtgggtccagagaagacaggcaggattagccttggaatacagactttctattttaataggtaggaagaagacaaaaatggtacagctcatgggagcagcatgtgctcggaagtgggaagttaagggatttcccttcatgaggcttctgttttctttgtgaagtaaaaagtgagatgatcttctgacagagtggtagccaagtgagagagtcagaatctgtaaaaaatggaaaaggtttaaaatagaagtacagaggatcggggaaaagatgattagagaaatcttggaggattatcaaacggtacacagaaccctgcttaggggtcgccatgaatttattataaatctgccctgtggtgtgattttctccagcagcactcagcatctggttgtaagcacacaggaaagggttgttcttttgttttattaatcttaatgaatagcagtagtctgttctgcaagtccttgacaccaccctcttttctatatgctgtatctaatctgttaccaagtgctgtcagtcttaggctccaaatacgtctataattcatgaactctttccacctcaaaatgctacctagcctgtgttcccataatctcgcaactggattattcaacaggcttataacacttgtcattgaatggaaacttgcctttttcagtccatcctgaacactgcagccagcatgaactttttataatgaaaatctaatctaatcctgtgacctcccagcataaaccttctcaagtcttcccaatgcttttagggcaaaaaccaaaaacccgaattatggtctcccctccttctggcaccactgttttcattgatctctgacctcagttgccctcttttggttttctgcacacgacacccttctcaccgcaagatctgctctcatggtcttgttttgcttccagtatcgagtccatgttccaggaagaaggacaaggacaaagggcaaaagtatggactttgcttctgttccagtgttaactctgaaacctcactcggtctcttctgcctacatgtcaatggccagaaccgtattacatactactacctgcaagggaagctggggaaaggtccattttttgccagtcacatttcagccttcaataaaatgagagttgtgttatttaaaaagaagaggaggaggggcactaggtaagcaacctggagtcccaccttcaatgaggaagtgttttctaggtgaagagttgagtgaaggagatgctgacagaagtgacagcatgaatacagtttagtgctgagcaatatgatgtgggaagaaggtgctggaacactgagtttgaggcagggaaaagggagggaggaaacagagaagtaggcagggatcaaaaaatcataatgcccttctattccagctgaggaacttaaacttcatcccgtgtgttagcctctaaatgaggtcttatatgccaggtgatgtcaagcaagatggtctactgggtatagacaaaaatgttggtatttttatttatctccatttttatttcattttgtttaaattctatttttaggtatgcatcttgacatacacacatataatttataagttcaatagtacattatatacaatttataagtaatagctatgttgggagtccatctgaagacttttttcttagtgacttgcacagtcaaaatgtttagaaactattgcattaggcatcagggaactgttaaaacattttaaacaaggaaatgatgtgatccaaattgaatatggtccaatttgccttttctttcccctatagagttctttaaatttttaaaaattttagaatgttagtacttagaaagaaacattagggagcatcaaccctgtgtcataagtaagataactgaggcccaggaatattaaataattagaaccattaatttgtggctgagctggagccccatccaacctgggtctcatcttctcccagtggtcctttgtggccctgtgcgagtgctttctctcttcctgaatgcatgtccctattcttcagcaaatactcttctcatcagaattatgacatgtgggaatcaagaggggagtaaaagggcatatttataaaaaacgtggaaaccaagaaatctgttttgtaaaaatgaatcacctatttagcctcagggttctgttgactctttagctgtcaacatggaagtctctaggtaccgattcctgcaggttctgttttcataatgccagacccatcagcagtttaactgagacataccgttgtacaatgtcattattttaggtattgtatttgcaaggccagcggtctaagtaagagattaaactgaacagatttctgacttggtaagacagagactttctaaggggtacactgccccactttatcttaccccagtgtatatgaagaaacacatgtttacccatgggaatgtgtatgtatttggatctatttcacagagtatcttataaaaaccgacatgaaaagaaagtctgatttatagaatcctatttcctgacattgtgaatactagttcaggactttgctaactactttttgaccagtgtgactgatttatttccccatgccatcatcaacccagctatgcaagtacaggaagacagggtatctaataaccagatggtgaacaagatctgtattctcttgggtatactaagctattctgaaaattcagtttataggggtacagactaagggttatatatctccaaacaaatgtgtttgtcaagttgatgatcatgtttaccaagatccttttatcaccagctgagtcctcttttagtggcttaggtcaccctggaattatttcaaaaaccagcctgatgtttagaacctcctgtgggctcgggcttgccagacacaaacctaaaatgaagcctgtagccttcatggtagcaaactgtaacctcaagcacaattatatgaatcatggacaaatgttttcactttcaagcaagtttttgccgcagcaaaaatgaccacttatctaagaggctgcatatttatatatatataaacagtttttggacataagaatcttgactattatttcccacagagaattacagatttatatatgtgtgtctatgtgtatatatatgtgtgtgtgtgtgtgtgtgtctgtgtgtgtatatatacatatgtgtgtgtgtgtgtctgtgtgtatatatatatatatataaacaccatattctgtgtcttttatatatagtatcacttgattattataattaccatgaagtgccattgttcttctcattttataggtgaggaaactgaagctcagagaggtgaaataacatcacaaagctaagaggttgtaaatttggcacttttaaaattatctagttattacaaaagttgatcttcagatcaacaaacttaactgacatttcctttttgggccccattttctactctgtgaactgaggaggattgaattcagtgattctcaaaccagagcatacgtcagaaccacctggggggattcttaaaacactgattcctgggcctgcttagagtttctaaatcagaaattctctggagcgattaagaactggtgtttccaataagttcccaagtggtggttcccagccacactttgagatccattggagtagatgatctctcagtgtcttccagctgttacatcctggagggtcagcaacctgccatacttcattggtgtgtgaccaaaaatactgcttcttcatggagtgactttcctactacttttgccaagtttgttggttagccaggaaaattctcaacatgaatggaggaaaatgctgatgaaaatcactccttcctgtatttattaactcatttgccagactaatatttactgagtataccctttgcagatattgtgctacatactggagatagcacatgtgaagatactcagcccctgcctgcgagatgcctatcaactatggagaaaacagatgattaatttattgttattactaaaagggaagtgctgagacctatgagaataaaatacttctctaggatttgtgattatgacttcaaacttttcctaaacaggactattttctactgtggtcttaagtcataaattgtctattctctgtatctagttcgattctgttcttagctttttgaggtatttctttattgggacaggtcagtaagtggcattttcatttattttttaccaacctaagcatttccttcctgccctagatgaaaacttagctttgttcaaaatttgcattttcatttttagcctatggtgacagtttaaatcaacagcaaaagcagaaacccttgtctaaagcaatttcctcactgttattccaacttcagtgaaatgagaagtcctggggagatgaattcagactgtcttctctactcccaccccttctcctaacagtttggcttcttgaaaaaaaataaaagatgaaggaagcaggggtcttgaagggaagatgtctactgtaaaaaaaatagggaaaggaaatagtgtactgataatggttatcatttgttgagtgtgcattatatgccagggactgtcgccaaacattgtacatgaattagcaggtaaacttccccagtaaccaatgaggtacaggtaccattattatcttccttttacagatatggaaattgaagctcacagagggtagataactgtcccaaagtctcatggttatttgatggaggaacaggaattcaaaagcaggcctgactccaaaatctcatgctttttaccagtaaattagatctccagtcatttcaatccctgcatttttcatagggatggtgctgactcatttggcttcctggttttctgactcatctcactgaacagggccagatccgatatgtcttctgcattctcccttatatcatctttctccctgctcccttttctattatggtccacctactctatcatcttctttccatgggccttaaaggaataccttcttgtggactgtctctgtgatgcagtagaaatctggtaagcttgccagggtgtaaaaagtgcatttgtttaggactgtaatgtttatttgaaagggactttcaatcacagacatgacttttttatgagcctcattatatatccttgtgattggaaaaatgcatcagtaaataatgcctccatgaagagtcactctcacttgcattattttaaaagatttggtaataaaaagtactcagattattgataatccataattaatatgaagtaaataatgtgtgttttcaaataaaattcaccatgataagtgatgagagtatgggcttttatatttctttgtaagtcagagacttataaaagataggttatccatcactaaggaatatgtagacacattaattttagcattcagttttttttctctcttttctaaaaaacatgattctattcttcaaaagaaagagtggttttattatttttccagctctttaaaatggttcaaaaatcttggcctgcagacatctttttaaaaaatcaatttttcaataatttagagtgaatcacacccataggggggatgtgctttcaaaataattaaagtagaggaggcaggattatagatcttgagaaaatgtgcttggaaaatgtcctttgatttgttgtgaaccccaaagctttgaataaaataggataggactggaatcaacttctgaactttctcactagctagtggcatgttaccagtagtccagagaatgctgaatgcccatctaatctacactgtcatcccttttattaacaaaacttaggcttttagggtacatcagggtctttcattatagactacatttcccagctccctttgcagctacacatgttcatctaagttttggccaatgaggtataagcagatgtgtcctgtgggattcctgagacgtctcctttaaggagatcaggcagtggccatcctctttccctcccctgggtcaggtagattggctggtcaggtaggttagcagtgactttggataagggggacagacgccatactccagggatggcagaacagtgagcttttgtggaacttccataccagccttggattcactacctctggactttgtttgtatgagtaggaaatttgtttatttgtttttgctgttgtttttgctttattagaaaatcactgttttgtagatttgtagctacacttaatcataactaataaaaatggtgactcataaggtttgggaaaacaacagttaaattaaggtagtaagtttagctatcattattgagcacctactatttactaggaactgttctaagatctttatttgtaatagctcacataactcattcaacagtctttctaagagacttacccccattttacagatggtcagtcacagagaggttaaataacttgcccaagatcatacagccaagccaggagttaaaatcttcagtctatctcttaaactttctgtaaatcactgtgatgaagtgacttgacaacattctaaaaacaagtaaaactggacctaaactccaacttttccctatgtaggatacctgtctcctagacttgttgctaattatgttagttggcctctggcacatcacttagagcccctgtgcctcagacttaacactaataagaggcatgggacaatacctcaccattgtttagtatccattctgagcctggcactgtgccagacacacagatgtgtgaatgacagcgcacccagagggagaccatgcgttggtcaaggagacaaggcctgaacacttaagaagagccaaggaacagcaagggaaatgcagaaccacaatgtcactacatccaggagggttcttggtgcttgatatgtggctagcaaccagtgaacatccctggaaccaagtggcaatgcatgttaagtgccctgtgagcaggcagaaataaatgttttgaatcaaaagaggaggggagctttggcatctaaaggattcagggacacatggtgagtgctttggttcatgttggttgtgccagtaattgaaggagtcttgtagttggtaagatttggggaggtgatgggaagttaggctcttcccccttctggctttctctgccccagggctaacagggctagttcctggaacaccgtctgtgctcccctgtcttgggtcctacacacagctacctacctgtcagcttgggatgctttcccagcctttcatcctagctaccttcttatcctcctggtctcagaaaaaaatgacatgacctatatggagtctctcctaagtagaccacatcccacttacttgctctactgtgtggtgaaatcccatcaaaatggaggatatggttccaaagtcagtgcatactgtgagcagtgaatcagccaagagaatccttgaaaatccctgagggagctatctccacagtggaaactgataagctatctccagtaagtctaacacattaattccggtatttcttttttccctgttcgagatagctgtcctattttaaagtctaggttgtatgaaaaaaatctaggttacatgtagccaagctataggttatacactccaaggagtctcatgtacatagaccatgatgggagtgacacacccctgaggtttttcagtgtatatagaactgtacatagtggaggtattagggtcagatgtagcaaaaggagatattcacactaaaagaaaatagaaaccgaagccaacccagggaagagctgatttacactccattctcgggttgagctccctgtgtaggatggtgaaataaatcacttgcattatttatattgtttaatttctctctgcatctccttcatttgcttcctgaagcctatgtacagttgactgtgtgtgtctatctctgcaaactacagatcttcacttcctattataacacttatcacatttgaatttttcatggattgtaattatgggttaaatgtgcctgccagattatacattccatgagggcaggggccatgtccatctcattacctgctgtggcccagcacctgcatggtacctggcacacagtctttccaagcagttctgtcctagacattgttgtggctttcttctcacccgccttcaggaagatccacccaacttctttctcagttactcagcattaagatctgtagttgctgaggcactcagttaagcttagggtggagctaaaacctgcctgggctggtgcttctctgatacagaaacccctgaaactgatgattatccagaaatacttgatctctttgggggcctgaggagctttggaccaccttaactcatcacctccttaagctcccctacctctaaatgctcttctcaccgctcccactcccaccccctcccccttgccccaaggctcctcctcagcccaactaactgaggctctttcacaatcctaaaagcatcatctttgttttaattttttcttttatcttcaaaagcatctaaaagtaaaaacaactaaagaaaagccagaaagtgaatgaagcagaaaaacaatttcagcactctgatacagtaccccaaaacaattttagttcactttgcctttttttgtgccattttaacgcagttgaaaccatgccgtatatgccagtgtgtagtctgcagttttaaggtgacattattgcatattcatattttcatgatattctttagaagcataattttaataatgccataatattttattgaatgctgtaatgatatttttaagccttctattaaggttggacacttaaatgtttacctttttttctctagtatgtaaatattatggtacaaatacacaaaaatactgcagggaacctttttattttctgcatctgacagactcgcagaaatggaattactaagtaaaaaatacaaactctttaaaatagatttttatttcaggtgatacttaatgcatattaagtgtaaaaaacttagaaaatacataaaagtatttcatccagcatttacctccaagagatggctaattttttgtatattttctgtctttttgatgtatgtgtatatgtgtgtgtatatatatgtattatgtatatattatatataaatatgtattatgtatatattatatatattatatgtatctataataaaatttatactgtattgatatattcatactatatatgtatcattactttacacaattgaaatactttatatgcatgttgttaaaactcttcaaatatacagcttttaatttactgtgtaacgatttttaaaacaacacttttcttgtatcatttaaattttttctgatttcttctattttgttgtatttgtatacataccttgtcagcattttatgttattccttaggatggattccagtaatggatttaccaagtcaaaaggtataaatttttaaggctcttggtgtatattgtcaagtttctttccaggaagattttgccaaattgcatttccaacagtccataagattataaagcaatggaaaatagcatgtcctttctgttttaatttctatcttattaactcttagtgaggttgagctttttccttatatgttattcatgtatatcttcttttgtgaattgtctagatacttaaaaggctaagaatatttggaggttatttttaaaaaataattttttatttttaattgacgttttatacatatttagggggtacatagtgatgtcacagtacatataatgtgtagtgatcgggtcagtgtaattagcatatccatcatctcaaacatttgtcatttctttgtgctagaaacattcaatatcctcctaggtatttgaaaggatatattattgttaactatagttattctacagtggtatagaatactagaacttattactcgcatctagctgtaattttgtgttttttaataaatctctccctcttcccctcttccctctaccattctctgcctctaatatcctctactttttacttctatgagatcaacattttttagcttcaacatgtgggcaagaatatgcagtgtttaactttctgttcttggcgtatttcacttaatataatgtcctccatttccatccatattgctacaaatgacaggattttgttgtttttttatgtctgaatagtattccattgtgtatgtatatcacattttctttgttcattcatctattattggatacctaggctgattcatatcttggctattgtgaacagtgctgcagtaaatgggagtaaagatatgtctttggtatactgattttgtttcctttggataaatgccccagtggtgggatcagtggatcatatattagttctgtttgtagttttttgaggaacctccatactgttccccataatggctcttctagtttacattcccaccaatagtgtaagagtcctttttctctgcatcttcaccagcatgttaattttttgtcttattttgataatcactatcctaactgggataagatgatatctcattatggttttgatttgcatttccctgatgattagtgatattgaacattttttcatatttttgttgtccatttatatgtcttcttttgagaaatatctgttcagatcatttgccttttttaaaaaatttatttttaggagacgggatttcactgtgttgcctagactgtagtgcagtggcacagtcatagctcactgcagccttgaactcctgggctcaagtgatcttcccacctcagcttcccaagtagctgagactacagatgcacaccaccatacccacctaattaaaaaaaatttttttggacagggtcttgctatattgcccaggcaggtcttaaactcctggcctcaagcaatcctccagtgtcagcctcctaagtctctgagattacaggcgtgagtcaccatttgccaatatttaaatcaggttggttgtttttttcctgtaccaatggttgaattctctgtgtattctggatattaatgtcttgaccaatgaatagtttgcaagtattttctcccattctataggttgaattttcactgtgttgattgtttcctttgctgtgcagaagcttgttagtttgacataattccctttttaaaaattttttcttttgttgcctgtgctttttagatcttattcataaaatattttccctggccaatatcctgaagcatttcccctatgttttcttctagtagttttatagttgcaggtcttgtgtttaggtctttgatccattttgagttgttttttgcatagagtaagagttgggagtctaacttcattcttctgcacatagatatccagttttctgagcaccatttattgacaagactgtcctttcaaagcccagtgaatgctgttggtgcttttttcaaaaatcagttggctgtagataggtggattaaagtctgtgttctctgttcttttccattggtctgtgtgtctgtttttctgccaatactgtgctgttactgttttggttactaaagctttgtaatatactttgaagtctgaaaatgtgatgcctccagcctgcttgcttgcttgcttgcttcctttcctttcctttcctttcctttcctttcctttcctttccttccttccttccttccttccttccttccttccttccttccttccttccttccttccttccttccttccctccttccctccttccttccttccttccttccttcctttctctctttctctctttttttctttcttctttcttttttgcttaatattgctttggcattgtgttttttgtggttccatacaaattttaaggcttttttctatttctgtgaagaatgtcattggtattttgatagggattacgttgagtgtgtaggttgctttgggtagtatggtcatttaataatattaattattctgatgcatgagcatggaatgtctttccatttatttttatcctctttagtttctctcatttgtggttttccttgtagagatctttactaccttggttacattattgtatttaattatttttgtagctattgtaaatgggattgccttcttgctttgtttttcatctagtttgttgttcatgtataaaaatgctactgatttttcatgtcaattttgtatcctgaaaatttactgaatttgttgatcaattctaagagtttttttggtagaatgtttaggtttctctatatatgtgaccatgtcatctacaaacagggataatttgacttccttctttccagtttagctgttcttttttttttttcttgcctagttgctctggcttattcaaaggttgttgacacatacatagatacctattttaaaagagtggcatgtgagaaaaatacaggaaatagagcccaataagatatgaatatttgaatttgctgatccattctttcatataggactataagatttaactcttaaaacttcaaaatttttctgtatgtactttccatcttgtaaagttataatagacgcgtgtcgttcttattggagtcaatgaattgggctctgtcatttgttgagatatcatccttctggctctggagttctgtaagaaaatgacaatatatttagggtgataaagctaatatctcaagtctcaattgtttgagagccagttatcagattacctttcacttctgttcctatcattttgttaataactattgttcatttatttatgtacttattgtctggtaccccactataatgcgtccatcaagagagcttacatctctctcagtagtctgtttccttcatttcctccaaatttccattaactttttaatctgtttgcttatttgggtttctgtctttcatattaggggctctcttcagatgataaggtgatccttggctgtctgtttcatgcttgagaatggggtactaaaaagatgactgggaactctatacatgcataaggcttatcaacagtggtttgtacttgtacggtgatctggatggcttgtttagaaggggaaatcctctgccagtatttttggatttttttctattagtttaattaacatccccagagcaaaactttcaatctttcaatatctaattgcagaaataaagcctggctgctggagttcaaggggctagcataggaaagagactagatgactccagtagatattatgaaaactttcactaaatcctcctttttcactttaacttttttactttcagctgcctggtatccactatctagatgccttctgtttttcctttccaggtaataaacctcgagtcttttgccaagttgacaaaagggatggtcacaccagtgtcaagtcagtactgagtctgcctttttattaaacaggctttcagccagttttactattttcagtccctctttactctcacttctagagatatcatctgccaccaaattcctaagcactttggggttctataaggcaaattgagttactttttagcttttgtcacaatcaattaaggcttcaggttgcttcaaattgttaaattggttaccatttatctttttactttttaactttcatgattttgttgctgctattattttctgtcatatttttgtcttgatgggtttgtatattttaaaaaaatacctcttccatgtcatactcattaggatggctactattaccaaacaaaacacacacacacacacacacacacacacacacacaaaacagaaagtaagtgttggtgaagatgtggagaaattggaaaccttgtgcagtgttggtgggaatgtaaaatggtgtggctgctgtaaaacatggtggtagttcctcaaaaagttacaaacaatattaccatatgatccagcatttcatttctggccatatacccaaaagaatggaaagcaaggactcaaatacatgtttgttcacccacgttaataaaagcatcattcacaatagctaaaatgtggaagcaaaccaagtgttcattagtggcagaactgataaaatgtgatatatacacataacagaatatgattcagcattaaaaagggagggaattatgacacatactatagcatggatgaatcttgaagatactatgttaaatgaaataaggcagtcacaaaaggaccaatactgtatgatccttcttatatgggatacatagagtagtcagattcatagagatagaaagtagaatgatagttaccagggatttgggggaagggggaaaggagaagttagtgtttaatggatatagagtttcagttttgcaagatgaaaaatgttctagaaatgggtggttgtaatgatttcatgatgtgtgaatgtacttaatacaactgaattgtatgcataaaaacagttaagatagtaaatgttatcttacatatattttaccacaattaaaaaatttttaaaaacaatgaaaaataattccactttacatttattttattctcttcttgggggagatagagactaattaatgtattcaatgtgttgcttaaaattaaatctattatttcttagtttacagctaagatgagcctttttagggctaaatcacttgccctggtcacagatctagtcattggcagcctagggtttgattcagttctgggaggaaggcagggtttgtatctgctgtgatacatagatcagttcgattcattctttcattagccagcattagaacacctttttcattccagcactcttgaaggtagcagtaagcaagacagtaaggttacatcacattaccatgtgagatggagaaaccagacagtaagcaagtatatacataaacaagacaaatgcaaatgtggctaattgttatgatggaaataaagtgctggctgaaatgtgggtagggaaggcttctctaaggaggagacttcagagttgtgacatcaatgtggagatggcctaatcagtgtgaacatgtgggcaggagtgttcctggcagaagcaacagcaggagcagaggcccagggctgggaataaggttggcatgtttgagaagatagaaaagaccagtttagcagaatgtactgaggaaggggaaggacaagtgatggggtaagaggtgtaaaaaatgcagaaccttgtgagccttggagtaaagcagccaaagctttcctaggtatacagaaagccactagaggggtttcaaagggaaatgatgattttactttttaacattctgttggctttcactttgtatctactgtatagcagatggtaggttgtagataccagaaatgcaatatgtaatactgttgcccacaaggaaattatggtctggtgaggaagaaagagcagagagtgccagaaaaatatagcagcatattccacagtgtacactttggggtactagaggtgatttttaggaaacaaaaattctttatagtagaacaatttatattcctttgggtatatacctactaatgggattgctgggtaaaatggttctttgagaaagaagttctctaagttctttgagaaatcaccaaagtgctttccacaatggctgaatgaatttacattcacaccactagtgtataggcattcccttttctccacaacctcaccagtatctgttatcttctgactttttaatgatagccattctgactgatgtgagatggtatctcattgtgattttgattttgatttctctaatgattaacactttttcatatgtttgttggttgtatgtcttcttttgaaaagtgttcatgttatttccccattttttaatggggttatttttcgcttgttaatttgcttaaattccttaaatattctgggtattaatcctttgttggatgcatagtttgcaaatattttctcctattctgtaggttgactgtttactctattgatagtttcttttgctgtgtggaagctttttagtttaattaggccccatttgtcaatttttgcttttgttgcaattgcttttgacatcttcatcgtgaaatcttagccagagcctatgtctagaatggtatttcctaggttttcttctagggtttttatagttttaggttttatatctaagtctttaatctatcttgaattgatttttatatatggagtattgattttatatatgatttttatatatggtatacaattaggtatataatacctaattgtatttcctaggttttcttctagggtttttatagttttaggttttacatctaagtctttaatctatcttgaattgatttttatatgtggtataaggaaggggtccagtttcaatcttctgcatatggctagttatcccagcaccatttattgaattggggggaggggtctttccttattgcttgtttgtgtcaactttgttgaagatcagattgttgtaggtgtgtggctttatttctgtgctctctattcttttccatggatctatgtgtctgttattgtactagtgtcatactgttttagttactgtagccttggaatatagtttgaagtcaggtaatgtggtgcctccagctttgttctttgtgcttaggattgctttgtctattcgggctcttttttggttccatatgaattttagaatagttttttctagttctgtgaaaaatgtcattggcagtttgatgggaatagcattgaatctgtaaattactttgggcagtatggccattttaataatattgattcctcctttccatgagcatggaatgtttttccatttatttgtgtcatctctgatttctttcagcagtgttttgtaattctcgttgtagagatctttcacctctctggttagctgtattcctagatatttttattttttgtgtcactattcaaaatagcaaagacatgaaatcaacctagatgcccatcaacagtggaccggataaagaaaatatggcacatgtataccctggaatactacacagccattaaaaagaataagattttgtcctctgcagcaacatgaatggagctggaggccattatcctaagcaaactaatgcaggaacagaaaaccacatactgcatattctcactggtaagtgggagctaaacaccaagtacatatgaacacaaaggagagaacagtagacactggggcctacttaagggtagaggttgggaagagggtgaggatcgaaaaactacctgtagagtgctatgcttatcagctgggtgatgaaataatctgcacaccaaactaatgtgacacgcagtttacctgtgtaacaagcctgcacatgtacccctgagcctaaaataaaagttaaaaaaaaataaaatagatgaacaaataaataaataaaatgtggttactagattgattaaaaaaatgtctacaatcaaatcaggttggggattcatatgtgatatttccttagagattctcagtgcacaccagcatattaaagtcccaattgttacatcacagaaacctgtgtactttgttcaactttacatttcctaaatttatttgcacaaatagcttctttcaaataataccttttaacatctttttaaactcctctgggaaacactgatttaaggcaacatgacaattatatgttaggtgttatggcaataatgaggggggcctaactaccacaactctgggtgtgaaacaggtaagcattcaggattgccttcctggagtaggtgacccctgaattgcttccagaaggagtagagaggttagccttgtgaagaatagagaagggtatttcatagagaaagaactgccaaaacacagatatgtagacccaaacatcccacatcatcatccttggaaaatagatttacaaatttccagcaggaagaggaaaaaaagtgcttgaagtgtgctggtttctcaccttagtggaaataattgcttaaaaaaacagccagaggctggacacggtggctcatgcctataatcccagcactttgcgaggccgaggcagcagatcagctgaggtcaggagtttgagaccagcctggccaacatggcaaaaccccatctctactaaaaaatacaaaaattagccaggcgtggtggcaggcacctgtaatcctagctactcaggaggctgaggcaggagaatagtttgaagccaggaggcagaggttgcagtaagccgagatcatgccactacactccagcctgggcgacagagccagactccgtctcaaacaaacaaagaaacaaaaaaaaccagagtagaatgcaattctcctcatctggatttcagcaagaattgcccatttctgttcagccgtaggcctccatcctctgttgccagtctgttcttctgactctcacctgtctcctttctgcacacagaaggccagagagaatgaacaattcttccccatgtcagttggctcacccttcctggaagtgtggatttcctgttagtacctgcaactctgtcggcgctgctatttctgtcttcgcgttgtttcagaatactctcacactgctgccccatttttccgtacgcagtcttccaggcccttttttgcacctgatttttgccaggcagcataattagaggatgttacatttccctgaaagagcatattctcatggacaacaggacacaagggagtaagaaagcttcaaagatgctggagggtctccctcctgtaccccaacctgtgccacttggtataacaggattctacatgagttagcttttctttattgttattaggagattaataaaaattgacctcatttatttagtgcttactatgtaccagacactgtaccaagaatttattatcattcaactttcacaaccctaaaatatgtgtattttacaaatgaggagaagtaggctggcgagtagcttgcccaaagtcattcaactcagaagagaggccatcgtttaatcttagattgtacttgtaaaattcacacatccaatacataatgcctttaaatgttctcattgttaacatttattttctttggattctgtgcctatttctgcttatgtctccggattacctgggagcttttaaaaataagaatcctagggttccactttataacattgaccagaagtcaagaatggggcccaggaattgctattttcagaagctccctaggtgactctaatgcagggctcttcataccttggtgtgcgtcaaaatcacctggtgagggaggatggctgggctccacaccacagtttctgcttcagtaggtctagggtggggactgagaatgcacacttctaacaagttcccaaatgctgttcatgctgccatcctagcacttgagcatttttcccaatatgtgtatgatccccctcccccaccaactgggtgacgtagatagaactttaagtgtcattaagttatgtcatgttttgaatctttctctgctcgatttccacgtcaacatgagtgagggcttcagggattttactccatcattttggctaaatgccaacttggcaaattccactcctcccccggagggactgcaaatgccagtgtcctccttcattcaggagtgaggtcattgtctgtgtggttaaaagtggacactttctgctgcttctgcttttgcactgtagtagaagtttcaaggagctctattttacagttccaaattaccatccctcccctctttaatgcttccaagatggatagtctctcaccataggttaatgtttagattttgatctctatttctcagccccccaaatctggatgatcctctggtgccagagctgttgcatgtatcacccctggacactttcttctctgcttgaaccagagaataattatatatagtagttcccccttgtccatggaaaataccttccaagacccccagtggatgcctaaaaacatgggtagtactgaaccctatgtatactatgtttgttttttttttttttttgatctggtaactgagaggattactaagcggacgacagggaggtagtgcctacagcatggatttgctggacaaagggatgattcacatcccaggtgggaccaagctagataacgtgagaattcatcacactattcagaatggtgtgcaatttaaaacttatgaattgtttatttctggaattttccatttaatatttttgtactagagttgaccatgagaaattgaaaccatggaaagcgaaactgcagataaggggagactgctgtgctagagtgctatagaggatttcatttggaaaaaaaaagttttggtcctggaaaaaaagtttaagaacatagtcgtattccatttcttcatatgtttgagatatttctggctttggtgaaacataggctaggaaaagaacctaacatcttattagtgtaactgaacaacagtaacagcagacttagcctttcttccttatgtgcaacattacctgtgacctgactcttgaaacatagctgctattaaagtacaagtgagtcatgcatagcagcttctccttgcccagttaatttctctgtaaaatctttactctcttttattcatgtatatatatgtatgtgtgtgtgtgtaaatatatacatatatatgtttgtatttccctttaaggatttcaaacacaaagaccctagtcatttgattgtctctgtactgtcgaattttgcctacaaccctgactgtagagacacattgttacctgttttccatattctgtctagtaaatgcttggttgtcaggacaacggcatagaaggtggaagctcattgataaccacgtgaattctttaaacaaatatgatcagagcaaattccagggtatgcttgaaagtagatttaaggaagagcaaaggtttcagacatatccttccttttataaacttgatattcatctttaaggatcagcaacagttggagttactcataattttatttaaaatcctgaataaagatatcaccttagttttatggtacgtttgtcattccagcttgttaggcatgagtgtgttgttactgacagagcccctggaggacaggcagacactgtggttctccatggtctctcagtaccaggcacagagcaagcacccaatacatattataggaataaatgatctcaaatcttcacagtgcctcttatagatggcttttatgatatatatctgcagagaaactgaattcagggattttaagtgccttttttgcaaggcccttaaagtttgggaaagtaggtgcatggaattagaactcagattatcctgacttctaagatcacactcttcattgtagcacactgccttcttgccaaaaaaaaaaaaaaaaaaaaaaaggaagaaacatgtaaaaagacagaccatttctaagatgaaatgtgtgcttttcaaaacaatagcagaaaaccttcttcaaaggtaaaatagttggaaatagaagaagaaataatatgtaatttagcgttcgttgaggataagcaattaatcctgccctccaggggtgaatttatgtctagcctatttgcacatgaaagtacaagttgggcttcatttctatgcaagtaagacatctggttgggaagtgaaaaattttgtcagttacctgaatcatgtttggtctacatgatagaaaagcccctgatgtcttcagatcaccagaagacatttggcattgtatagttaacaccagatccactgactgagtggttcacctgagagttgctgcttgacatcctgtagattcacccattgttaggaggctgttaccattttgtaagtcagcagtttgcaaacagtagtccagacgagaaaccaacgctggcccttgacaaagtgttcactggtgtgtgatgcaataaatacatgaggtcataaaaggaagtgtatttaccttaaaaaagaacatcctttattttgagatcctctgcttcctatgtttttagtgatacaattttgtgtcaaataaatcctcattgtaagatttggttttaattagtaaatgagacaggataaaaaattgagaaacctatataaatccctagttttctttatgtgatctttgtatttgattgtgaaaaaaaaaagcaaaattgtagaaaccactgctttaaaccttgtaatatttttagcacaatgacacctaaagtattttcatgtatttcccaagttttccttttcctagaagtggggtaactctccatggtagaactgtttgcatgggtcttgaaagcattggacatcttaacagtcaagtattttgctgacaaaataatgaattttccttttgaaacaagcgttttgttcttaaaataactctaaagagaacaccttctgcacttttaaagcatttccctctgaaggcatgccgtggagacatgaccatagggagaaactttttgtgctagaaaactgaattccaccactgtgaattttttaacagctttcacaggttctgcagtttgctctcatgaccccaaaagcatatatctccacatgctgtaacatcaaggatctctcctcaagctttgtaagctcggccagaatgagctgagtaccctctgtgtgtcaggcgatgtccaatacactgggaatagggagtcataataaccataattttatctgacttttgtctagcatttgtcatgtggcagacaacatgctaaaacacttatttgcattatcttgcttgattcttataaccactctgggagaaaaataacattattatagcctttttacaggtgaggaaaccgttgcagggaagttaaatcacttgcccaaggtcacaagccctgtgagtgataaagccaccaccatccaagcctgtccaccccctaacctgaactcccaagtgctatgctaaaccacctgcctcttatggatatattatctacaaaaagagctctgccctcaaggcgattataatctaaattagaagagggaagcacaagggaaaaagccattatgtagagcagaatgatgtaattccaaaaaacatgctgttggattgtagaggaaagagtgattaattatgatctacccagggaaggctttttgcatgtggccttaggctaggtgagaacaaaatagggcaccagcaattatctagagaattgggtcactgtgggtgccaaagtggatgatgatttcaagctaaaaagactatgctctgaatagttcagaattggccgcccacactcctggaatctgttgaatttttgccaactcccttgttctctttgtgacttattgccctggcttagatgagcttcctactccaggtgggggaagatgcaggatggtgctgccatagcagggagtgctgacaacgtggaagaagccttccttgagtcaggagctctggattcaatctagactctgctcccacaactggttgactccagggaagccacctccttctctgggttcagttttctctactgtaaaatgtatacactgaagttgatggtctgtatgggccattcaaaatcccgtgtctctgtttttggaacagagaaggaatcagaggagaggactggaagaagctaaaagattcagcatgttcggatttcatgactcttgtggttttgttcctagacaggacctaccaggggagcctcctgcaaatgaggtggtcttccttttctactcatcacattctatgcctgccctctctaacctacatggtatagtaggaagacgccataccatggagtcagagaatcttgggctaaaatcctgaccatgtcccattacatagtgactttgaacaaattatgtaatctttctgtgcttgtatttctacaactgtagaataataggttgcaatatcatagactcttcatgtagagaatctaattctattactataaaatctaattctaataccattggtttggtgttagcaatgaaggtgatagcaactgaaaagtaagaagagcagtgactaaaagctcataggttttgataaatgggcactattactattataatatttattgtgttaaaatacaaattatgtacagcactcctctgaacactgacctacaatagttaccagttgcttgttggacttcttgaaccagacttgaccaggcaaagagaatttgagaacctctatttcactaaaaaggtggtatctacaatatcttgccactgtagcatctgctatgtgtaatgagatgcttgggcctgctggtggtcacctattttctaggtatacgcattggcttttgtggtgtcgccatatatatatatatatatatatataaaatatgtattatatatataatatatatacatgatatagatataattaaatgttatattcaattaaaataaatataattttaaattaaatataaggaacatgagagttagcaggaatcatgggtgaaaaaaatatgtataataacaccacaaatgcatatatataggtttttgcccatgattcctggttaactcccatagcccttattataacattggggcacttgaggcctcaggcaacagtctctctcagtgaccccctctggtccttcttcacctgcccaaggtaggatgctaatttgattatggatcagaagaccctcattccagagagggtcctgccccatagcctagtggaaagaatgctacacagagaggccaaaaaaagtctgagcagatagtccttgctggatttagatcatatgctttttgtccaatcatatttttacatggttgtcaatcatgcctgtgtaaaaaagcctccataaaaacccaagagtacagggtttggagagctttttgattgctgaatacatggatgttcctggagggtggagtgcccagggaaggcatggaagctctgcgccccttcccccttaccttgccatgtgcatctgttcatctgtatcctttgtaatagtatttataataaaccaataaacgtgtttccctgagttatgtgagctgctctagcaaattaatcaaacccaaagacagggttgtgagaaccccaacttgaagccagtagttcagaagttgtggaagttggacttgccactggtgtctggtgcgtggggttgggggcattcttggggactgagccttcaatctgtgagatctgatgcaatctccaagtagataatgtcagaattgaactaaatgacatccagctggcgtctgctacagaattaagtgcttgcttggtggttgggagaaactcctacacatttagtaacagaagtcaccttctatgtggatgattgctgtggtgtaagaccagaggaaaaacatgatttcagagtttttccctcaacagccttgagatactccattttaataagatagagagatgaaagtgtattactggtgggattatgttagaaaacacatttcttgtcccagtagcattcaagatcaagagttaaacttaatacagtctctcctctttactctcccaactgatattcagcttcctgtgtgagtgtatgtttaatgtttttgtctaaattaattgatctttgtcttatgatctctcgtcttaaaaaaactaagttcagctaaatgaacattgctgagaacttatgttctagacactgctgacgttgtgctgaggggaaatgaatatagaggtaaataaaataatttgaactattctctgtctagtgggaaagagagatcgaggtataaataggggaaaaaataaaacacaacgtaagggtcataatttttaagttggattaaaaatatgtgtgtgtttctttattaaacacctcttataggccagactatcgggccagggatataacattatataaaactcagtccaaattgcataggtgtctacaagatgtaataactacaagatggcataagaagaggtattggatgggaatagtgtcgactagaaagtaagctacttgagcgtaggggccttaactatcttgttccttaatgcatttttagcattagaacagtgcttggctcgtatcaggtactcattaaacatttctgtagtaagtgatgaggctatcataaagttttgtttccccacccctaaaccagattgtaggttcagtctgaaaggactccaggaccctctctgctggtaagacatggtgccactttgtactctcccagccaatctgattggcctcttgactttggcaaaactgagctgggggctggcccccagtgccaagcacagaggaagcagggtcacatgccacccatgcccaaagctctttctgacatttccatgggcctggaaccaactctcctcctgggtttcatctcattatatgtgggaagacaaaagaacactgaaccttccagttaattcaacaccccgcccccacttaccccttcctggagaggataacagttctgttgaccattataatgcattttctgtctcccagcagtccacatagtcattaatttctgctgctgacatcaggaaagaggattatgtgtgtgtctgaaactgttcccaaagtgctcattagtcatagataattgaaaaactggtaggggaagatttggtgtaataggagcccccgcctgtgaagagggactgcaaccaccagataattgtagattccagcttttgaccactcagactgaatctgcccatccaaatgggaattcagcagacttgagcctaagagctctcagagtgatagtgtttttacatacccaggtgagggtgtgtacaccgagacagagacagccaaatcaagagaataggtgaactgcccttgggtctctttcctgccttcagactgtggagcagtgtttggaaaaagtgtccagtattctcctttattttgtttttatttcaacgtaagattgttttgatcacaaaagacatacaaggtcatgggatataagaaacacaaacattagagaagagtaccctacactggatcccaacccatgctgtgacaaaattctagggtttttctggaagtttatgtgcttacatttttatatccttttctttaaaaaaaaaaatcacatgatcatactaagaatactattctgcatcttgccattttttctgaatttatcttggagttccaaatctataccttaattcaagttcattcattttaatggcaaggtgggattctgaccagatttaagggggaaaaacatcttttaaaatattatacaagaggctgggcatggtggcttatgcctgtaatcccagcattttgggaggccaaggtgggtggatcacttgaggtcaggagttcgagaccagtctggccaacatggcgaaaccctgtctctcctaaaaatacaaaaattagccagccgtgctggcgtgtgcccgtagtcccagcaacttgagaagccgaggcatgagaatcgcttgaacctgggaggcagaggttgtagtgagctgagattgtgccactgcactccatcctgggcaacagagcgagactctgtctcaaaaaaaaaattacacaagaaatgtagaccaattagaaattagagaaaaaagaaaaaaaggaaagaaaaaagaaatcactcataattcctccacccagagaaaacctattttctgtatttttttcccctaggaatgtatttttacaaatagttcatctactttcattgttgttgttcttacagctgttaaaagaaaacctttaggcaaattaaatttaacagtttaactgtgcaaagaatgattcatgaattgggcaggtccccaaccagaataggttcagagagacttttgctcagccacatggttgaagagaaattacggacagaaaaagggaagtgaggtacagaaaaatggaagtaaagtacagaaacagctggattgggtacagctctgcatcggccttatttgaacagagtttgaacagttggccgcctgtgggtggttgaagtatgtcttctgtgattggctgagactcagcttctagttacaagagtaggttacagtgtgtttacaaatccagttaagttacagtcactgtgtatgaagaaacctttaggctgaagttacaaacggacacctttaagttaaacttaatttaacaaaaggaagtcatatactgcatgttttgcagcctctatttttcacttggtttgactgttttaaatataaaaattattccccaagcttttctttacactgtgtgtttatcttcttttttatttatttatttttttgagacggagtctcattcttgttgcccaggatggagtgcagtggcgcaatctcggcttactgcaacctctgccttcctgggttcaagcgattctcctgcttcagcctcccaagcagctgggattacaggcaactgcaaccatgcttggctaatttttttttttttttttttttttgtatttttagtagagacggggtttcatcatgttggccaggctggtctcaaactcctgactttgtgatctgcctgcctcggcctcccaaagtgctggggattacaggcatgagcaaccacgcccggccacatttatcttcttaaaaacccaacctgagcacttacagtcgtgcccctctgggcaattcctttttgcctggccacgcctgaagccctccgctgcctcttgtcccgtctgttccagttctctgttcctccttgttcccctttttgcgacatactaaatgcctcaaacacaccatgcccctcagggctccctacaggaaactcactttttgctctgctgtcatccctttccccggagcatgccagcactgaaaccaccaatctccaacttgcctttccacacaggcttgaaagtcatcttcaccttgaagactgtattcactctactagccaccctaactggaccctccacagttctctgggaacaccatgtacacatttcacctttctagcattttctacatggccctaagagtcttagtttttcatcatctttgtcccaaaccacaatatgagacctcagcacctagatcttagcacatggtagatggaaatctatgcaggcaatcattagttctattgtttctgaaatgtttgttaaaatgcatgaatgaatgcttgaatgaagcctagaaagaactgcaaatgctcaggcagtgaagtcttgatttctgggaaaagcaatgctgtgaataatttaattttatggtgaaagaaaagccaaacaaggattatattgggaaaagttgtcaggaggcactaatgtttgcctctgacagctctagtgccctcagtgtacctctggctgataaacttagagtgtgattttgaaggggtgatttctcagggattctcacctatttctatcatcctctctcatgccaagctgtttcattttggtctctaaataaacaaagctccttcctgcttggagtccagatagcctattcctgaaggctgtggttccaaatgaaagatgggatatttgtccttgtatatatttattttcatccctaaccactggattgaggagaaggctggttcactgctgtaggttgggttttccagaagcaaaggctgagacagatttggggggataaggtgtttattagggatggttggctgtgaaagaaggaagagagagaaggactgggtagagggaaaagagctgaactgaggtgcattcctgcagcaccttggtgaactcagcagagtctctggagtgagtggtgtctatcagagcccttctgcctctgctttgcaaagtcaccaggtactggctgtcctgggaggtgcatcaccttgggaaggcagctctctgcaactgaggcaggccctggaacatctggcagctgtctgctgactttactccatccttaagggggagtttgagccatggtatctcagtctctaccatgcttcctatatccacgcaaccactgtgacctgttatttcttgttccatggaatcccttctgtctgcctctgtttctacatctccgttaccaatatctcagtgaagatccttatattctctctctttctttgattactgaaatagattcacactattttccctaaccccagtctatcctctgctataatactgccagagagtgcttaaaaaagcacaagtttaatcgctttcctcctggcttaatgctcctttagtggtttacagtgggcttcatgattaagttcaaacacttaagtatggattacaaggccctgcatccactgccccatctgcctccccagcttcctctgtccttcaacacccaccccctaccagttcacaccccagcctatgttccaatttacctagcccttttgatagttcccttaggggccccttctcccttttttctgtccttgctcaagacgcatcctctgctgatgaagctccctgtggtcctatagcctataattagacccagatctcctgtctgcatgcccaggactctctctgcctcgcagtggtctgcagcctcatgttctgagcctagaggacatagaatcaaattaagctcctttaccagctaaggtttcttcctaaattactatagagaaaacttggaagagtgccccaccctgctaatcctgtctagaaccttttttataaaaattacaccttttatgtttgtggagattgggggtgaaggtggaacagaatttccattttgaccttcctatgaaaaccatttttaaaaaatctcaatttagtaggcaagatttctaaacggtgctcctttttctttttcttttttctttttttttttttttaacatacataatgcttgttctaaaaatacttctcttgatcctttcatccattcagaacccatttttaaacaacttttactccaaaaggtaatgtaatgaataagagcagaggtgtggatatcagtcagagtagaacccatggcctgtcttcagctcttaggctgtctctagggtgtttatttttcttctgtaaaccacaattttcccatctgtctgtaaaatgggggtagtatgggtcctattgtacccttcacagagggttaatatgaaaatgaaatgagaaaatgcatgctatgtccttagtgcagtccctagcatgaaagtgctcagcaaactggagtgcagtctctcctgtgttagatactagccatagtgacataattaagatattgtccagaaccgtattatacaaagccaaggacactgctctcttccaggtttctgctactttggcatttgaaacagaataagattttcctgttctctgccccatcctttgagcatcttatacttatcctccagaccatcagtgtccaatagaaatataatatgagccacatatgtaatcttaaattttttagtagccatgctgaagaaagtgatactaatttttaatgtatcttatttaacttagtatattcaaattattattttaacatggaattgatataaaaattattgaggtattttacattcatttttccagatgaaatctttgatatctggtgtgtattttccgcttaacacctctcaattcagacgctagatttttgttggaaatacttgatttagatttcttaaattaatctagaaaaagtagattcgcatacccaagttgttccgaacatacttaaaagtttttcagtaactgaatttaatatcagtttttaagttgaagttaaaactaaataaaactaaataaaatgaagaatttagtccctgagttactctagccatacttcaagtgctcagcccacatgtgactagtggctgccatattggacagcagagttcttctagaagtcactgcagaggtttcagtcttactcttcttagctaaacttgttttcatattcaattgtagatagaagctcttaaaatggataaaaatggtgtcgtcaaagtgctttggttccatttagaggaggttggttaagctgttcactctctgacccctctcccaacctccaccctcacctctacccccagaggtcctggagcacctctgcccagtccttgagctccatggaacaattaacaagtggcatcttagcactcaaaaattgctgattatgcacccagattctatcttggggctcaaaggggtcttaatatatctatgagtcaactcctagcccctccctgcagtgcagaaatactatagaatccttgggggatgagagagggctcgggctctgtttaacacctaggagcagatggatcatttcattctattctgtcttacgtggttctctgggttcttatcttgtcttcctaactaggttgggggcaaggactgcttttcacagccccacagcacccacacaaagcaagacaatcaattcttaactgaaggcctgactgcaagaattcaaggtcacttgaaaaatcagggtcactgcattgcacaactccaaagaacatcattcaaattgtattatatgattgtgcaagtggcagccttgtaaaatttgcaaaggtttagactggaatattttttccagctgagaaaaactttttaactaattatttgttggtacaaagtacacctttttcctcttatcctctgccaggaagcaactgaaagagtaagttttcttgacttaggaatatacgttcattagagagggtgtatggatgtgtgaacatgtgggtttacgtgcgtttaagtaggttagtagatctgctgtgttaggaagcccatttggaatggtttgagcatttaaaccttgtatttaagaggctactgtgtttatattccttttgaaatttcccattttcagaatctttatctggtttgaatgatgctttagagttccttgtttgtaaagctccacaaagcatgacccataggtaccaagcacgtacactaaagtcactggatgagcaaagggactcttgatgactgcatggtttttatctttgcaaatgcagaggagggaggagagagcaaagagtttctcttaaaaaaaaccctctgtttacttttgtgtttttcaaactgatggtgtttgttttttctcatgtctacccaggaaaccaagtgctacctcctggagcttctcttggaaatgggctcacaccagaggcagcaagagaccttggccttctccctgggattgcggtcgcagcttcactcattgatgcccatgcaggaggactaggtaatctcttatttgttgcctacagccaaaaccgtattcaaatggaatattccctagaaccgaagacactccttttctgtttttaaagcaaaggtcaaggactttggtgtttcaggatataataatgaaaagcctttttacagctaggcatttggatagaattacagaacttttcattaatgataaaatttatttataattgtattaatttctttatacatggcaatagaaaaaaatgtatttgaataactttctgcatagttcttttgtttactgaaaattcaaaaaagatatgttaatttcttgccacacttagctctactgtttttttgtaaggtactccaaaacccttataagtctcttagatttattttaataatatatttggcttatgtcctgtatccagttccttggctgcagtcttgattttatcttgtacataactctcaagtctttcattcatgtattcatttgttcattcataaaacacccgttgaacacttaccatgtccaggcatggtgctagaagacagtgaacttaaaacaaaaccaaataaaaccaaagtctcttccccagcttttaatgggaaaacacacagggaaacaaagaattacagtaaagaatgatgacttcctcatccttattgcaggttgtgtgtgttttttgcaggggaagttgttctggttctcagcatctctcatctcaactgtagccatatatttttttcctagcctttcattctaacaatgttttgttttaaactatgatttataattcatgagatcaatttagcaggacatgaccactgaatttgcacaacagaatggaacagaattgaatagaacaaagtggaaaacatcagagtacatttcacaaagtaagggaaggcactgctttgtggagctgtgtttccattctgtgtgtgtatactttcagacacttccatactctgcccatgcatttacacctctgtgacttggcacacatgttctttgtccagaatgattggtcctccacttctccagctggctaactcctcctctaactgcaagacccatatcagatgctttctgctctgcatagccttccatgaaacactcaggtgtatttagaaattctctaaattatgctttttttcagcacactatttgaagaaatgatcatattgcattgtaatttcaaatatatctgcatgtcatttccattagagtgtgaactccttgagaacaggaacattatgttatctgtcctgtatccttcatgccaagccctatgtctggttcctatagctgcttattaagtttattaaatgaatagtcacattaaggcaagaataaggtgaaatggctttaaacagtagagtgaagattaatctgttttcttatgcaacggattattaaatggtgccttgttctacatactacatggatttccagagcaggatcgctctcatcaatctatggacatgtctgtcctgttcatctctctgtcctcaggatctaaaacagtgcctaagaattagtaaacaactcataatatatgtaggttggttgaatgctatgtaacgtagttctgattacaggcaaggttgtttctctccaaatacttttcagtgtgagcaatgtgtgcttttgattggaatgttaagattttggtttttacatacaagcacagagagaacttgaggtctaggcagacatggagtgtttctgtcccctagcaatcctgacattccagatcatgtgtgaggccacaaaagctttctctgtcatgctttttaaattatccctggggtgacagtgtcaatcatccacccctacctgggtgacaatcacttggctgggaccggcatatgctgaaagaaagagaactgctgcttgaagagccgcaggcactacagtttccttgtcagtttcccagacttccctcagggacgtgccaaaacacaccttctcacttctgcccaggactcactatgtcctccaggaggggagactgtcaatgaccctcacctttttcctaaacagagatgttcagtggcagaagttttacccttagaagctttggcttaagccttttgttccccgtaaaatgcaaatgcttgtaagtgatatggtttggctgtgtccccattcaaatctccacagagttgtatctcccagaattcccacatgttgtgggagggacccagggggaggtaattgaatcatggaggccggtctttcccatgctattctcgtgatagtgaataagtctcacgagatccgataggtttatcaggggtttccgcttttgcttcttccttattctttcttgctgccaccatgtaagaagtgccttttgctcttcgccatgattatgagacctccccagccatgtggaactgtaagtcaaattaaacctccttttcttccttgtctcgggtatgtctttatcagcagcataaaaacagactaatacagtaaattggtaccagtagagtggggcattgctgaaaagatacttgaaaatgtggacacaactttggtactgggtaacaagctcatagagggaagagacttgccttgtctctgatgagactttggactgtggacttctgggttaattctgaaatgagttaagactttggaggactgttgggaaagcagctgggagggaggctgtaccctgcaaagccacagaggcagcgctgcccaagaccatgggaacccacctcttgcatcagtgtgacttggatatgagacctggagtcaaaggaggtcattttggagctttaaaatttgattgccttgctggattttggacttgcctgggccctgaaactcctttgttttggccaatttctcctggaatggctgtatgtacctaatacctgtacccgcattgtatctaggaagtaactgacttgttttttattttacaggctcatgggtggaagggacttgacttgtctcagatgagactttggactgtggacttttggattaattctgaaatgagtaaagactttgggggacttttgggagggcatgattggttttgaaatgtgaggacctgagattgggaggggccaggggcggaatgataatgatttggctgtgtctctattcaaatctcaactaacttatatctcccagaattcccacatgttgtgggagggacttagggggagggaattgaatcataagggccagtctttcccatgctgttctcgtgatagtaagtctcacaagatctgatgggtttatcaggcttttctgcgtttgcttcttcctcattctttcttgctgccaccatgtaagaagtgccttttgccctccaccatgattatgagacctcccagccgtgtggaactgtaagtcaaattaaacatcctattcttcccagtctcaggtttgtctttatcagcagcataaaaatggactaatgcagtaagttagtaactttcccccatatttttgttagtggaaagatagaatagtttttttttgttttaatggaaagatagaataagaatcttggattctttaaggcctgaacttagatgccagcagtggctgggaagggcacaggaaggtgatagtccatgatgacgggttgatacagacttacttaatatatgttgactatgttttatccttattatgccttcttatgccttcttatgcctctttctttacccttcaccttacagccaatccaagagttggatatctcaaaaaaattaggaggcctgggtgcaaatgtttcctttcatttctacctttcctatacccctattaggatgtggaggtgaacagatgcctgaaaatcttgaaaaggttgtccatgggtccaactctatattaactaaatataattgagtgaatgcaacctgtcagtgattggtctaggcactggagattattagcagtgaacaagtcaggcaaagtccattcgttttggaaagaaaattctcattgttctcccctgcctgcatgtttgtagcttaatagtataggtttgggacagctaatccctgagacatattgtgatgctatgacaagggcactcaaaatggaattttaagttctggatttagattgtgtttctgcctacaaatatggtgcttcgcagaacttttgtctcctgttatgcagtgagagagtgagagacaacagaatgcaggattcactactttgtgattctgtataggttgaggtcagtaatagcctcaagaactggctaaatgaaccctgtgttaagagatttctgaatgtcaagtacagacacagctttggatttggaattgccacccaggaagaggccatccaggcctctcaccaacaaaccctgacaactgtagtcacttcaaatgctgacctggcatggcctgcttgaaaccccacattctgactagtatgaggggtcagcactctgctttagagaaatacccctggactttcattcccaagggaggcctgggatgggaggataaagatcaaagaagcaagcaaaactcaacccatgcttttcccagttctggaaaaagaggaggaagggctttgtgggaataaaaatcaatgataaaagaacattttgttcttaaggtgctggttagtaagttctccagcagacagtcagaagataggagtagctttgtttgcactttgtgggggtggttctggccagggctcctgctgctgatatttttctagcttataaaaataacattaacttttttccaggtcttttcttggctccagcaccccaactgccctgaaaggcaataacaacctgatttctgtctcaggcccttctcttctcagttgctctttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactatgcccggctaattttttgtatttttagtagagacggggtttcaccgttttagccgggatggtctcgatctcctgacctcgtgatccgcccgcctcggcctcccaatcagttgctcttatctggcagacagactcctgattatccatcaaatcttgaatcctgttctcctctgggaagccctccctgacttcccaagttgacttaagcactctctttttcccccactgtgtcttgcgcttgcaggtttgtgtgtgccacattgcctcatctactaatttataaactctttgggcaacctgttgtttcatactcccactgcagcagcctgcagagtgctttacatatggaggacccttaacacatgcgtatttagtgaatgagtgaatgaatgaatggcattccctccatgaggaacggatattacaactgagagagagagtaacctctcattcaaaggcaattgtccctatacaatagttatacttggcttatttctgcaggagcaaaagtttgggttcttctagatgtttggaaatctgtctcctttttgccctcatcacattaccaagtttcggccaagagcaagctttgttccttggtttagcacaactatttgattaccaatattggattatttggcagatgttgaactggcttaaattgctcatctgggccagatattgaattggtttaaactgctcatttcaattgcagagccaggccaaaatgaggattttgaatttcttttctttttaaatggaagaatttattgagccagtcttgcaaaaagggcctttggttcatgccctagaacaacacatagtttgttccagtaaacaataaaacatgccaataacatttctcaccattatcagtgttctagaagacaggataaaggctgcgatctaaagcctgcgactttagataatgtgatttggggggaacatttatttataagtagtatatatactaaatgtagcatgatggataaagaaatatacttattggcaatagtccattgcgtttgtaaacttttgatttatgaagcatgatatggtttggatctgtgtcctcacccaaatctcatgcaaattgtaatccccagtgttggaggggtccctagtgggaggggattgtatcatggtggtggatttctcatgaatggtttcgcatcatccccttggtgctgttctcatgatagtgcatgagttcccttcagatctggttgtttaatagtgtgttgcaccaccccactctctctcttgcttctgctccggccatgtgaagtgcctgcttccccatcaccttttgccatgatcgtaagtttcctgaggcctccccagaagccgagcagacaccatcatgcttcctacacagcctgcagaaccttgagccaattaaaactctgtcttctataaactgttcagtttcaggtattcctttatagcaatgcgagaatggactaatacaaaacacatctatgttcattatagaatttgctccttatagcaactttgtagtgaagttaggacaggtatgtgttccctcattttgcacagcaaacagctgaggctcagtgtattataaactcaagaatagatatttatcttacacttagttcttaaggcaactttatacatactattattctatttgtcagatgagacagttgaggctcacaagactacctaacattctgagctacacagttaaatgagagatgcgtgacttaagcccatgctttgtgcacacttatcactgtgttataaagaatggcctacctatttaaacatgatccactctgctctttaatttgaccctaaaaatgtgagcaagtaacaaattttgaaaaaggaaagtctttaatatttattgacgacccactttactagttcatggggttagacagtgactatgagagagaagtggacttctgggaatttgtattctagtaaagaaaatagacaagtaaataaacagttacggttacttgtgccgtgtatggaaggctttggaaaaacataaaatgggcctaaaattgagacttaaacaattattaaaggattcctagagggagtgatgtccagtaatctaattacgacactgctttccctgttattgcttcctggtaaagtggaatttatatattttttgcgacttttaaacttcaactaggcttcatttctaataataaaataataacattgttaattagaacaaatacaaccaccactctgactggtactactatgatgaccatttcttacatgtgtcctatgtgccaagtactctacctgatactgctcagactttatatcttgctcctcacgataagcctacaaggtagaggttgtttccccattctgcatgagggaattgaaggcagaaagaataatgtttccacaatcacataactaatctcatagcaagatttgaaattgagtctgcctccaaggttcatatatcttttctctaggccagtggttctcaaccaggggtgatttgacccctcaggggacatttggcaatgtctggggacagttttgtttattgcttctggggaaagggaaatggcactggcctgtggtgggtagaggccagggatgctgccaaacaccttacaatgcccaggccaaccccctgcaacaaagaattatccagcttcaaatgtcaaatgtcagtagcactgaaggtgagaaaccctattctctcctggaacacctccagtgatattatttctcttcatcaattcagcttatttctatagaagccaaaaagcagcccacaataagggttttgctgatacattagtactttgttgaaatgtgttttgtgaaattgactcttcagtaaaagtagttgtgagattaagaaaataatagaagtgaagcctgaggagtagggaggacaggatggtttctagctcatctatttcagagtcaagccacacgggacaacttggccgtctttcagcacatcatgcacattccacctcctttcctttgttactcatccatcagcactcagtctaaatgttactttgtggaaacatctccaaatttaatccattcttagaaaagcaccaatcactctctatgctgtatctgtgaaatactttacaactatttcagttttttcaccaaatcatgttcacgtttgtatgcccatcatccagcatgaaatccacatagctggtcttcactaaatcaatgtaattatttaattactattattagtaattaagataataaatataagagggttttgaaaaatccagaataagaattggtaaatataggtgagggagactttaagaaaatatagattcccatgccctaccctgctgaggatgcctggaatcttgttctaagtgtggaaaatgtcacctggtacccagaggagacagcctggggggatgagttggcactgaggacactggggtcagaagcagtattgatgtgtttctgccaagtaggcagatcagaccagagcagaaccgtgctgcgcaggagccaggccaggcgctggccaaaagctgggggcaggagggagcttgtccaaaatgagagagaatatggatccaaagaggcagacggtctgcaagaaattgggggtggggggggattagaaatgcagataaagtcatgccgtggaatctggaaggagaaaaccgtgccagtccctgagcagatagagcaaggacaactctgggagttcctggatgtgaatcacagagggcagaggaagaacgtattcatgggattgcaagtttattgttttaagttgaggttcggtttaatgcgacccactactgcctgagacctcggcagttcatgagccgtggcaacagctcatgtgatggagggaggggcagagagcatacgtggggggaaggataactgagtttcctgttcccaggctccaaggctttcttggagtgctgtgattctctggactgcagaaggctggccttagctgagagaccagactttgactctgtggaagaaaaccgagagaatccagggcctggtgctattgccagctccccatgtgtccccagtttttaaatcttgtgccacacgtcagtgtatatggctgtgaacctgccatgaaaccataatattttgagtttaatacatacactcctgtttggataatgagtaatcataggctttagaactaaaaggctgctcaaagattctgtataccaaattcttcaatttgcagatgagaaaactgaggcccagacaatggtgaatcatccaaagttaccccagcatattactttcagagtcaaatttagaatctgagtgacctagttcatcagccagggtccccgccccattgtactacactgtctccagattaggaaaagggaatgactcctgatttgttattccattttataccttatatcccatttaatggccacaggcagcttcactggtggttattaaataggtaatttagttttcctgagccacacttgagtaaatctctttgttttgttgtcacaatctacaaaaagctccaaagaatctcctccagagctggaaataataaaaacacctgctattcgagttccttccaaagagctcaaagcagttatttttatttcacctaccaatcgttgaatacctatgctgtgccaagtgttttgctaggtacttgactattcactattgtgagctcacaaccacactgtgagctacaattatttttggactttaacatacaaggatgaaggtttaagaacctgccaaaggttacattttaataaattataaagttgggttcctggacccaccgattgcagagcctatgagctctcccgtgttgacctggctagtgaatctatttgtgtgtaggtatgtttgtgcctttacttacgttagcccatacttacaccaatgcatatttgtatctatagtggaagatagagcttctgcttaatatccttctggacgtttgtagatctattttatggatgagaaagttgaggcccagggtggagaagtgactctaataaagtgtatttaaagcagcacaggagtctgggttccatcaatcatggggaataaggccaggcttattagatcagggtaggaatgggatgcgtagctattggggttgtgtggtggagagataaacaatattaatgttgacgttaattttgtttactaaatttgttaattaatgcttacaatctcaatctcaaagattaatcttaatctttttgtagtgacttgctgtttttaaactacccttggaatagggaaggtatttttacctcccacgaatggttgggaaaactgaccttcgaggaggtgaagggatttgcctaaggttacaggaccaggaagactggatccaagactcaaacccttatttgtgtgcctctgtcttcacatcagctttagtgcaacccttgcatcaaacaatggaaaagtagtacctagtaaatggagcaaggtgtcttattctgtgcccagagcctctcattttaaacaagctctgatcatctcatctactacagaactgtatctggtattctggggccatttttaaacagaaggtttcacttattctctcctgtattagtatatggccgagaaaattagctgagctgttattttcctttgctgaactggggaacaaaaacaaaaaaacacacagtaatccagccactggttctgacactgccaagcacctgttaggaggacttcctactccaagttcaaaaggtacggactgctagaaaagtgtgtgtttgggggcccagagtctaagattgcacttgcgtcactggctgcaagagtaggatcaggtccactgtttttcatggcacaaaaactcaacagatagtgcttcacatccatatactgtttctaagcactaatgtttactttgggtcttgcacatcagcagctgatggtgggaaaatacacatctctagttattgccccaaggcggcagcctcacatctaaactgctggcttcttccttattatctctccacaggcctggttcatttccttgttttcagttttctcttagctgtgcattcatatcagtcattgtaaagagcaaagagaaataattttaaaaattttccatatgggcatcttgagcattgcctcagtacactctgtagctagtatagatatctggggaaactaagaaggaaaatttctttgaatatagaaaaatcatactagtctccagttatatcattcaacagcagtccccccagcccacctttccatacctctaatctgtatctgtgctttgtactatgactctgatgtaagagtttggctctctgaagatggtaaaaatttaaatgcttgaggtaaacacagtaagatagttaaaaacacactactggttccatcagctgtctctttgcccttggaagtcatctgacactgatggcagcagtgacccatctggagcagccactgcgaagatgctggctgcagtagaggaatgcactctgcagagctggctggggccagaacaggtgggagccctgtcccctaccaagttggcagggtgggagccccatgctcccaggcacatctgcagccgcccagctgcggctctggacctgggcatccctacgctctcaggggcccaggaagccccccttcctttgcagacttggaaatgcttgctcctactccctggcctcttcccattgctggtgcctgctctggagtggggcagagttgtggctgagcccagtgctgtcacaatccagccaggtgtacatgcacttgaggtggtgctgacacgctagcctcctgccaccttggccctctctggaccttgggcgccaacgagcatggcaggagctgagggcagctcggctcaggcctgcaggtgcctcagtaggaacagactgggtggcgggttgatggcaggaggaagcagacaggctcctgggcagaaaggagcgggtccctggcgaaaccccaccttcaagccagggacagtccgaagcctggtggctggactgccagttccaagtggagtctgtggcccagagtgagaacttgtgttgctttttctgggtccacccatggctacccatggaccaatcagtactcatttcctcccttctgagcccgtaaaaatccctggacccagtcagacacggacagactcaggactaccagctgcaggaaggagctacccactttgggtttctccacccattgggatgacctgcctgcagaaaggagctacccacttcgggtctcctctccactgagagctggacactcatctagacgacctgcctgcagaaaagagctacccactttgggtcttctgagagctattctgtcactcaatgaagcttctctccaccttgctcaccctgcagttgtctgtgtatctcattcttccaggttgtaggataagaactcaggacccactgaatggcaggactgaaagagctgtaatacaaacaaggctggaaacacatccctccggctcactcgctactttgtgggcaatgaggagagaagagctgtggcccttcatggagcccagacctaggggctccccaagccaggggtgtgacactgtctttaaggctttgaggttcatggcatctccaagcctccaggtgcccgtgttcccctcatccagatgcgggtgcccatagcagaagccccatgcagcacatcagatccagctgcagccttgcgtggagctggcacctgtgccagcacctgtagctgcctcccctgccacagcagcttgcttgtctggttgtgtgcagtggccggactctgcacttgctcacccacacacccctcactgctccacgcctgggtcacccttggtaggtgtgggatccaggatggtggcgtgagctgagcccagcctgctgggccaagtgggtggaatgagcccagcaggcacgagcaatactcaggcagaagatgccaccagccacagaggtttccggctggcaaagtgacaccccgaggatcccatgacagtacttcatgcctcagttcccccatctgagaaatgggaataatagtacctcttgcatagatttgagtaataaatgagcttttatttgtaaagcacttagaataatgtctggccatactctgtgtgtgtttagctatgattaatgtgattgcagtaaagttacattatgaatagtagcagtgagcaagagaaaatcaaagatttattacttgatttacaggtagatgacgtcttccttctgtgtgtcaggcattgttataggtatgttagatacagtggtaaacaaagccaagctccttctcttatagagcttctatcctactggggacgttcataaactcccatttaaacatatgtatttataggtatatgtaagtatacatatatgtattgtatgtgtgcataactgtgtgtctctgtatatgtgcatatttataagtgtcttcatacacatgtgtttatgcatggatctggtatttatacatgtatgtgtattacatgtgtatatctgtatgtagttgtgcatgcatatgcatccatgcctgtgtctgaatgcgtgtgtgtatgtgtatatactgtgcatgcacatgtttgcatgcccctatttgtatgtctgtttatgtgtacatttatgtgtgtgtctgatttgtgatgtgtttatgtgtatgtgtgtatattctaatgttcatgagtgtatatgcatgtgtccgtatatatgtatgtgtatatgtgagtggatatgcatgcatgtgtttgcatagggtactgctgagtgttatgaagaatagtcctgattaaagtgatggaaagttccaggaggtgctactggtatacagaggtcaggaaagttcagtctagaatggggacatttgaggaaacataccttaatgaagagaggaaatatttcattgtgtaaaaagcaaggcagagattttttcaatcagcaaatatatgttgagcacatactttgcctcaagcatgtgctgggcactgggaataccaggatgaagatgacccagtcccttctctagatgactcagcagctggtggaaatgggagatctgtattcagaaaaatcctaatacaacttgcatactgcttttccaggcggtgtaaaaatgttacaagagtatagggaatggatcagccagctcttccaggacaagttaggaggtgaaaactcctagaaagtgaaaacttggataagccttttaagaagcagtagtagaatgtgcagaggctcagggacgttaaaatgcccttcataatcaaggaacattttggtgtggccacctcgccattcaaatgtgcgagaggggcagcgagaggcagccgggaagacggagcctgtgtagcacactctgactggaatcagactgcctgggttcaaacccctgttttgccacttgttagtaaagagcttacctgctctgtgcctcagatttcccttctgcaaatggggatgggaatagtgcctcacagggttattttagagatgccttctcctgacacattgtaagcactcaacaagtgttagctactcccagttggaagctagaatgtaaaaggccttaaattcccagccaaagagattgaatgctaaaattaatttcaagcaaacctatctgttcaaatagctttctcagcactgattttgatgtgaaaaatatctggaatattcttcgttatcaagcatgtgccttggtagtgtaattacagtttttaatactaatggatgatcttccattaaagtagtaaaaagataccatctcattttaagcttagagcaaaagcttacttaagtgaaattaagcagatatttattttgtcaggctctggggaggattccgaaattatttgctccctactagtgcctagcactttatctttgcaaccgcacttaccctgtagagtcatagttgcacaggaaactgtattcctgcatctctaccttcagtgtttcacgatcactgtttctcatctgccaggcctgagggtgggcagtgctgatttcactgtctcatacccactcttctttctgccagtgtcttttgtgagagcaattttatctctgcccctttctcttcaccccattgtctcttctccagtcttcaaacccaaacaaaaaacatacaaagtttgctcatattcactgcagtctgagctgctgaatgttcttccagagccccttaggatttctgcacccatacttgtaaatgtttgcatcttcattttgttggtggtgatgacaaattaccccacataacttgcctctgttcctgttttagttagaaattactgtttactggagacagaatggaaaatgtatgaaggggcaacatgagaaaataggttattttgattacttccaatcatccatcgttaatcgaattcataatatagataaccaaataaaaagattatttcaatttaaacttagaatgacttataggtttttttaatctgatttccattcttattacttcttgcagcagttttcaaacttgagtctgcataggcattcatggagctagttaaaatgcggatggctgggtccccaccaccacaactcattctgatcagtggctttaactggggcctaaatatctgcactgtatccagcccacacatgagcctgatgaacttcaccagtggtaccttaaaagatagcaagaggggcagactaattagactcaacgttgtttaccatcaaaaactgtctgtacataatccagaaagagcaaagttgaatccaggctaattgaaagactgcattttaaattttttgtttcaaaagtagagcaataaagagtttttccaatgtgttatacttcccatgagctggatactacctgtttacctagatgccacttaatgtggacagcaacttttatggctgtgcacattctcaccacccccatttaaagagaggaaggagactcgcttagactcaggcagctagtgtggttgaacagagagaaccttggtctgtctggccccagcttgctctcttttaccattatatagcttcacccaagccagcgttaacagctgtagatgattttcttctaatgttctaaaacctgaagacatggggcatcttttaaccaaatgctcagctctagggaaagctaagcctcttctattttgttgaaagataaagtgttaggctgtcgatctgtattgttacaggtccctgggctggatttagcctcaggagttaaaagtatatcagccttgtgactcaccaccatgaaaccctcagatgggagtctcctaccagtatcaataatatgaatgaaaactttatatgccttctggattgaggcctctcacagctcaaagttgtaaagaaaaacccacgcaattggattttgtgaaatatattaaatatgcccagtaatgtggctcttcaaaggaatttatatactgtctgctttactgtggtgtatcattatagctcagccaaatgcgtggcctaataatttgtttcccttatgcatatccatcattaaatgtaacatgcagacaataactatttaaacacctaaatagatgattatatagctgtctgtcccacttagactgtgaactttttatgaacaatggaatctagtcatcttcatctctgtgtctcttagctcagtaaatgaatgaatatatgcatgaatgaatacatgcgtgaatgaatgggtttgcttaacatgctaagcactagactagttactgtggcaaatacagtgatacaaagaaatagaggcagatggattgagttctacaggaattttaaaaagggaagaatcactttcagttgaaacagtaaggcaaagaaaagacaaaaatactaatatttattgagggaccttcctgatagaaatatgctagagagtctacatgtataatcttcacattgactccagcagcttgctcaaggtcacacagctggcagtgagaaccccctgaggttagctaccatggtccttctgggaagtgggaagggatagcctttgaatgaatctgggagaataggtgtattctccactggaagcaatgaaacgtagagtattctggatggagagaataacataaatggaggcactgagatgaggtcgtggaatggtaagcatttcagtttggctgaaatctatgatatctctaagggattcctggaagaagaggatataatgatcaaataggtggagatagattgggagtctgtcccatctgagtaccgttttggagtttgtgcttcctctttctccctggaggcattggcaaatcattgaaggtgatctcaagccagagattcattttaagcatggctttatatacttttatacacaatagttgggggaaaaggcaaagaggtttcctgaaataggttttggcagtggggcttgaaaagaagatagggagtttgacaactttttaaaacaaatccatgcattaggcacaagttatttaaaatttttgatgttctttatattcttctagctctttctatttacatagctattactaaattaaatgtataaaagtatttttcctttttaatttgaaatagatttcatctcatatttggcagaagataataataacttgttaacttcaaggcagtcagggtaattcatccagtctcaaactgggcattcatttaaatctattgtcttagatggagatatctagtatactcactcatttaaagtagagccgtaaatcctgaagttaaataagcaaaacaaaaggcctcccaaagctgagaaaacacttgccatagagtgcacatactgtaggaaagtacaaggattattctccggctgtcacccagcactgctaacttagaattatagataaaatatgctgtaattttaataattaatagctgactatgcaaaaatattattttctcctagcttcaaccaacaggtaacatatctgcctttcatgtcaggtactgtgctaggtactaaagatataaatatgaacaaattatagtctctgtcctcaaagagctcccattctgattggacaaacaggcaagtaagccatccgagtatgatgtggaaagtgtctgataaaagcatgtctgggctattacaggagtctaacctcactttacctgagcaagttagtaaaattccctccccttcccccaaaaatgattggtttgacacttaaagatgaattggagggagaaataggaatttatcagatggacaagacggctaggcaggaaggagggtgagaaggagagggaagcagagggaggtagtatgcaccaagatccagaagcatgagggtacccctttggctgcagaataccgagtatactatagtgtagagtatgctgaaatagaagtgtgagagatatatgtggggacaaagtttttgagggccttgaacatcatttaaaagagattggaatttttatccttaaggtactagcttgtaaacagaaactttagaggcagtgaggttaatggaccagaagacgggactgttgtaagagaccttgaaggccagaactgacgcagttccaaggcagtatcaatggaacaagaggggacattaaaaaattaaaaataggctgatgaacagtgatggggtcctttaatgcatgggcttaaagtgctacatatatagctctctgaagcaagagtgcactggacaatgatggcatggcactatttaacagaagtaagcagagtctatgtgtcaggaggattgagtgtaagtctcaaatctgcccttaccagttatgtaacttctacaagtcacctctttaaacctcacttttttatataggtgtgaagatcaagattcatgctttttcttctaatatatccacttttatatgccaaaattttcctactattgaagtggtattgttggaataaatgtgatcacaaatagaatgtatttaattcattaatttattcacttgccatttattgaatttttttttctggcaacaatgggctgtcctcttggtcccccaaaataaaaagctggtgaaaattaaatgtatccacatattcaactcacaaggcaccagagagctactaaaggacttgaggggccaagatcaaaagagaagcctacagagctgggttcaacatttccacccttttatacgctgagcatttactgacttgctgagatttggactcaacatttccaccattttataatacactatgagcatttgctgagttgaaacctgcaactcagaggccaagaagctaaacaccagtttgggcagtctgcaggctggaagtatatatatttgagtttggacatcattgaagagggagaatactagtaaatcctctaggtgttatttgggaccccgaaagtcagtgtaaactaaaaatagacaaactttacaaaggccaaagcctgggtttgaattaaattaacatctgattaaattcagatcatctatccctacttgagctaactgcaagaagcaaggttatatcctttctagaggtaggtaacataatcagaagctcaagttataactaaaaggtttcatatgtaatgtctgcattgagtagaaaataagcatgtaaaatatgaataatttcaaaaatcaagagtaaaaacaaagccacagaaaagtccatatgctggtggtatttgacatgaactctaacatatctgtgattaatatggtcaacaaattataggagaagatggagaattcagcagagatctgggaagtagaaaaagaagtggggattctagaattgaaactaataactgagattaagaattgactaaatggagtaaagtcaacagcatacaatataattgaaaagagaattagagaactgaaacatagatctgaaaaatctatttatactacagccagtatacaaaaggatggaaaatacatgaaatacacaaacaagtatgagatatatggagcatggtaaagaggtctaacagaggtgtagttggagtccaagaatgagagaagagagataataaatcatacatagaagctatatttgaagagatattggccaaaagtttttcaaaacttataaaagaactcaagtgagttattttaacttttgaataatcaattaatgcaattccatattaaaaggatgcaagagaaaaattaacagttgtttacaaatgcttttgatacaacttagcacatattcatgatttttttaaaaatcatggcaaactacgagtagaaaggaacttattttgattaaggatatcaacaaagaaaaaaacataatgcaaatatcatacttaatggtgaaatattacaatgttccaattcttaccacgtttattccacagggcctatctagtgcaacaagtcaagaaaaataaatggaaaatataagaattagaaagaaagaaagctaacatcatagatgatacaattatacacatatagaatgtcaaaagaatctatagataaaatattaaaattaataagtaatttagcaaggttgctattgcagaaagtcaatacaaaactctattttatttctctaatccagaggcaaccatttagaaaataaaaattttagggaggagccaagatggccgaataggaacagctcccgtctacagctcccagcttgagcgacacagcagacggtgatttctgcatttccgtctgaggtacggggttcatctcactagggagtgccagtcagtgggcgcaggacagtgggtgccgcgcaccatgcacgagctgaagcagggcaaggcattgcctcactcgggaagtgcaaggggtcagggagttccctttcctagtcaaagaaaggggtgacagcacctggaaaatcgggtgactcccacccgaatattgcgcttttccgacgggcttaaaaaacagcacaccagattatatcccgcacctggctcggagggtcctacgcccacggagtctcactgattgctagcacagcagtctgagatcaaactgcaaggctgcagcgaggctgggggaggggcgcccgccattgcccaggcttgcttaggtaagcaaagcagccgggaagctcgaactgggtggagcccaccacagctcaaggaggcctgcctgcctctgtaggctccacctctgggggcagggaacagacaaaaagacagcagtaacctctgcagacttaaatgtccctgtctgacagctttgaagagagcagtggttctcccagcacgcagctggagacctgagaacgggcagactgcctccttaagtgggtccctgacccctgaaccccgagcagcctaactgagaggcaccccccagcaggggcagactgacacctcacacagacctgcagctgagggtcctgtctgttagaaggaaaactaacaaacagaaaggacatccacaccaaaatcccatctgtacatcaccatcatcaaagaccaaaagtagataaaaccacaaagatggggaaaaaacagagcagaaaaactggaaactctgaaacgcagagcgcctctcctcctccaaaggaacggagttcctcaccagcaacggaacaaagctggacggagaatgactttgaagagctgagagaagaaggcttcagacgatcaaattactccgagctacgggaggacattcaaaccaaaggcaaagaagttgaaaactttgaaaaacatttagaagaatgtataattagaataaccaatacagagaagtgcttaaaggagctgatggagctgaaaaccaaggctcgagaactacgtgaagaatgcagaagcctcaggagccgatgcgatcacctagaagaaagggtatcagcgatggaagatgagatgaatgaaatgaagtgagaagggaagattagagaaaaaagaataaaaagaaacgaacaaagcctccaagaaatatgggactatgtgaaaagaccaaatctacgtctgattggtgtacctgaaagtgacggggagaatggaaccaagttgaaaaacactctgcaggatattatccaggagaactcccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtagggttatcctcaaagggaagcccatcagactaacagcggatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcttgaaggaagtgctaaacatggaaaggaaaaaccagtaccagccactgcaaaatcatgccaaaatgtaaagaccatcgagactaggaagaaactgcatcaactaacgagcaaaatcaccagctaacatcataatgacaggaacaaattcacacataacaatattaactttaaatgtaaatggactaaatgctccaattaaaagacacagactggcaaattggataaagagtcaagacccatcagtgtgctgtattcaggaaacccatctcacctgcagagacacacatagactcaaaataaaaggatggaggaagatctacctagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatgtgcacccaatacaggagcacccagattcataaagcaagtcctgagtgacctacaaagagacttagactcccacacattaataatgggagactttaacacctcactgtcaacattagacagatcaacgagagagaaagtcaacaaggatacccaggaattgaactcagctctgcaccaaggagacctaatagacatctacagaactctccaccccaaatcaacagaatatacatttttttcagcaccacaccacacctattccaaaattgaccacatagttggaagcaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatcttctttgaaaccaacgagaacaaagacacaacataccagaatctctgggatgcattcaaagcagtgtgtagagggaaatttatagcactaaatgcccacaagagaaagcaggaaagatccaaaattgacaccgtaacatcacaattaaaagaactagaaaagcaagagcaaacacattcaaaagctagcagaaggcaagaaataactaaaatcacagcagaactgaaggaaatcaagacacaaaaaacccttcaaaaaattaatgaatccaggagctggttttttgaaaggatcaacaaaattgatagacctctagcaagagtaataaggaaaaaaataagaatcaaatagatgcaataaaaaatgataaaggggatatcaccaccgatcccacagaaatacaaactaccatcagagaatactacaaacacctctctgcaaataaactagaaaatctagaagaaatggataaattcctcgacacatacactttcccaagactaaaccaggaagaagttgaatctctgaatagaccaataacaggctctgaaattgtgtcaataatcaatagcttaccaaccaaaaaaagtccaggaccagatggattcacagccgaattctaccagaggtacaaggagtaagtggtaccattccttctgaaactattccaatcaatagaaaaagaaggtatcctccctaactcattttatgaggccagcatcatcctgataccaaagccaggcagagacacaaccaaaaaagagaattttagaccaatatccttgatgaacactgatgcaaaaatcctcggtaaaatactggcaaaccgaatccagcagcacatcaaaaagcttatccagcagcacatcaaaaagcttatccaccatgatcaagtgggcttcatccctgggatgcaaggctggttcaatataggtaaatcaaaaaatataatccagcatatacagaaccaaagacaaaaaccacatgattatctcaatagatgcaggcctttgacaaaattcaacaacccttcatgctaaaaactctcaataaattagatattgatgggacatatttcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggtaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttatacaccaataacagacaaacagagatccaaatcatgagtgaactcccattcacaattgcttcaaagagaataaaatagctaggaatccaacttacaagggatgtgaaggacctcttcaaggagaactacaaaccactgctcaaggaaataaaagaggacacaaacaaatggaagaacattccatgctcgtggataggaagaatcaatatcatgaaaatggccatactgcccaaggtaatttacagattcaatgccatccccatcaagctaccaatgactttcttcacagaattggaaaaaactactttaaacttcatatggaaccaaaaagagcccgcatcaccaagtcaatcctaaaccaaaagaacaaagctggaggcatcacgctacctgacttcaagctatactacaagggtacagtaaccaaaacagcatggtactggtaccaaaacagaaatatagatcaatggaacagaacagagccctcagaaataacgccgcatatctacaactatctgatctttgacaaacctgagaaaaacaagcaatggggaaaggattccctatttaataaatggtgctgggaaaactggctagccatatggagaaagctgaaactagattccttccttacaccttatacaaaaatcaattcaagatggattaaagacttaaacgttagacctaaaaccataaaaatcctagaggaaaacctaggcattaccattcagaacataggcatgggcaaggacttcatgtctaaaacaccaaaagcaatggcaacaaaagccaaaattgacaaatgggatctcattaaactaaagagcttctgcacagcaaaagaaactaccatcagactgaacaggcaacctacaaaatgggagaaaattttcacaacctgctcatctgacaaagggctaatatccagaatctacaatgaactcaaacaaatttacgagaaaaaaacaaccccatgaaaaagtgggcgagggacataaacagacacttctcaaaagaagacatttatgcagccaaaacacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttgaaccattgtggaagtcagcgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaaggatgagttcatgtcctttgttagggacatggatgaaattggaaatcatcattctcagtaaactatagcaagaacaaaaaaccaaataccgcatattctcactcataggtgggaattgaacaatgagaacacatggacacaggaaggggaacatcacactttggggactgttgtggggtggggggaggggggagggatagcattgggagatatacctaatgctagatgaggagttagtacgtgcagcgcaccaacatggcacgtatatgcatatgtaactaacctgcacattgtgcacatgtaccctaaaacttaaagtataataataataaaataaataaaaatgtttaaatagcatgatttacaataaaataaaaatattaagtacctaggaaggaagatgtgtaagacatctatgcagaaaggtataaaacattgagagtaactaaagaagtcataaataaatcgagggatatatgatgttcattgattggaaaacagtattataaatgtgacagtttcttcccggttgttctatagattcagtgtacttcagttcagcattctagcagatttgtgtgtaagaggatggaaattggtagacatcctaaaacttagatggaaaggatcaataataagacagtcttgaaaaagaacaaagttgggaaaactccataatgccagatagcagaacatattacgaagtaattaagaatggtattgagggaaggacagacaacccagaggaaaacagattaaggagcccagaaacaaactcacacatgtatggacagttaatttgtggcaaagatgccgttgccagagctgtaaggaagcaatgtatttttcagtgaaatagtaccctgccgattggttatcactatggcagaaattgaattttggcccttctccttatactatgcatacaaatacattccaaacagattaaaaacttaagtatgaaatttaaaaaaataaagttcctaaaagacaaggtcttcatgactttgagatagacaattttcctaaataggacattaatgtaagtacaaccataaagaaaaggattggtaaataagactatgttaaaataagaaacttcttttcatcaaaagcttccattaaaagagtgaaaatgcaagccacaaagtggaaggaaatagttgcaatgcatataacaaaagatgtgtatccagagtatgtaaagaatgtctacacattaatgagaaaagaacaattattttgacagaacaatggttaaatgtgtataaatgtgtgcatatatacatttgagcagctttgcagaaaagaggatatacaaatggacaataagatacgaaaaattgtccagccttgttagtcattaggaaagtccaaattaaaaccatactatgatatcactacacaccctgcaggttggctaaaatcaaacggtttgataatgccaagtattgatggggatatcaaacacctgaaatgctcaagcattgatgtggaaatatgaccacactttgggaaagagtttggcagtatcatgataggctatgattcagcagtcctattcttagacatatatccaacagaaatgtgtaccagaaaaaatacgtatatagtaatacatgtaaaaccattatttgcaataggcaaaaactgcaaacccccagttcccatcaataatagaattcatcaatgtttggtatattcgtggagtaaaggattttatggcaacaaaaatgtacaaaatattgctacatgcagcagtgtggttgaatctcacaaacatgggtgactgaagctggcacaaagaaaatacaccgaatggtttaaaaattaagcaaatcctgtggtgtagacatctggacagtggttatctctggcaaggcatggtatttggaaaaggacatgaggtttatttcttgatctggataggtgtgtttactttgtaagactccactaaattctatacttaaaatctgtagctttttaatgtaggttatacttcattgataaggtttattaaaaatatcaaaggctctgggccgccctgtgctaggcactgggaatgcagacatgagtatgaaataacctggctctgaagaacggagaggaggaggtgagtggtaattaataaacaattagagaaggagtttgttagaagtgaagtcagggtgtgtcactttatatgtcagcacacaaaggagcaactcccaactcaacacacttcctgcctgtattaggtgcttcataaatgttaaattctactcccaccttgctatactcataatcatgagtaatcaagtaagggaaaaattatgttatgaatcctcttttttagtgcacaatccatgttagtgatagtggtggcaagtaggcttttttatttgtctgtttgtttgtttgttttttgatgtctttaacagtgagccttcctcaaacaatgtattagatagaattgcaacttcctcagctgaaattatttcatcagtgattactttctccatggaatgttaatacattgagtttctcttgtatatataaccagggattctgagcctctttcatctctgccttgggccacacagccccatagaaagatgatggaagggagaagaagggaagaacacctgccagcctgccagaatttcggctatagattggcaagcagacagctgaatggagggaggatatggacaatgaaaaggaccatctaacttgagggcacagtgcccaccgacagcacagcaggtgctgccaggcctgtacagagctggaaatcctggcaagatggtagctgctccatcttgtctggcctagttactgcctctggcccatgctgaagggagtctggggagttaccattccaaagaactcacaagaaaacagaactgacttggatatattccaggtttgcctagtggtacttcaaaatggtagattgaatgttattttaaaagtcattttaaaattatttcctttgaaatacagaatttaataggagaaaaatcagaaggagaatgaaaaataatatggatatgcagaatatatccgaaagaaatgtgtacttcaatgtaccaaaaatatgtacagggatacagataacaccatttcaacagcttaatggttagaaagaagtatgatttctggagccagactacctaagtttatattccatgctgtcacctactgtctttgtgatcatgtgtcagttactgaacgtgctgagtctaaatatttcatctccaaaatgggcatcatcatagcagttgtaagaattaaataagttaatttacctaaaacactcaaaacagcacctgtcctgcgtaaatactacacaactactagctgctgctgatgataacagctaagccatttttgtggctgagagtcagcagccacagccagggtggaggagatccttgtaatcataaggtcagaggaaagagggcctcagtaaagaaggcttcttaggcccatacagcgggaattacttcttgccaaaaggcttgtttgtcctctcttgaagccatgattagtctgcctctgccatgtcgttggctcctcaggagattacaagctctctgaggacagagattacattttttttcaagtattatttccccagcagtgctgagcacagtacctgatgtaaagttgtgctctgtaaatgtttactgaattgaatccttctaaacagaggagggagatactattaatcagggctgaacgtgtgacagcactgttctttcaagccaagactatatgtatgttctttactttttttttttttttttttttttttttttttgagatggagtttcactcttgttgcccaggctggagtgcgatggcacgatcttggctcactgcaacctccgcctcccgggttcaagcatttctgtctcagcgtcccgagtacctgggattacaggcatgcaccaccacgcccggctaattttgtatttttagtagagatggggtttctccatgttggtcaggctggtctcgagctcccaatctcaggtgatctgcctgccttggcctcccaaagtgccgggattacaggcatgagccaacacacctggctttttttacttttaaatcatcatttcccttttagagatgggatgtcagaggcccaaaaaactcagttcatttgcgtgaggtcatgtaaatggtgatatctggaagtgtctccctcaaagtcagtgccctccctcacaggcactcattccctaaggcacctaggatgggcacagagaaaggagaaccaagcttggctggggctgctgtccagagaaggtgggcaggtgtcaagagcaggtgcagaggtggagaggagagctaaatcttgtcctcagtagaagcagagatgtcatttcaactgcaggttttgaaaaatgtcagtgcatacttcatgagattttctgaattcatttttactctcatcttctacactatttatctaagctgttgttctctttgaaactatgtcagccacatgtcattcattgtgccacaaccctgggctttttatcctgcttagggttttgttttgttttgcttgttttttctccccagctgctctgcctatcacttaattctctgagccctctggcctgagtcttatccggtggtgtgggtcaccttacaatcccgtttctagtctcctgggagtagtggtggcaggcgagggatagaatcaacatccaggttcagaatctatttgtcttttttggtcttattgtccgaagcttgagtcaaggataaattaatcagtctagaggtgggagagccctctaaccctccccagggaaaatcctagcctttatagaaacttggcctggttttggctctcagatttaattccaagctgtgaagaatctgtcaatgttcaactaaccctgacaaaacctttggaagtttctgttgcaaccgaaactcttatcacaggaggtggtactgagcttggcatcagaggttggagagagaagagagctagcctgctaattaatattttttttccttaaatttcaggcttttttttttagtttaaatgttctaaagaacctgtcctgtcacttcccatctgtttcctggtgttttcctcaagcatctcactggtttgttttatgtttttgaggggattatctggggtgctgattactttccctaccttcaaggagcctttgaataattttataaatgagaccatttgtctaggggcaagagaaggttgctgaaggcaacctagtcctgctttctcccaagagaaattgtacactaacatttgtttagtagtgcctatatcccaagtacaaggctcttgccttatacctaggatgagcaactattccagtttgccccaagataagctggggggtttccttgggtcctggaccttaaatagagtgtagacgaggagagttatcttttcttctgtctatcctaggttcatagctggggcccttttaacaaaagatagattaacaagagagaagcatacacatttatgtaatatgttttatgtgatatgggaggtatcatacagaaatgtagacccagaggaacagttaaacatgagtatttttatgttaggcttgatgaagagtagacagacatggaaaaatatgatagggcaagaagggcatgatttaatggtaataaactggggaacttagcaaagcctgttagtgcagtttcatccgtgtgatccttcatctccagatacaaggatggtgctttcctttgagtacagggagggcacctctcacatgagggtcttatgacctgcttcaggggacagtcagaaaatcctaggtttaatgacctgctttaggggagaatggtgggggaaaggtaagagtgacctctatgcctctatgattttctcagataccttcagcttaaactattcaaaatactaacatgccatattttgggatagcatgtcctgaaccccatcaagtgcagataccaggaaaaatgaccctgtaaaggaaatgccattatttccaccttacaagtgagaaaagtgagtttcgaagaggtgtgttcacttacagaagtttgcacaggaaactggtggtgagaaagaatcaaatatacatctgtcagacttcagacccagaactttacactaaccaacttcttcagaatgcagagttccatctccttcagactgtgtagctcaacagttttgtaccatctggctatttttctctactgtgtatttgactttgtctcttttgtctcagggtgtacttgaaagcctttacctccccatcttccttccctgatggctgatatacttctgcctcacctgctttaggagcccctgcctccaaccatccaaactaggtcaggggctggggctccttccttctgttagactattcagatctgagtcactggtcattcgcatagtgtcttataaatgtctgcctgtgtatttttccaccactgctagactgggatcttgtagaatacaaggaaacaactttcatctttagatttctagcacccagcatagttcctggcttataattggggatcagtaaatagctgttgaattaatcaatttataaattttcaggaagcatttgtgtgccttcgagtcacagtatttgatctatttaaggacttattccataagatgcatttgtgatgcttaggccagttctcttaatttttttttctatttttaatttttacaaagtaatttttgtgagttaacttggctgtttggattagatttcaacctgatactttaccatgcctaatgtctgagaatgagaaattgtcttttctgaagtcatagatgataatgtccaagtaatctagaggctgtgttgaagttaggaagaaaggaatttctgacatcaagtttttgctttgtcttcactgtggatttttctagttttctctaagtctcaaatttccaagctatacatattagcctacctttgagatttgatctttctgggtaggaaggagaaacaggagtgagacccagttatcagaaggtctgttctttgttctctccactcctcgcaatacaaccagcctcttgaattggtttctgattgctctaagtcatggaggagtgtggcatgaagacagaaatgatgaatgccatcccaagttaaactgcagtatgcatggtgctacatgtaattgtggcttttcatgaaataagcagattttggtttattcttaatgtttaaaatgctagcctgggttatacctactacctggtacctcattttccttattcctttgggcccgcaattattttgtcatcagttgtatagtcaaggacagaaaacagatgttccaatcaatctaagtaaacccaaataactctggcaaagcacacaccgtgctgaaatcaaatgaactgttatgccaagccttgctattaacaccaaagattggaagttgttggtagtaacatcaaaaatggtgaaaatatattgagtaaactgtcccagacattgttcccctcagttaatctccatgatagccctataagccacattctatcatcattccaattttatagatcaggagactgagacataggaaacttaagtgatttgacctacttgccagacttgaaaccaagcagtcgagttccagtgcccttgctttgaaccattacgccctaactagttcatatatctagtaaatgtctgtttacatctcatgtagaaaaagaccttccctattatcttgctctgcagagggtgggagggttggggtggggagggggcagtggcagtgtcaaggtgtgtaaaatttctctgttgacttaaagcataggatgatgatgatgatgatgatgatgatgatgatgatgatgatgattattattattattatttgagacggagtctggctctgtttcccagtgcaatggcgcgatctcggctcactgcaatctccggctcagtgcaagctctgcttcccaggttcacgccattctcctgcctcagcctcccaagtagctgggactataggtgccgccaccacgcccggctaattttttgtatttttagtagagacagggtttcactgtgttagccaggatggtctcgatctcctgacctcgtgatccaccctccttggcctcccaaagtgctgggattacaggcgtgagctaccacacccagtgcagtaaaagtaaacctactttaggatttagttggggtaagttctagaccacatttctttcaaggtcaaagcaatacttcatgaaacattgggattacctttttgacttttttttttttttttttttgagatggagtctcgctctgtggcccaggcttgaatgcagtggcgcgatctcgattcactgcatcctccacctcctgcattcaagcaattctcctgcctcagccccctgagcagcttggactacaggcgcgtgccaccatgcctagctaatttttatatttgtagtaaagacggggtttcaccatattagccaggctggtcttgaactcctgacctcatgatccacctgcctcggcctcccaaagtgctgagattacgggcataagccaccatgcccggccacctttttgactgttttactccccttcatttgctaggcttgaggttaaccctttgggtttgctttagtggcattttgacagtaagtcctgaaagagatctgagttcagctatcctattgtctaggaatagttggagttcttgtaagtagttgaaaagaaaggaactagcttctgtgaactccacgagataatgtaggataaggtagaattagagtcaggtagatctgggtgtgatatagtcccaccccgaggtcccccacaatttagtagtgtgggaccttgtagaagttgcttggaaaactttactctccttttctctatttgtaaatcaaagtgataataactaccttgcagtatcactgtgggaatcaaatatgataatatttgcaaagtgtcaagcacaaagcaatctcccaataatcaaggatcttagaacctttagtctttaccagtgatttttgacaaggtatgttgtgaggctccagtaattacattattacccatgagttgtcactcaaaaccaatcaatatttttcacctttattcatatttaagacacggagcctttgtccgtgattaaatgtgctattgttacctagaaaatgtcttgtgctttactagtatgtgacttctgccacacacattcatttattcattcattcattcatcaacaataacaacaaaaaatagtgagctactgcagtgtgaagacttgccctggcctccgtttgcttatagtgtagtagagggatttgtttgtgttgtctgtgcagacacataaactaaagttacagtgacagaatctgtagagagtcagaagatgggctacaaaggaaggaggcttggtcggttctgctggtctggggtgttttggggatgtggggagatgtgatcaggaaaggcttctgatgctgcaactgagtcttcaaaatggagttggtgttccccaggattgttatgggatgaggtgtattggtggaaaggatatcctaggcagagggagcaaagtaaacaaatgcttagtggcaaggaccaccaaatcacattcaggaataaggagaaaaggtcccaaccatatggaaccctgctcatgccaggcaattctgcaggtcgtggatggcgtatctcccatttattgagtactggtgtgttccacctaaatctcatttaattctcacagcaactttgtgggtgagtattgctatccaaattcttcagatatggaaattgaagttctaaggggtcaaggcatctttgcccaaggggatgaaagagggattcaagtctaactctgaagaagtagataaacaacaaaaacagcaataacaataataaaagtaataaaaacagcaaaggttcatatagtactaggcatgttttaacctgtaccgttcaatataatatccactagctatatgttgctacttaaatgtgaattaattaggatagaataaaaaattcagtcctcagttgtactagccacattttcagggctcaattgccacatgtgtctggtatctattgtatcagacagtgcaaatatagaacatttccatcatcacagaatgctcttattagcactgttatgggtactttacacctatattaacatatataatttttataatctgtgaggaggatactattcatattgtagagatgtggaaattgaggcataaggaagataagaaacataaagaagataagaaatcacatgatgaatgagtccttatttttaagcactgtgccataatactaactcaatatattgtgttctgtttaacataaatgaatgttagtcaaaataatggacttcagtgtctgcgtgtatgtagtctggtgttaagtcttctgcagagaacacgtctttgatatgattcttatccttccagaagcatacagttgtcaatttgcatgtataaagctggtggtcactagagagtcttctctggagcccttcctctccaggaactccagaaacctcccagccagctttggcaagaaactcactggatgggattcatcagtcagttcattcatccaaatgactgaatcaagagtctcaaacagatgtagtcttaaataatgttcaaaacccttcttatcctttttgatacttcagagaaggtgcctgaggttattaaaagagaatctttttcaagatgccaacacatcagactcaaagactgaaaatcctagttgagtccaacttctacctctaagttactaaataaactcgactaaattacttcacctttctgaaattcaatttcttcaactgtgaactggaaataaaatacacatatcacaggattttctaaggactaattgaaggttacagtgtttgaggatactttgcaagctataaagtactttatatggctataaagtgggagataattataacacaaatgcgagaactcaggatgtttttcttctatataaccttgtaagctttcaaaactgccacagcgtgataaattataggaaaatgtactcttaatcataacatttgcaaagtctcttttttattttacataaatatagtagggactcaatgcttgggtggaagtattgttggttggatgaatgggagagatgaagggagacagcatattaaataagagagctgttcatgaagttttaaatgttccttttttaacattctttttaaacattgcttgatatgaactatgtgtgttacatggagggttgggagacatttaattcattgagttagcctgtttttctgctatttgttttttagttcaacaaacatttattgagcaactgccatcagttgggcattgtgcaagtttcagggaaaacacagttgatgatgtcactgtttttttatgcctgtttcttcatctgctaatttttctccttaaacattttgaggattgcagaataaactgacactggtatggtcatatgaagggccccagcggtaccgagggctgcacttgtgtcaaattgtttcctgatgtacacatgcagcctgtgagttctctgtggatggcaaaatatgtttctccggaaagaagaaagctcctcccaccttttcttgcttttccctgcttatctctgaacctcttttctcggggatagcccatcaaagcactgtgtggccaaaggaaaaataagatgtcagctctccgactcatgtggtcttgcagtgaacatcagctatgcatggctgctgaattggggtggacattaggcagagtgtagagaacctcttgaggggaaatgaggccagtcctgcccaatatatataattttaggtaaggagatacctcagcttgtattttaggagaagcactgtgtatatactgagaatggctgaggaaggacctccatttgtaattcatttctctcattgtggggatgagagaaccagttcaaacttttaggccatttgtggcagaattggggctgaaactcttgtttttctaactcttagcccatggctctcactgagtttcatggtgaactagcacttccaagtatgttttcattatgtaagacaattataacatcataaagtgaggagtatagaaagaacataagctttggagtcagacagaacaaggtcaaatcctggcactgcttcttaaatccatgtggccttgggcaagttacctgaacactctgctctgttcttctacttctgcatctattaagaggaagaaagaatgtttaccttttatggatgttgcaaagattaaatgagagaacattcaaggagctcagcacagtacccagcctatctttgatgttgatatgtttactagaaaggaagaatccagttgtctcttgagagggggttcagatgatgatgatggtgatgatggtggtggtggagagagtgatggtagtgatgatggtgacagagctaccattaaacatctctttttaagcatttctgcaatatcacaacaaccatgtgatgttgtgattttcctcattttatagcagatccttctgtctccaaattccatccttttctcataatagcacactagttctcaggttctaagtctagatatagcagcagtgaatctgccaacccaagaagaaacaaataaatatttcctacacatttctttttccttcattttaattcccttttcgtattgactgaccctgtaacattaactttgcctgtactttatgtttatgcaaccagtaaatgtgggtgattctcaggaattccttgaacctatttatgatactgtggagcagcgtggccaactccttttctgtcaaggatctcagaatcaatatatttaagatcccaagattttgagatgtacagataagtgaacattggttgcctggctattggatttttatcttagagaaaaacctgtgagtcttggtggggaagaaccagcactttggaatcagattacctgaatgtgaatcacagcccagttccttgtgagctgcatgaccctggtgaagttactactcatttctaagcttcgattttcttatccataaaatgaggataatactaataccaatgacattagtttgttgtaagaataaaatgagacatgtatagaaagagcatgtaaaaagagctcagttaaaatgagctcatatcttgggttattcctgtacaaaagcctttgtgccctgaatggagaatcgtgtcactcaggattcactcagcaaaacacaaaccactctaattgtttaaaaaaccagtaacttaatacccaaaaatggcgatcctgatgatggaggagctgagaagggctacattccctgtgaagcaaatcagagatcagtgaaatggaagcagctaccatccccaggctggagggactaaggagggaggagggaggtggtgttctcatagtctgagggcaggggacaccagccgatgctggagccatggcagccctgtcaacagagcccgagtggtggaggggaagcagctgctgcctggcacagaagagaagtagataggctcttgcttccccttgcctgcaggggtagccccacaatactgagcagagcagcggacttgatctgaaaacacataggccaaggattcttgcaggctaaagtctcagacttctattgcctggttgtggatatgtaactactgtgataactaacacagaaagtttggaagagtcttacttccccctgttgctagacctctgaacaatagcagagattcacaggttgctgtgccccagaaggtagaatttggaaaaagcagtggaaaaccctcgaaagctgtaagaggcctgtctctggcctttttctcacattactttctagcaagtatctgagcagccagtgccttcagtatctggggatttgtggtctgatgagacattcccaccctgccgtttacctggctaacttctgcagaattgagtatagactgaacttccttgggcccctataggtgggttagctgcctttgtggcccctcctgtgatacactgatttccctgcactgaaatactccatttaggcttccatctccttcccaccagactgtgagcagggacttgtcttcttcatccttgcatccccaagcatttgtactcttacttcctgtattgagctagctactgtggtaggtcctgggctatgcatgtaagtaagagtgccagctactagcaacttttattatagaagggaggcagatgggatatatgatgttttaaaattacccatgtcttttgtgctagggaagtccattgcatgagactatttaacagggagaatcgtctgtcctagagggtcagggaagccctataattaggagtcggcctgacagcgaggttgggggaatggcattccaggcagagggaagagcaaatgtgaaggtcttgaggtgggaaacagcattaaggattagagattgagagcaaacgtggcattgcctgggagctgatgaggtcagcaggacctgttctctcctgtgtccaagtctctgcgtcctgcctgagcactttccacccccagctttgtgttgtagtcctgcaagtctgcgtgtttgtggcttccacatcacacctagtatatatcgttttgtgcatagaaggggcttattggatatttgaacaaatgaatacaattccaggccctaaagagtctttctagctttcttgtcatatttataactttagttgccctgcaagtatcaaggaatacgagctctatggggaagaagcctgaatttataccatttatgggaaaccctctgctatttggcattctgttactaggaactcgctctcagtcattctctccttcacaattggagttctgcgataagtagtagtaagaatggtgacctagggatgccagaaagattcagtcatcagaccatcctttgcttttgcttctttgggactgagatgtgatgtgttaaaccagattccatttggctccgctccttcttagcagtgaccttgggcaagtcagttaacctctgcagaccttagtttctcctctgatgtctaacattaataatatctatgatagtgttaaaatgagaccatgtatgcaaatatgtagcatagtgcctggtatttagtgagcagaaaataactgatagctgctgcttttattatgacaatcacaattactgccattattataacgttgggtgccatacattgaccagaacaaagcaaaatctgagcaggcttccgaggtttcctatgcaggcaagtatgccctttgggtttctccttgagactgccctacacacaggacccttcctccatgttgtttgactattaaaaagaagatttgttaatgcttgtttttagctttctctccctctttttttatgtgttaaagaggatttgtttttgttttcctttctcacaggagtgattggggcagatgtgagagggcacggcctcatctgtgaggggcagccagtgacgtcacggctggctgtcatctgtggaacgtcttcttgtcacatgggggtgagtccactgagcacaaaggcaaggccaccacacagcaggaggtagcctggaaggagaccctgagtgctggcttcttcaccctttcacttctttcctcttttccctgcctgccccttgtgctttgtctagccagaagcccagctccccactctacctcccttgcttaacatttgctggatctttttccaggggccaaattcttagtaagcatgaaaaggattgagtgctccctttgacgtcaccctggccagagagcccaggcatgaatggtgacatctgatcctaaggtgacaaagtctagctcccccagactgatctgtccctaatgggtagcggggtcttctcggcaaagagtgtctgttttccttggccagggaactctctctcaatcaatataaatccatctccctgggagcgtcctgatgatctatagaattagcctgcgtatcatgacttcaaaagaacactgataagcaattttcactttgttaatttttctccatgaattagtgaaaaggctttctccaagattgcagttaaaatttagtgcctgccctaaaatttatatcttctttaaatgcatgagtctgaaagcattccattccgataagtacccatttctaccatatttttatttaaaagtcattactctgttaaacttaaatcgacgactctttggaattttcccagataagtataatagagggcagagtgggggaggagcagggagatgagcagagattagagcgggacacagcccagggcagaaccaaagcagctatggaggaaattaagtgggatgtgagactgttttgcaactgtagggacccctgagcctttttaccatcagatattctagttcagttgatataaatacatgtacttacttatcaatccctgctcttgtgctaaactgtggatataagaatgacatcggctcagtgggatgagatgaagttataacaggtattagaatataatgtgaggccccccaatgtagatacaaattgaactcatgatactaagcatctgttatgtgccaagcaatatgcgaggtattcttgcacatggcatcccattttctatggctgagggagccagcccgagtggtttccagtcccacttcctcagtttactaagtgtgggcctttgggcaaggtacttaaactctctgggtcccagattcctcatctacaatatgtagagagtgacagcacctgtcagagtgctgcaagaattaaatgaggtgatactaagtgctccacatgcagtaagcacatcacaagggctcactcttaatcactaggactgttgttgttactgagcagaaagcaaacagtggctgactctgcctgggagggtgcagggtgatagaatcttcttgaggtgacatttgtgctggactttaaggaaatagatttccttctgtttgggctctgggcagtcttgaatggaatttttctaagtttaaaaattgcagcatatttggccagacacagtggctcacgcctgtaatcccagcactttgggaggccgaggtgggtggatcacctgaggtcaagagttcaagaccagcctggccaacatggtgaaaccccgtctctactacaaatacaaaaaattagccgggcgtggtggcaggcacctgtaattccagctgcttgggaggctgaggcaggagaattgcttgaacccagaaggcagaggttgcagcaagccgagatagtgccattgcactccagcctgggcaacaagagcgacactccatctcaaaaataataataataatttcagcatatttcttctgctcagcagcccttttgtaaggctcagctgtccctgaagggagagatctgcagaggcctgaggcctctttaagccagaaggcaccagcccaggagccagcccttctttcccttgatatgagtctacacttgttagattgtcttcactgaatactgatttaatcctgtttaaattatctcttattttcacagggatacatctaatcaggcttctcctgggagatctgaatctcaggcatttttaccccactcaattcagatttctgaacagaagcaaatctaaatggatgcaagtgtctctgtgatggcctgcttcttagtcttactgtctcttaatggagatgaggctggctttccctacccatttaatgtacacatttgggacctaaagcgtagaaaagtccagtaattttcccaaagtcacaaagctttgaagttcttgagctaagaactgaaatctaactctgattccaaagctcatactcctccttgcctccctgaattgtgcatgaagatgatgtacccatagaggaatggtgagaacatgggcttttacattgtccagaggcaagcttgaacatctgctcatgcatgttttggccctctgacctgagtgagctacttaacttctctaagcttcagattcttcatccatcaaattggggataatgatgccagtctcacagggttgttgagtaacatgcattatgtaggtttgtacctagcacacagcagacactcaaaaatggtggagattgttattaaactttcctagtgatgtaaacggctcacatgaagcaactgtttgggctttaacgagtttgatgggcagctgcagttggttgcgatgaatgagggccataaaaggccagtttatgatggctgtgttgtgctggaaataaagtccccacccccatcctgctttgtacttgggagtgggaagggaccctctgggccaaggggattaatcatcagctttaatgttatgtcatgagggtgagactgtggtcatgctggcatgggaaagtgcctttgatctcctcaggtgctgggaacccagcaacaataacacctttgtgaggtctaggagaggtgcaggtctgaggaaacactcccagggagactcaaggaccccctttgttgtggttctggcaaataaaaccgccactgtgaggaaaaattaaccaaacagaacacagggaccaaagggtgatgcgggcttttcaaaaagtggttttcagcatgatctgaaggatcctctttcttcctgtctgcttacttctgatgtttccaatttagtagattgagacaaaattcccaggaacgttttgtgcttgatccaggttgcctctttctagatcacccaaaaagaataaatgaatgaacgaatgaccacataagtgagtattggtaaatacttagaagcttcgtacctccaggttcctgttgcttccaggaatctggagaaaaagcctgaggttgaacataagacatgttaataaggcctttgatattttagaagatacaagcatgggctgcacatttatcttccttgtgggtgatttaattaacaggggaaaaatgccattctttttttaactccatgaaagcagagctgcttgttcagagttaattactaccaagtcaccaaaaccccagataatacacagcaggggttagccagaggttgaaaagtcatggggtaagatggagctgatccttgccattgtactgacatccttttcttgagctgtcaggttgggttgtaacttggcaacttgtcttccagttagcatgtcagatggggacaggaccctgggggggtcggggtagggagaaacactgaggaggtaagatttgagcagaacaatacctgaagagagctgggaactacatctgcatcttaaatcgctcagaactgaagttttttcagtcttaatattgagatagtggttctctatcattgaagggatgtggagactcaaagacataggctcatacgctgcccccaccacttactgtgtgaatttaggcaggatgcttcatctttcagtgcctcagtttctgcatctgttaaatgtgagtgatagtatttacccataaagttttgttcaggttcaaattaggccatctttgtaaatgacttggcactgtacctggcacaaaataccaaatatgatattgttattaaaaatgagttgttaatcacatgaacaatccatgtggttatggactagaattagagacatcagtatgaactcatattgggggaacccacccccaatatttcaacgtaggttctttctattttccgtaagtgtcagccggctgagaaataaagagaaagagtacaacgagaggaattttacagctgggctgctgggggtgacatcacatatcagtaggaccatgatgcccacctgagccttaaatccagcaagttttattaaggatttcaaaaggggagggggtgcaagaacagggagtaggtcacaagatcacatgcttcaaaggcaaaaaggagaacagagatcacatacttctgaggaaacagtacaagggcaaattcagaactactgataagtgtctatgttcagctgtgcatgtattgtcttgataaacatcttaaacaacagaaaacagggttcaagagcagagaaccgatctgacctcaaatttaccagggtgggttttttccccaccctaataagcctagggtactgcaggagaccagggcatatttcagtccttatctcaacctcataagacagacactcccagagtggcttttatagacctccccccaggaatgcattccttccccagggtattaattattaatattctttgctgggaaaataatttagcgatatcttccctacctgcacatctgttttaggctgtctgcaagaagaaaaatatggctctttttgcccgaccccacaggcagtcagaccttatggttgtcttcctatgttccctaaaatcactgttattctgttctttttccaggtgcactgatttcatattgttcaaacacacatcttttacaatcaatttgtacagttaacacaatagtggtcctgaggtgaagtacattctcagcttatgaagataacagggttaagagattaaagtaaagacaggcataagaaattattaaagtattaattttgggaactgataaatgtccatattaaaatgaaatcttcacaatttatgttcagagattgaagtaaagattggcgtaagaaattataaaagtattatttgggaactgatatatgtccatattaaaatgaaatcttcacaatttatgttcctctgctgcagctccagccagtcccactgtttgaggtccctgacttcctgaaacaaactcatatttagtttaacatagatgcagatggatgcatatagaaatagttatggatatatatacatatacaggttagtaaacacatatttatttcctggctctgttagctgagatggtctagaaataaggatacctcaagagctagtttttacaagcacatagtgtccagatcatggtatctaataccattatccaatacaaagaaccaggactccttggagaaatagttgattttaggattggaataggaaatatacaagatgagcttggagcatttgcagtgccagaaagttaggaagttctcaacaaaaaagatgagaatatgtcacagggagccaactgtgggagctcccactagccaaaactggaacaatttaagcagtaaaatgaagtattatgaattataactcaaagtataacataaatatccataagaccatactgacataaattattttgaataaataaatcaatgaaaagaagagagacatctcccatgcagaaagattccaaataatttatataaatgttccaccatcaaggaggtggagcataactttccactccttaagtgtgggctgcacatagcgatttccttccacaaaatatggtatggaaaacgggggaagagtaattttacattggagaaatatgagaaacagcatccacgtgacaaggtcaacatcaacaatgataagtcatgttgatagtacgtacccttgatatgatgtaatgaaaatgacactttgtctctgttgtgttcatcccccaatcctataagcccagtctaattaccaggaaaacaccaaacagatcttagttaagggacatcctataaaatacttgaccagtatttctcaaagctgtcatccaggtcatcaaaaaacagggaaagtcagagaaactatcacagccaagaggaacctaaagagccatgataactaaatgtaatatggtatcctggatgggatcctggagcagagaaagaacattaggtaaaatctaaggaaatctgaataaagtatggtcttcagttcatgataatatatcagtgtcattcactgtgacatatatacttgacaagatagtaatgataggggaaatgtaactggatgtgaggtatatatgatctttacaaccatcttatattgtaaaactattctaaaatttaaaatttatttttaaaatattcattaactattcactcataaagaaaacttttttttttaatttacctggctaagtgctaaaagtcttcataagataaaatgtcatgcctgccttcaaagagctcaggcacattgagaaagacagacagaaaaaggagatactacaatacaaaatggtaactactatagttaatgcatggctggagtgtggtggaagtaggaagaaggggctgtcccaagtcttgggtagatgaggaggttttcctataggaagagatatttgcaggatcatggcttccccgcccccactgagacactgttcctgccagcccaatttctgtagtaggccctttcctcagtcttctccactttgtttttctttgctgtgtccacaaagcctcacagctgacttcccctgaggcctgagcaggatgtgggtgtgtatgagccctttgggagggcaccacagggagacagcacagtcatgtattatgaactgatggtcttctgttactagctgagaagagtgggcaagtgggaccagtttctctgtcatggtctctttaacaagtgacattggcagaagttaccagaggggtggagtgggatgggattccacacggtacagtagaccactgttacacctaacaatgaaagtgctgaggtgctgctcagaaggtgcctcgcttcctctttgtttaccaggacctgttgtcgtcagccctctaggaaccagcattctcaggacactctctgtgtcaagactagctctcagactgcatgttttgaaaacaaagtatatgctaggcattgattcggcgaggagagggttgatgtggttcagtggacaatgagagacagactgtgcactcaagaagctcaaggtagcttgtttttcaagacatttgagaaacatagaaacattatgctggactgagtatgtttaatatctctgaacccaggcagtagcaccctttcctcaatcctcatgaggagataagcagtaatactacttgctaccatctgttgaccacggaccatgtactaagcaccttactaaaactttgtatcatgtaaatagctcaacaatcctaccaagtaggcaccatactgtccctcattttacaagttaggagactgaggcaaagagtggttaagtgggtcacacaatgtgtaggaatgcaacactttgagccctctggaagactgaccagagagtccttcctcctccctttcagctgtatagcttccctcaaaggcctagaggaaagggagaacagactcaattaaaagggccaaacatgagcaaatgtttgaacagacatttcaccaaaggagaaatttgaatgaaaagcactggtcattagggaaatgcaaattaaaaccacagtaagattctctactactcctactcatcttagaatggctgaagatgtgaggaactgtagctctcacacaccactggtgggaatgtaaaatgatgcaaccattttggaaaatggtttagcagttacaaagttaacatattcctactacgtgatctagccattccactcttacaaaagcatgtattcatacaaaaatttgtacagtaatgttcataccaacaaataaagctttgtaatagtccagcactggaaacaaccgagatatctttcaagagtgaatagatcaactcttggtgtatcaagagaacaaaatactactaagcagtaaaagggaatgaaccataatataaggtacaacatggattaatcacacaaaataattatgctgagtgacagaagccattaattcttccaggcaacttgcagtcttttgtggaaaagtgggctcaggccagctgataggtagattccccctaaaggcttttgttcctggccttctgagatgctttgtttcacctgactttgccatgttcctggtggactttcagaaacatgaggccagatatccctgcccagcttttatagaaatggaatgtctggatcacagggtagatgtaagttttaagaaactgccaaactgttttccaaagtcactgtaccagaaacgaatgcaaactttcttgaataaaaaatagttccattatttaaattcttgcaaaagcaaactaatatatagtgacaaaaagcagatcagtagttgcctggaatcatgaaatgggcacaacaagggccaggaaagtaggatcaaaaaggggcacaaggaaagatttgggtatgtttatcttgattgtggtaataacttcactgatctatgctatgtcaaaactttccaaatcagacatcttaaatatgtacagtttattgaaagctattagctcaataatgctttttaaaaacagaaaaaagatcgattttgtatctggagactttactgaagttgcttatacacctaaggaattttaaggctgagatgatggggttttctaaatatacaattatgtcatctgcaaaccgagataatttgacttcctctcttcttatttgaataccctttatttctttctcttgcctgattgccctggccagaacttccaatagtatgttgaataggagtggtgagagagggcatccttgtcttgtgccggttttcaaagggaatgcttccagcttttgcccactcactatgatattggctgcgggtttgtcataaatagctcttcttgttttgagatatgttcattcaatacctagtttatggattgtttttagcatgaaggggtgttgaattttattggaggccttttctgcatctattgagataatcatgtggtttttgtcattggttctgtttatgtgacgggttacaccaataatagagagtcaaatcatgagtgaactcccattcacaattgctacaaagagaataaaatacctaggtatacaacttacaggggatatgaaggacctcttcaaggagaactacaaaccactgctcaaggaaataagagaggacacaaacaaatggaaaaacattccatgctcatggataggaagaatcaatatcgtgaaaatggccatactgctcaaaataatttatagattcaatgctattcccatcaaactaccattgactttcttcacacaattagaaaaaactactttaaatttcatatggaaccaaaaaagagcctgtatagccaagacaatcctaagccaaaagaacaaagctagaggcatcatgctccctgacttcaaactctactacaaggctacagtaaccaaaacagtatggtactggtaccaaaacagatatgtagacccatggaacagaagagaggcctcagaaataacaccacacatctacaaccatctgatcattgacaaacctgacaaaaacaaggaatggggaaagattccctatttaataaatggtgttgggaaaactggctagccatatgcagaaaactgaaactggaccccttccttacaccttatacaaaaattaactcaagatggattaaagatttaaacataagacctgaaaccgtaaaaaacctagaagaaaacctaggcagtaccattcaggatgtaggcatggacaaagacttcatgactaaaacaccaaaagcaatggcaacaaaagccaaaatagacaaatgggatctaattaaactaaagagcatctgcacagtcaaaaaagctgtcatcagagtgaacgggcaacctacaaattgggagaaaaattttgcagtatctccatctaacaactgttcagaaatcagttagagagcctctggccttagtgtctttgggctctaaccacagaaaagccacccttcagaccatgctacgtttttagagctgtgttctctgggtgatgtctataacagcactttacagcttcctcagaacaccaaagaaaacgttccccagaggcaaagggtgtggcctgggcctggggggcccatgtttcatccaggaccatgaggcactgcacagtgtttgtttgttagaggagcagaggatgctcaaaatcattagtcgttagggaaatgcaagtgaaagacacagtgagatccactccacacttactagaatggctgaagttgtggtgataatgtggggaactggaactcacatgccactggcaggaatgtcaaatgatgcaacgactttggaaaacattttagcagtttcataaaacctactctaccctgtgatccagacattccatttctataaaagccaggcagggatatctggccccatgtttctggaaacccactaggaacacggcaaagtcaggtgaaacaaggcatctcagaaggtcaggaacaaaagcctttagggggaatctatctatcagatggcctgagcccagttttccacaaaagactgcaagttgcctggaagaatggtgtaagttcttcctctagaagtagaggacgaaaatggtgcagctgtgttttagctccctcctgattggcagcatgggttcttctcccaagggtacaagggaatggggtgggatgggggtggtatatgggagtggaaagttctggaggactgccttgattagcagcaatgacaataacagctaatatttattatatgtttatcatggtctatttggatttttttaaccctcataataaccttatacagttgtcagaattatcttaccaatttatggggactgaaactgaggctcagagagacaagtgacttatccaaggctgtctagctagtaagtcctttctttttttttaagacagagtcttgtcgcactcttgctcaggctggggtgcaggtgcgccatctcggctcactgcaagctctgcctcccgggttcacgccagtctcctgcctcagcctcctgagtagctgggactataggcacccgccaccatgcccggctaattttttgtatttttagtagagacggggtttcaccgcgttagccaggatggtctcgatctcctgacattgtgatccacccgcctaagcctcccaaagtgctgggattacaggcgtgagccaccgcgcctggccgtaagtcttacagataggtttgccactcaggcagttggattccagagctcagactctcaacaataagcagaatgatgagacacaggctgtgggatgggttgaccataaacacacgtgttttgtgggaatgaggtagagtgattacacagcagatctttcccagagcctgatgagaactgcacagttaaggctggatcacagctagaccgcagtgctttcattttccctttttcccagtcttccaaatcacttcctttcaagaagccaccagcctaatgataacaataaaaataaacaacatcacttgtcaccatcatcccctgggaagagagtatttatgagactccctatttaatcttcccctgttccctgctgcgctgtggtcaagtaccaaatttggcaatgtgaagacatgcggctgacttcccaactcatgaagatgtttttctatttgtttggagagcatgatgaaaaccacattgattttttttttccttttcctatttaccacacatctgttgtgtgggtgattctgatattgtggctgctgagggttacctggcagtaaccctcagtaagaggagagggtttgtccttttccagaagtttggtgtggatgaaatagatgatgaggcagtcatggtggagccctaaccaagcattgggtcccgtgccaagtgcctgcatgcatgagctcatttagttctacatacatttagttcagaggctttagtatttatgccttgtttttctcttagtttttcatcctcttctcctattctgtttgtgtgttccaaatgtctgttttttcatacattacatttttatatcttttgaaagtactcttaagagctgtcagaagtttgaggtagtttctactctttcacttaaccaatggttagagccccaggagaaataacagtgagatcaaagaactcagaagaaccaatgggaagctttttgagcaatcagcactgaaggaatgaaattgaaagtccctacgtaattaaccatcagtggctccctactgccaatagaaaaaaaaaagttcagatgagacaatgagtggaccttctggctgtgttcttatgggtttgggatatattgcattagaataaaaccgaagtcttaaatcctaaatgaaagttactgtcagttatactgacagtgatactgtcatgtatgttgtaaatctttttgttgaaagataatttacataccatgaaatttatccccttgtatttttaaaacatctagagaactgagtatagtgatgtttgagaaagaggagacttactgcccattttttaggttacattatgggatgatactagtgtgtggtctttattacttagggagataacagaaggatatcatacaatagtacattgccatttacttgtatgtacctgacacataataggtgtccgttaaataatagatatatacatgagcataaggacagacagaaaaataccagttagcaactgtaaaggtttgttggagaagaaatcgtgccatacctatttgatttctgttctctgatggagtgaaaggctgggcagagaaagggagatacagcatataaaccaccaagttattggtcaggccttaggttctttccttgattaactgacccttcccacatgccacagcagcattggttaagtcagtcacacaattttatctgtgcacaaccgagttgtccactgaattatacctcaaagcaggccaaaaatatatatatatatgtaaaactgattgaaaagcattaagaacaactaattgccaatttgtatttgggctgtttagttgatcgttgtagccttgtgtggcaccaggcaaagactaagccacaattctgttggttgaggaaatatttaactggaagatgcttttgaatgaatgatcagctacccaggtactatttgacatacagcagtcttggggcttccatgacttattctcctatcatctgtttgcatgataaaattacaggtttccatgtaatctttagcagatgtatttgctatgatcttggaagacagggcatagcttctctggaattaagggaatggcccaggaaaaagaagaggtgcccacagataaaatggtcagttatttttatatatgtgtgcattcttctgtggtgtgcagaacaccaaattgcttggacctgtttattcccacagactcacagtcaaactggtcctgaatattaaatctgatggtttcattctcctgataaaaatcctttgtcgataaaaaatcctttgtcaagtctcctgaatgctagctaggcatacgagatccagcattattgcccctgtctacctctgataccattccgtgctatccctcaccattcatcctgtgttctagcaggtgcatctgcacacgcttgtttgaattctatggaaccagagatgtttgagcatagagaatgaccagattttaggcagttaatactgtatatatacaatataatgcataacactgccagtgaagtttggagcagcacctgtaatcgtgcatactaatatctctacagtaaaacatatgaatattcacaccaaacaggttaagtcagctttaaatggcttgatccattcagatcagattttaccatcaaatgaattgtgaaaagacttttggtatttgaaatgctttgggttgaagaagtgtggtagacctgtacttgcttttcttgaaaagagcctgtgctctcttattcatctggcctttgggcatgttgttttccctgcctggaatggccacatctccctctgcctgttgagtagcatcattactagaatcatcattgcatatactgaggatttactatgttgttactcccagcaaattctatggtcgggggggcgggggggggtgttcttattgtattacatccccccagtgtttagatgaggaaactgaagcttggagaggtcacagagctaggaagaggtagagctgaggttgaaccaaaaagtatggagacaacaaaccttgggttcttagttactacactgtccgtgtgtgcgtcttccccaaaggtccagttcaggtgtcaccttcctaaggccctcttcccttcctccaccacgtttaatagattatgactcctctgggccttcacagctgtttatgcatagctgtggtgcactgcttctcattctctgtctttcccatgagcctaaactccttgagtagttggggaaaaatgtctacttcagtgttctatctctagggcatacagtaggtagtcaacacatagtttataattaagttagtttaaagtgatacggtaacagataacaatttgtatcatcattaaaataaatagtaaacaccaaatcacaagttcaaggatataaaatttggatttacaaaagaaaaaaatactcagaaaaaaaaaggctgctcatttttatgcatggtatgtaaagaagaggaatttggggacaacagttcaagaatgggcaaggaacacatttatacttaaaaattatgacagctaggatttattaaatacttcacatgtgacagtttctctgctaggcattctgtgtataaactttctaatcctcacaacaaatatgtaaggctaattgtcgaatccctgaatggacaaaaattatagctatataagaaagagaaagatatggtaaccatgtcttagatcagaataaaaagaacaaaaggtaatgatcctaatatattcagatttaacataaattaagcatcattagaggacagtcacataaaattgcacaatagaatatatttccacatctgagagatgatggaattgaggtcaaagagattacaggctagtatgtggtattttatacccattccttgaattatgttaacatggtaccagaagtatatcttgctgtcctcctcagaactgggtgcagttttgagctctgcttttgtaaaaagctgttagaacctgaaagaaccacataacacagctgtaatattcaagagaaagtgggtcccacgaacaaagattgagattgttcagagaaatggggtggttctgattgcttaatagaaacctcacaggttggctctattattttcttgtttatggaagtttttgtgaccgtaagagctaacttttccttggtgctttagagtttattaaacgtcttatggaatttgatgctcagaataactaagtgaatcagtcagagcagatgttttctttttttcaaatgagactcaaagaaattaagtgatttgttcagtgtcccacagctaataaatgatagggccaagactcagatatgtatctgagcagacccctgagccatgtccactgcaatcttgcaatccttggttcatcttcatttactcaaattgaaggatcctgcggctggtgaatgtctggttcattgcagaagagttcctggttccttgtctctaatttccattgtgactgtgaattctccattgagctgcaagccagtgactgtcaattaatgtgcacaaaatatacctgggtaactgttttaaaaatgcaattcctcaggcccctctcccacagggtctgattctctaagtcttgctggaagggatatatgagaatctgtaattttaacatgtgcccaggtgattctaatggaaaactttcaaaaaaactgctttaagctctttcagagtagcaattatatctttacttcattgtttccgtagtgcctagcagagcaccttgtacatagacagtactctaaatttacacttgatgaatataagagtgaagtaaataaatgtaaaattaatgtaaaatgaaggaaaacaagtttgagaatcagtcagttcctgccagatttggagcacactgaggaatccctttatctccatcctttcaaataaaatatctcttggtaggtctgggtaagacatactgagaagtcatgacttggacaaagtacctggtagaatctgccaacaattagagattgtggaattcttattttctcatggaaagcaggatggagtgaaacagtgagagatcctgtttgtagttctgtgcagacaaacccagaaaccagaacgcagacacaccaggacgcaacaggaaaccacaaaggcctgagatctttcaatgtaaataggaagtcagagtttacttccgaacccacagtgccaagctgaagtgcagtgtttaatccagctctctacccagcccttccttgagcctgggcacagatgaaagatgatgatgccacctgggtaaaagcattcaaaaatgtttgttctgatcaggtcttggagtgagcttcttttgtttgtgctagtgaataatttgggacacaggtgcactttgcatttgaaagcgttaattggtctccttggttttccctgccatgatatttgaagccacatcttcctccacaaagtaattttaatccatatacattcaaaaagcacttgtcatggacagccgtctttcatataccccatctgtggacccctgggtccaggtgcagagtagtggaacattggtgatgcttaatatgtactctgtgttcattgcattgacatctgtaatctcatttgattactactattacactgggaaataattaataggatacgatcatcaccattttgaaataaggaaaatgtagtctggtagaaaacacatggatgttaaagttaggcagatctgtgttcatgtccaaaagacttaagctttcttaccagactgctttattttatgtagccagttgtttagagcattcactctgtgccaggtactggagagaaaatggtgagcagtagacctagactgtacagtgtagtggaggagatgaatactcagcaaacaattacaaaaatgtataattacagaccttgataagtgctttgctttcataccctgctgggggaagtataaattgggcagtcactttggaaaacagtgaggcattgtctgatcaatttgactgtgcacatgccctgtactctaccaattccattcctaggtaggaagctggagaaacaattgtacttgtgtaccagtaagtgcccagagacaagtaagtacaagagtattcatagcattattttttataatagctacaaatttgaatcaactcaaatttcatcaataatagcatgaataactaagttgtattatattcatacagtggtagacatacttaaaatgtaggaactacagctacatatgacaacatagatggatcaaacaattttaagtggaagaaacaagacatgaaagagatacatacagaattatttcattcatagaaaattcaaaaagaagcaaaaaagacaatgtcttttaaaaaatgcctacaaaagcactaagcttagaaaagacaagcaagggaataattaccacaaatatcaggacactggtgaattagatggcttggaattgcaggttgttgaggttaaaagatgctttcaggaagagcttgagggaactagcatttgcttctgaaggatacatgagtacttaacagtttttttaatgttcacataagttttatacactcctctgtatgtatgatatgtaagtgctagaaagcagagaagctatcagaacatagagccaagtgccatataatttgggtggtctagaaggcaaggcagtgatgtttgagctgggagattttgattaggtaactaagcagagagcctgacggggagggagtagggttgtgcatggcagtggtcaagagaaaaaatttgttcagaaagagagtacagaagaataagcagaaggaaattggcagctttggtgtggggcaagagagaagaatgctacaagtaaaggctggagaagcaaaaaggggtagcatatgctgggcttgtaagccttctgagggattttagtcttttatgtaagagaaactgaaaggttttaagcacagtggataagataattgaattacaaaggatggaaataattccagtttggagaacaaattggcaagagacctgagtggtactaggatactaggaaaccagaagaagactgggagtctgtgtgagagatgatatcatactaacttgtctcagattatggtgggggagatgagatgtcgatatattggaaagatgtttagaagataaaatcagcagcacttccttggtgtgaaaactgttgaggctgcagggcaaacacaatagaggcttattaggtatctcacccaaactcctaagatgagctgctccccagtgagtagagatatctggagagagagcagtagtcgttcaggcattccttggacagactggattcactagagagaaacatttttggtttgcactgtcagctttgtttttaggttgttttaaatattttacccttgtctcttatgaaaggtcttctcaagaagtagccatgtggacacgatattgctttggtagtaattctgccaaaaatgcctgacttgaatctgatcatgaggaaatatcagaaacccaaattgagggagattctataaaataacttgcctctagtcttcaaaaatgccaaggtcataaaagaaaaactacaggaagatcaaaggagacgaaagagacatgatatctgaaggacatgtgtgatgctgaattgaattggagaaacttttttaaaagttttattgtaaaggacatttagtggataatagatgacattctaataagatcagtagattagataatagaattgtatctatgtatacttcctgataattgtattatggatatataagagaatatccttgttattataaaatacacactgaattattgaatattttggagtaaaaggacattatgtctgccactttcaaatggttcagaaaaactacatacatatacacatatgtgtgtgtgtatatatatgttcatatatatacacacatgtatgttcatatatatatgtttatgaacaatatgtgaacaatatgtttatgtaaaacattgggaaaatctaggtgaatattatacaataattctttgttctatttttacaactatttcataagtgttaaatcatttgtaataaaacattttaaaagtgttttttaatagaaggaagtagtcatgtgaaggccatgcttatatttggcataaccatgagttaatataccactcattgtgccccatataaaatcccacttgagaatttattttagaatttaccatttggaaaagtgttgttcaatctcaaatggtgtattttcatctttccagtaataaaagctatataatggattacatttttcttctggccctggaagccaaggaaactcagagttaaaaatttaacactcaagctaaactgttgagccttctactacatagcatatttccattcttctttttgctgtaattgtcttgcattactgtttctagtcactctgtactatattatctgtgtatgtatgtttgtgggagtggtagataaaatatctcaaactctttgtattagtttcctatggctgctattgtagcaagttgccatacacttggtggcttaaaacaacacacatatattttcttatggttctcgagactagaagttcaaaaccagtttcactcagccaagatcaagtgtcaacagggccgtactccctctggaggttccaggggaaaacctgttccttgcttcttccagcatctggtggctgctggcattccttggcttgtggccacatcattccagccttgccttctgtggtttcattgcctcctcctcatctgtggtcacatctgcctctccctgtctcttacaagaacagttatgattgcatttaggccaactcaaataatccaagattgtctcctcatgtcaggatccttaatcacatttgtgggtcctttttttttctttcttttttatttttttgccatatgagtaacattcataggttccagggatttgaacatggtgatcttttcaggagccattattcagcctaccataccctttatggaaagaagtgacatttaaatgtgttttttaaggtacataaaaataaagtattaatttatttggaaaatataaagtacttctgcactctgtgtatagtgaaggaacaaagataaaagaaatcaaatttctgtttagtgatttttcattgcttttatgaattacattgaattttctattatatttcctatttggttatttctggaatagagaaatatatttgactttttttagaaagtaaattatttgttaatatgaatgaataatacctgtgagatttccaatgaaaagaagcaaagttttatacatcaaatttgcttccaaatgctaatatactaaaatcagtgctagttatgtttaatataggttgctgagaaaaatagttatcttttatggtttttaaaaagtgtatgttaatttatttttatcgtttatttcttactgacaaatgcaaattgtatatatttatggggttcaatgtgaattttgatatactatatattgtaaaatgattaaatcaagcttattgacatattcattacctcacatacttttttgtggtgagaacatttaaaatctactctcttagtaattttcaaatatacaatacatttttattaactatagtcaccatgctgtgcaacagatcttcaaaacttattcctcctgtctaacccaagcttagtacaatttggccaacatctctgctttaccccttggcaaccccaccctaataaccaacattctactctctacttctatgagttcaactttattaagctttacatataagtgaaatcgtgcagtatttatccctctgtgtgtggtttattttacttagcataatgttctccaggatcgtctgtgtcactgcaaatgacagaatttccttcttttttaagactgaatagtattttgttttgaatctatggcacattttcttgatctgttgatggacatttaggttgatttcatatcttggcaattgtgaataatggtgcagtgaacatgagagtgcagacatctcttcaacatattgtttgcatttcgtttagatacacccagaagtagaattgcctgatcacatggtaatttgtcatttttttgaggaaactccatactgttttacaaaatgcctgtactagtttacattcccacagatttttaaaaagttaatcttctacccactaaccttgctaaactttcttatttttttaaaatgtgcatgtattatatatgctctgcatgcattataaatgttacagtaatttttaggtacaacactaaatattctcatatggtttggatggtcagtgaaggcttctgtaaggaagtgatatctgtgatattttggttaggaaaaaagtggtccaaacatagaggacagtatgagctatatatacaagatcatatcatctgcaaattttgcttctctcttcccttctttatatcttcttttgctgttaatttttgtctaattgtgtttgctagggcctctggtattatgctgaacagttgtggtgataaaaagcattctcacatgcacacatatgtttattgcagcactgtttacaatagcaaagatttggaaccaacccaaatgcccctcaatgatagactggataaggaaaatgtggcacatatttaccatggaatactatgcagccataaaaaagaatgagttcatgtcctttgcagggacatggatgaatctgggagccatcattctcagcaaactaacacaggaacagaaaaacaaacactgcatgttctcactcataagcaggagttgaacagtgagaacacatggacacagggaggggaacatcacacactgaggccagtcggggggtagggggaaaggggaagggagagcattaggacaaatgcctaatgcatgcagggcttaaagcctagatgacgggttgataggtgcagcaaaccaccatggcacatgtatacttatgtaacaaacctgcacgttctgcacacgtatcccagaacttaaagtaaaataataaataagcattctcatcttatttctaatcttagagggaatgtatataaaatttttccagtgagagtgatatttgctagagattacagacagacagacagacagacagacacacacacacacacacacacacacacacacacacatttccttatgaaattgagtaaatgatcttccaaagcattcagggcaaatagcagcccatgttttaataaccctaagaattattttatatgatagtcccattccatggccatggagctctgtcactatactgtgaacttctctatggcaggaactattcattcaccattgtatccttactctgaacttctctagggcaggaaactgttcacttgccattggatactcagtatctagcacaatgcctgtaagttaggcattcactatccattcaatgaatgaatggatggatgaacgatagttaatatctgtttcattctcaaagctagcaaattctttttaagcatgagccaaaaatatcactactttccattttctttattcaatgagttgagctcattttgccgccatccttacctcctcccagcacctggtacagtcagtagtcatttgacatatgaaggaataaatgaatgagtcaatcacagagcattctgctgccagttgatagactttgcccctaaagattctgaactttatttgaactgaagccaggtggttaaagatgatttaatcaggacaaaaataaaattctactctctttaatggaataattgcttattgcattttcttcttaaagttggccattcatctccttaaagttggccactgtctttcaatttatatatgttgtccatgaattattgaaagtgattattctgaattaagccaaaattattcacaaagaattgtcttggtgtgtgactagagggttcagaattccagtattacttggagagaggggttgggtatagtggtaaacttaaagtttacctgcaaaaaaacagtgttgaatgcctgagtatggcaaatccaaaaagtaagtatttggatttattggtgaataagggagagaggttggttatcaaaaaaagagcagttaagtaggaatatgttagtagttttaaatactttatgatggctctaatcatatatgtacttcctatttcaaaaggtatttcatttcataagttagagtaacacccaatattagaatttcagtgtccagaaattgattaccttctcctgacttggaactctctgctcaaaagcctttgatgactcttcgttgcctggagagtaaaaatttatttagccctagccagcgctgtccacctgcactcctaccatacacactctctgtttcagccacatgtaacagaatgttaccatagggctcttcctatcttggaggtttcgaacaggccccagagcccagaccacctatgcagagcttgctaaaagattgtgaaacttgtgctaaacgtcaccctgaggatataaaagaggtggaagaagtcagaggtcaagactaaggaaagaggctgaggttgatgattgtatctgagagagtagagcaaaaagtgaagacaaggaaaaggtgtgtgggtccagcacaagggagccagctggggatatcttaaaaggaatcccatccataaggttcaactagaggagcagaatgatcccagagcaggacttgatcacctgaaggccaggactgaaagggagttgtgggcagaccactggacggagagatagccagctttggacaggcaccacaccctgaggacataatgaagccagataacaacgtatatgcatcaagtgagaccttccccaggcaccttgacccctgtatggaggaaccccaaaacacccagctgtccagcaggaaaaagtagaaggaggagagagagaagccagcaagtccccttcttgaagtgtgtatacgctaagcctgaaatatactgtagctgcagaagggagaattttcaattagccaaaatgggagttttaattattataatagagtgtacatatttactgctagaagctggcctgaggacttttataattgaagagtgtaggaatacagtggatccccctgaaatttcatcccaggaatgaggaagaacagttcgtggaacaaatttaccaaggagaagagaatagagctgttttttcctgcacacccataatggtactacagatccttcaataaaccagaacacacacaaggctggggttgtcctctcgtccctctcctacatcagcaaatctgtctctacgtaatcatgtaagactacagcttgctttaatagctcccatcttaagaatgggagggggagagcgaggtagaagaaaaaccttgaccttatatttcgccctcctgttcccccatttattgtctttgccacacagcttctcaagtgctgtataatcccattcctcccctcccactctctcttgagcccaatcagacatttgtacaaacttctccatgaaaataacccttgaccatttgtttcgggctcctgtgaccagggtctgtgttcctaaatccagtagtcctcattcagatcgttctgttggcagcattgggcacagctgcgccctcccttctcaaaacccctcacttgcatgtagttgactctttggtcccattgtctaattgctctccatcaccagtttctaaattttggaaggcgttaagcctctgcccaagacctcttccctgcccatttccccttgcttcttcagtgacctcattaagactcaaagctttaagacaccatctgtagagtatgacctccaaacatatatctccagcctgaccctgatatcctaatatatttaatcacctactcagcatttcttcttggctttctaatagatacctaaaatttagcatgtcaaaagcctaattcctctcagcccccaggaaatctcctctcactgtctttcctagaacatgaaagaacaattctattcatacacttgcctatgtcaaaacaccttgaaaacatccttcatccctctctttttctcatattgtgctccagtaaatgctgtcagttctactgatggaatccaccaatgtggaccacctagttcaagcagttgtgctccctctcttggtttattgacacagtctcctgactgtctccctgtttttaccactgggccctggattctgttctcacagcagccagggtggcctcttgaaaacttgcctcagattatgtcattcctctgctcaaaacctttcaataattttgcatttcactgagaattaaagccaatgtccttaaaaataaaagatctgttcctcttacttttcagctctcatcttctgtcccctttctcactgttcacaccactgcagctgccctgattctttgctgttcatgtaagatagcaagcacacctctgccacagggcctttgtacttgctcttatctctccacctgcatcactcttaactgcatgcttcactcactcactcccttccagtctctgctgtaatgtaacctcatcattaaggtctatccagaccaccctatattaaaataacaacacttgccttcactcactgcttaacctctctatccttctttatttttctacacacagttatcgtcctacgctccactggactgtaagttccatgaagacagaactttgttttttcaccactgaatccccagccccttcaaagtgccttgcatgtaatagactctcacaaatagttctcaaatggagggtgcttcctaacttgctttagcctttccacatgctgttctttctggcaagagttgcttccctttaccccccgccttgttacaccccagccccaagtgagcctgttagaatcctgtgcatcctctcagactccagtttcatacaacctcctctgtgacaccgcgtgagtcagatttaattcctctttccccagaactcaaagttttcagttttattttgctttaatcaagtttgtacccttaaccactacattgtgtgtctttcagactcttgttctttcttgattttaaggctttagagatgacaaattcagcaaccgcaggtccttctcatgttgtagaattgtaaagtagctgttttttaactgcatgcaactgtatgaatcctaaacctagaattttcaatccctctattctaccgcatgtattttcatttctccttctttttctactacttcctcttcatcacaaaaaaagtcccaagcacatattatatgttattcattttcttcaaacatctttcacttaatagtttagagaaaagcccatctattccattgagtgacctttcctatgactatagaaagtggtcagtttttctgtcccttggcctgtttagcagttgaaatgcacctgacagtttgtattacaaagctaaatggtggtggccagtaaggagtttgataaacttttcatgtaatttatacataggggaaatgacactggctgttgagcacatgaagtcattttctttcttccctgaaatgctttgggggagaagaccaatcagtcatcttagtgctgcacctccatagtgagatctgcattaggtttttgaccaagaagacagtaatattttatgacaaaacttggaaaagttaaaaattcacagatgaacaaatgctttttctcattatttatctttttattctttcctatttttattccctgagaccatttgcatgaggggaaatttaatcaggatccctagttgagaacatttctattggagaaaatggaacctggatatcaaattatctcacaacttcttctgagtgacatacactgaattttatcttaaatagcttgtttagaagctattggtcaccagcttaaatagcaccttttcattataacattgcttctgttgttgcattcataacattttatttgctaaaaatgtattaactgtgtctctcccatcagttcttgagctttggagggctgtggctgtggcttattcatctctccatacccaaagactagcatataatagacatacagtaaaaatggaaagactatattgagctgcagtctaccctgtccaattaaaagtcagtggacatttgttgaataactgctatgtgccaggtattttgaaatatttggtgttatttaatctttatagtgaccctaaaatgcattgttatcccttagttatagatgagagaaagtacataagtggtttacccagctagtaagtagcagacctgtctttgaatgtaacccatgtaaagcaaaattttctgtcctttctcctttattagagcttaagtgatctttcagggaccgatatgtttagctatcaactctgtaataacatgaaaaatatttatttagctgtgatcatctatttgataaattgtcagagtgataaacccaaaaggagctttaaagatcattcagcctgtaatcccaaggtggaaagatcacttgaggccaggagtttgagaccagcctgggcaacatagtgagacccttctctcttaaaaagaaaaaaaagctggatgtggtggtggtgggtacctgtagtcccagctacttgggaggctaaggcaggaggatcacttgaacccaggaatttgaggctgcagtgagccatgatcatgcccactgcattccagcctgagaacagagcaagaacttgtctcaaaaaaacccccagaaatcatccaattcagtattctaatttcagatgcaaaaattgagtcccagaagggaaaaggtcttggccattatttcttctgtcagttggaatcatgttattcttctccttttgcactgtccttacagtaattacttttaaatccttagcaagtctgattatcccctgcatggtatggcctgtgatgacctctccagcctcacgttgcactactacccctcacagtttctgtccttcatctgtggcatagaacacactctattctctgcttcctgtccctctgcctatagcacccttccctctactccttctcctaagtcctacttacccttcacatttagctcaggcatctaatatcctctcgctggaagctttcagactagattaggtggtgtatctatgtgcatccatggtacatacctgtcatggtgcgtatccttctgtgtttgttgttagttaactggcttatgtcttccttgctgtgaattccttgaggacagatattgcggagcattcatttctatatcaccacggcctcataaagctcctcacacaaagtcagctttcaggaaattttgaaagaaataatcactcacttggattcaggtctgaagtgaggcaaacattagagatgtgatggtgttgaatactcatcgtttttgatattttgaaggctctcccatgcttgaggatccaaaggagtttaccattttgtaatgccacagatgtgtactggtgtctgtaatgctcaggtcccatccttgagcttcaccaggaacatcagtaggaagatctggcacaggctatgtggagagcctcctcaccccatgctgatgatctcatagtatctggtcactgccactaaggaaaaataaatgcctgcaggtccttttataccatgatgtaactaactataggaagtgtccctatgcaacatctttcatcttacctgaatcaaagcttcaatgaatgaagttctcttcggcccatcatcctgcaagaaactggtaggatgatggcattgggaagctataagggtgattctgacttctctgaaatgacatacattccttgtcaatattatgtcagcggaaaacttgctagccttagaaataaaaataaaggtcttatttttacattgacactttcaatctaggtaaacttgaataattcatttgatatttcagaggcttcatttcttcatctaagaacatgaggatcttttctatttatggaggtatcttgaggattggttgaagtagtgagcatgaaaggtctctagaaaaccttggttgtttagacatgttttagggacattgaaatggactgcgcatggaggaagcttcatggggggcacacctgaggggcatttcctcaatgggagagcacctttgcccttcacaacattcacacacccctcctgggtattggtgccaggctagtgccctgatctgagtccacctctgaacagtcaccctcaccaagataccccgagccaggagagccagtggagcacatctaagccaaagatgtcaaagagagtgaggagtgagaggtccaaattcaactggagaccctcaagatgagacctgttttgaatgagagagagatgaccgtgcagggtggaagcaggtctgatgcagctgacagctaaccactgctgctcggaagtgtcgacggctcaccacttatgtgttggcttttgttcctggactactcaggtggtttaaaagaccaggtgaaattgaggcaataatgaatagcttaccaaccaaaaaaagtccaggaccggatggattcacagccgaattctaccagaggtacaaggaggaattggtaccattccttctgaaactattccagccaatagaaaaagagggaatcctccctaactcattttatgaggccagcaacatcctgataccaaagcctggcagagacacaacaacaaaaaaaaagagaattttagaccaatatccctgatgaacatcgatgcaaaaatcctcaataaaatactggcaaaccgaattcagcagcacatcaaaaagcttatccaccatgatcaagtgggcttcatccctgggatgcaaggcttgttcagcatacacaaatcaataaacataatccagcatataaacagaacaaacaacaaaaaccatatgattatctcaatagatgcagaaaaggcctttgacaaaattcaacaacgcttcatgctaaaaactctcaataaattaggtattgatgggacgtatctcaaaataataagacctatctatgacaaacccacagccaatatcatactgaatgggcaaaaactggaagcattccctttgaaaactggcacaagacaaggatgccctctctcaccactgctattcaacgtagtgttggaagttctggccagggcaatcaggcaggagaaggaaataaagggtattcaattaggaaaagaggaagtcaaattgtccctgtttgcagatgacatgaatgtatatctagaaaaccccatcatctcagcccaaaatctccttaagctgataggcaacttcagcaaagtttcaggatacaaaatcaatgtgcaaaaatcacaagcattcttatacaccagtacagacaaagagagagccaaatcttgagtgaactcccattcacaattgcttcaaagagaataaaatagctaggaatccaacttacaagggacgtgaaggacctcatcaaggagaactacaaaccactgctcaatgaaataaaagaggataccaataaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagctcatatggaatcaaaaaagagcccacattgccaagtcaatcctaagccaaaagaacaaagctagaggcatcacgctacctgacttcaaactatactaccaggctacaggaaccaaaatagcatggtactggtaccaaaacagagatgcagaccaatggaacagaacagagccctcagaaataataccacacatctacaaccatctgatctttgacaaacctgacagaaacaagaaatggggaaaggattccctgtttaataaatggtgctgggaaaactggctagccatatggagaaagctgaaactggatcccttccttacaccctatacaaaaattaattcaaaatggattaaagacttaaatgttagacctgaaactataaaaatcctagaagaaaacctaggcatcaccattcaggacataggcatgggcaaggacttcatgtctaaaacaccaaaagcaatggcaacaaaagccaaaattgacaaatgggatctcattaaactaaagagcttctgcacagcaaaagaaactaccatcagggtgaacaggcaacctacagaatgggagaaaatattcacaacctactcatctgacaaagggctaatatccagaatctacaaagaactcaaacaaatttgcaagaaaaaaaccccatcaacaattgggtgaaggatatgaacagacacttctcaaaagaagacatttatgcagccaaaaggcacatgaaaaaatgctcatcatcactggccatcagaaaaatgcaaatcaaaaccacaatgagataccatctcacaccagttagaatgccaatcattaaacaggaaacaacagatgctggagaggatgtggagaaataggaacacttttacactgttgttgggactgtaaactagttgaaccattgtggaagtcagtgtggcgattcctcagggatctagaactagaaataccatttgacccagccatcccatcactgggtatatacgcaaaggattataaatcatgctactataaagacacatgcacacatatgtttattgtggcactattcacaatagcaaagacttggaaccaagccagatatccaacaatgatagactggattaagaaaatgtggcaaatatacaccatggaatactatgcagccataaaaaatgagttcatgtcctttgtagggacatggatgaagctggaaaccatcattcttagtaagctatcgcaaggacaaaaaaccaaacaccacatgttctcactcataggtgggaattgaacaatgagaacacatggacacaggaaggggaacatcacacaccggggcctgtggtggggtcgggggagtggggagggatagcattaggagatatacctaatgttaaatgacgagttaatggatgcagcacaccaacatggcacatgtatacatatgtaacaaacctgcacattgtgcacatgtaccctaaaacttaaagtataataataaaaaataaaagaccacgtgaaatgagcaggcttgggcaattcaaagcctggaaaaaaagtggtagagagggggatttggggaagagtagatagacagaatgaggtgacacattgaaggacttcttagagaaatgcatttgaggaagaagcagccaagatggccgaataggaacagctctggtctacagctcccagcgtgagtgacgcagaagacgggtgatttctgcatttccatctgaggtaccgggttcatctcactagggagtgccagacagtgggcgcaggacagtgggtgcagcgcaccgtgcacgagctgaagcagggcaaggcattgcctcactcaggaagcacaaggggtcagggagttccctttcctagtcaaagaaaggggtgacagatggcacctggaaaatcgggtcactcccgccctaatactgtgcttttccaatgggcttaaaaaatggcacaccaggagattatatcccgcacctggcttggagggtcctgcacccacggagtctcactgattgctagcacagcagtctgagatcaaactgcaaggcggcagcaaggctgggggaggggcgcccgccattgcccaggcttgcttaggtaagcaaagcagcctggaagctcgaactgggtggagcccaccacagctcaaggaggcctgcctgcctctgtaggctccacctctgggggcagggaacagacaaacaaaaagacagcagtaacccctgccgacttaaatgtccctgtctgacagctttgaagagagcagtggttctcccagcacgcaactggagatctgagaacgggcagactgcctcctcaagtgggtccctgacccctgacccccaagcagcctaactgggaggcaccccccagtaggggcagactgacacctcacacggccgggtactcctctgagacaaaacttccagaggaacgatcagacagctgcattcgcggttcacgataatcccctgttctgcagccactgttgctgttacccaggcaaacagggtctggagtggacctctagcaaactccaacagacctgcagctgagggtcctgtctgttagaaggaaaactaacaaacagaaaggacatccacaccaaaaacccatctgtacgtcgccatcatcaaagaccaaaagtagataaaaccacaaagatggggaaaaaacagagcagaaaaactggaaactctaaaaagcagagcacctctcctcctccaaaggatcgcagttcctcaccagcaatggaacaaagctggacagagattgactttgacgagttgagagaaggcttcagaccatcaaactattccaagctacagaaggaaattcaaaccaaaggcaaagaagttgaaaactttgaaaaaaattcagatgaatgtataactagaataaccaatacaaagaagtgcttaaaggagctgatggagctgaaagccaaggctcgagaactacgtgaagaatgcagaagcctcaggagccgatgtgatcaactggaagaaagggtatcagggatggaagatgaagcgaatgaaatgaagcgagaagggaagtttggagaaaaaagaataaaaagaaacgaacaaagcctccaagaaatatgggactatgtgaaaagaccaaatctacgtctgattggtgtacctgaaagtgacggagagaatggaaccaagttgaaaaacactctgcaggatattatccaggagaacttccccaatctagcaaggcaggccaacgttcagattcaggaaatacagagaacgccacaaagatactcctcgagaagagcaactccaagacacataattgtcagattcaccaaagtcgaaggaaaaaatattaagggcagccagagagaaagggcgggttacccacaaagggaagcccatcagactaacagcagatctcttggcagaaaccctacaagccagaagagagtgggggccaatatttaacattcttaaagaaaagaattttcaatccagaatttcatatccagccaaactaagcttcaaaagtgaaggagaaataaaatactttacagacaagccaatgctgagagattttgtcaccaccaggcctgccctaaaagagctcctgaaggaagcactaaacatggaaaggaacaaccggtaccagccactggaaaatcatgccaaactgtaaagaccatcgaggctaggaggaaactgcatcaactaacgagcaatataaccagctaacatcaaaatgacaggatcaaattcacacataacaatattaactttaaatgtaaatggactaaatgctccaattaaaagacacagtctggtaaattggataaagagtcaagacccatcagtgtgctgtattcaggaaacccagctcacatgcagagacacacataggctcaaaataaaaggatggaggaagatctcccatgcaaatggaaaacaaaaaaaggcaggagttgcaatcctagtctctgataaaacagactttaaaccaacaaagatcaaaagagacaaagaaggccattaaataatggtaaagggatcaattcaacaagagctaaccatcctaaatatatatgcacccaatacaggagcacgcagtttcataatgcaagtcctgagtgacctacaaagagacttagactcccacacaataataatgggagactttaacaccccactgtcaacattagacagatcaacgagacagaaagttaacaaggatacccaggaattgaactcaactctgcaccaagcggacctaatagacatctacagaactctccaccccaaatcaacagaatatacattttttccagcaccacaccacacctattccaaaattgaccacatagttggaagtaaagctctcctgagcaaatgtaaaagaacagaaattataacaaactgtctctcagaccacagtgcaatcaaagtagaactcaggattcagaaactcactcaaaaccgctcaactacatggaaactgaacaacctgctcctgaatgactactgggtacataatgaaatgaaggcagtaataaaggtgttcattgaaaccaacgagaacaaagacacaacataccagaatctctgggacatattcaaagcagtgtgtagagggaaatttatagcactaaatgcccacaagagaaagcaggaaagatccaaaattgacactctaacatcacaattaaaagaactagagaagcaagagcaaacacattcaaaagctagcagaaggcaagaaataactaaaatcacagcagaactgaaggaaatagagacataaaaaacccttcaaaaaattaatgaatctaggagctggttttttgaaaggatcaacaaaattgatagatcgctagcaagactaataaagaagaaaagagagaagaatcaaatagacgcaataaaaaatgataaagggaatatcaccactgaccccacagaaatacaaaccaccatcagagaatactacaaacacctctactcaaataaactagaaaatctagaagaaatggataaattcctcgacacatacaccctcccaagcctaaaccaagaagaagttgaatctctgaatagaacaataacaggatctgaaattgtggcaataattaatagcttaccaaccaaaaagagtccaggaccagatggatttacagctgaattctaccagaggtacaaggaggaagtggtaccattccttctgaaactattccaatcaatagaaaaagaggttatcctccctaactcattttatgaggccagaatcatcctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgtaaggctggttcaatataggcaaatcaataaatgtaatccagcatataaacagaaccaaaggaaaaaaccacatgattatctcaatagatgcagaaaaggcctttgacaaaattcaacaacgccttatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctgtctcaccactcctattcaacatagtgttggaaattctggccagggcaattaggcaggagaaggaaagaaagggtattcaattaggaaaagaggaagtcaaattgtccctgtttgcagatgacgtgattgtatatctagaaaaccccatcgtctcagcccaaaatctcctcaagctgataagcaacttcagcaaagtctcaggatacaaaatcaatgtgcaaaaatcacaagcattcttatacaccaataacagacaaagagagagccaaataatgagtgagctcccatttacaattgcttcaaaaagaataaaatggctaggaatccaacttacaagggatgtgaaggacctcatcaaggagaactacaaaccactgctcaatgaaataaaagaggatataaacaaatggaagaacattccatgctcatgggtaggaagaatcagtatcgtgaaaatggccatactgcccaaggtaatttatagattcagtgccatccccatcaagctaccaatgactttcttcacagaattggaaaaaactactttaaacttcatatggaaccaaaaaagagcccgcatcgccaagtcaatcctaagccaaaagaacaaactggaggcatcacgctacctgacttcaaactatactacaaggctacagtaaccaaaagagcatggtactggtaacaaaacagagatatagaccaatgtaacaggacagagccctcagaaataacaccgcatatctataactacctgatctttgacatacctgagaaaaacaagcaatggggaaaggattccctatttaataaatggtgctgggaaaactggctagccatatgtagaaagctgaaactggattccttccttacaccttatacaaaagttaattcaagatggattaaagacttaaacgttcgacctaaaaccataaaaaccctagaagaaaaactaggcattaccattcaggacataggcatgggcaaggacttcatgtctaaaacaccaaaagcaatggcaacaaaagccaaaattgacaaatgggatctcattaaactaaagagcttctgcacagcaaaagaaactaccatcagactgaacaggcaacctacaaaatgggtgaaaattttcgcaacctactcatctgacaaagggctaatattcagaatctacaatgaactcaaacaaatttacaagaaaaagcaaccccatcaaaaagtgggcaaaggacatgaacagacacttctcaaaagaagacatttatgcagcaaaaaaacacatgaaaaaatgctcaccatcactggccatcagagaaatgcaaatcaaaaccacaatgagataccatctcacaccagttagaatggcagtcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccatcccattactgggtatatacccaaaggactataaatcatgctggtataaagacacatgcacacatatgtttattgctgcactattcacaatagcaaagacttggaaccaacccaaatgtccaacaatgatagactggattaagaaaatgtggcacatatacaccatggaatactatacagccatgaaaattgatgagttcatgtcctttgtggggacatggatgaaattggaaatcattattctcagtaaactatagcaagaacaaaagaccaaacaccgcatattctcactcataggtgggaattgaacaatgagaatacatggacacaggaaggggaacatcacactctggggactgttgtggggtggggggacgggggagggatagcattatgagatatacctaatgctaaatgacgagttaatgggtgtagcacaccagcatggcacatgtatacatatataactaaccggcacattgtgcacatgtaccctagaacttcaactatagtaataataaaataagaaaaagtaaaaataaaaaaataaaagagaaatgcatttgaggcaaagcctcttttcctctgtgtagaactgatgatggggtaaaatagaagaaaccacacatatacaccctgatgctgatctagagcccagtagctccagagagctagggaaggccccactctgtgtgggacatttatgtggcctgtgaccacaagaaccgtcagcagcagaacaggtgatgagcatttgttgagtgaatcaaaacagaaatgaaccactgtgcaggttcagctgggttcccctgaatgcatccttgagagggtcctcagtgtgtttgtggacatctagttacaaggcaatcaacatataaatggggatcatcttcccatcgccttcaagaaaaacagaattctatttctgcatgtcatgaagggttctttaggatctgacacatacctgcccttccactcagaggtctgacattttattttcacatctgctccgtggctgcctgtctttgggcaagttacatgaccctgctaatcctcagttccctcatctttaaaatggggataaagatacctatctcaccggcttgtgataattataaaatgagaaagtgcaaataaatccactgtcttttcatcacacatatgccaatccagcatttgtgatttttaaaaattcttactgtatagtttacctttcagccaaaccatgccttcttcaagctgatattatactaagaacttttatctttattgaggtgcttatcagaatatcttgccattcttgcattaactgttagatatcccaactgcatgggaaacaaggacaagcacagtatctttttcatctctctttttcacaggacctgacacatagaaggtgctcagctgaatgtttgccgaagggtcatgtgaagtgtctctgttctggagaatcttgattcccaagagccccagataattcctggcccctactctcctatcccatattaggcagctactctgtgtcagaaactaagccaggggctctgcacaaaaggctgtagttcatagctctgcaaccctggggggcagctattatataaacttcttacaacaattaacacaaatccctcaagtgtaaacatctgatgtctctttaccttcaacccactagggacacaaattgagaacccagcaaccctcatctggcatggaaaacttaagacctggatttcttccacctgcacctgctgcgtttgtagccatcccctcccctcttccagcacctttgttgtttgtatcttaccaggattaaccatactagtctggactctgaactcagaaacatgtagattaaacatttcctagcttaaaaaaatagagtgcagaaagttaaatagttagctctcacatgttgattatttactatgtgaaggcagtatgtagggtttgtctaacattgcctccaattttcccaaatatccggtaaggtgaatattcttgtctgtcttttacacgggaagaagccaagattcaagagggcctcataacttgctgcatggatctgtgattcctgacctgggtacaccccaacactgcttcttcctggcaccaggcacccaaggaatcagttccactagcccccacgcctcagcaaccagcactaggcatggaggggtgcttcctcccaccaaggctgagtgctcagtcacaccctatgagagcaagccaatgaaatggaaaaatagctcttactcctgactctgacatctgccctgcaggtgagagccaaattctcaaattgccaggccaatggcaaataagcccacactatgcacagagggtatcaacacaaagagggttctgtgggaattcacacatcctggaagccaggctgaccctggtagacagtttcattttatcttgtctcagccacatgatgagtggagagagagaaggaaagtgcacagatctccagaaatggggtttgggttcactcttgagaatacccctgggcagtactctgacccttgggcccctctctgtaaacacacaagaacagctaaaatgtctggaaaggggaagggctggttccactgatgcccctgcattcattgagtttcctgcttcccaagtagctgagaggcagctggatataaaaggaacaggctttggagtcagacccagatcaaatccccattctgctacttggtacctgtaggacaatgagcaaggctttgaccttctgtgagccatggtttatctgtaaactaaaggaaatggtagattatcatgaaaattatagataagaatatgaaacagcacatagtagctgcttggcaaatgttagttgccttccctcccttttcccccactgcattcatttgtaatgcctttttttaaaaaaaaatgacagtaagagcaattataattggcacaggttgctttatgagctaaatatgttacagatcaataatacacaatctctggcctggcgcggtggctcatgcctgtaatcccagcactttaggagaccaaggtgggcagatcacaaggtcaggagttcgagaccagcctagccaatatggcgaaaccccatctctactgaaaatacaaaaaattagccgggcttggtggtgagcaactgcagtcccagctactcgagagactgaggcagaagaatcctttgaacccaggaggcagaagttgcagtgagccgagatcgcgccattgcactccagcctgggtgacagagtgagactccatctcaaaaaaataataataaaaaataaataaaaaccacaatctctatttaagccactctcacaggactgactgtaccctatatcatgtcatatatttgacagacagttgcttttcttccttttattcttctaaagaagtccagatgagccccagatacaggttcataccctagatagcctattccaagggttaaaatcaggcctgcttcacatcgaaggcattttgttatgatctgttcataacaaaagctgcctcctggctgttgcctgcagctgaatactgttactctgaagccatcatttcatttgtttctgattgttctgcagtgtttacataccttacatattagcgtgatcttttatagagtacaggcagaggttaagccctcccggatccactttccctctgagggctctttcttcttttttactgtcccttgcctctgtgttacaaaccatttctcttttatagaaattcatttaaatagaaaaacaatttttaagtgttttcttttttttttaacatgaggctcacttaacatttttagaaaatgttgaatatggagaagagggaaaagataccaccaaaatgtgtgattttttttttcttttttcctgacataggaaaatcccattacctctcttgaatttaccaagggacatattccatttagggcatagaaggacctgggctgcctccagacctaatgtggaagaaggtgctgtctgcctgctatttccttgcttctccttatttcaatcttttttttttctccaaaaaaaaaaaaaagtgacttaggaaggatatggacttgtgagtcagatttgggtctaagtcttggttctgccctatgtgtaatcccaggaaggaacttgagttgattttctgaagctcagtttccttttccattaaaactgggagtgactcaggcttgcctagtatcttagctggaagaatgtgtgtgaaactggcccacctttcacagataggtcaccctgctgattgcagtggcttccaggcacccaggcctgggaaagattcacaggcctagtccagacctggcaggaaagaggctgtgagcagttctgcctgccgcagatgtgctggcacatgtaccgccgtgtgctgccccaggtaacatatcaggcagctagggaatgtaggctttcagaccctctctcttcagttctcttctgctgacttcctcccatccagccatcatactttcttaatcctctcatcaatcccctttgttatagagaagatggaagggttaaattccttcaccctcatcacttccactgatatttgataaacacctctcagttcataatacttttgcactcaagcaggggagctacccaggtgtctatggaaagttttgaattctttttgcctattcagtttagtcttctcattttctatctggccagaaatggagaaagtgttttgaaggtcaggattcttcaggtctagacttgtagggatgtatcctgaattcctctgagctaagcctgagaagcacaagtgggttctattgggaaacacttccaaaaggcaatgattgatgcttatgcacagaaattctgacttttagtaaaagatgcttggatataaatcaagcaggactctccttgcctttatacaatatgcggtaaacagggtaaatcctcaattttacttatgcccactgacagatcttacaagtagaaattaacccatctgagtgatcgtgttgattctttctccctcttctctagagccattataacctctgtaccctacttcagaattctaatcaagatagtgtcaagtcttttaaaaaaaagttaaacccccacatgagctccaatccataaataagaaactcaccctggcttgtatggaggtgatgatattaacacaggctacatttctctgggtcactgaatgtacccggcactgtaccaaggccagtaatagactgtgccacatttaatctttacagatctgtaagagaggtcttatttgtcccatttttcagatgaacaccccaaagaccaaggtcacacagcagagactctcggctggagactgccctcaggcatccttttaacggaactctaaagtctgcaggagggagccatttttcctaccagccagtttagaatcaaaaaagagcattggttttgccgtattagagaactaattcataattagtactatgctcactcctggaggatttgacagaaatagaagatatggttctgactcaggatccacctcactacgtgatgtcagagcaacagagctaagactgcaactgatgagtattgtgcagatggagcacgctacctcctcgttagctctctcccctgcacccactctgccccacccactcctcctcccttgcgtgatccatagaatagaccaatatgtgtttacccaccacagattgtttggattgtgaaaaatgcatgatataattttatatctttgaaggcacacagctctcagagctttcaaagctgaaaaccagtctgggctcactggagccagttaggcatttgtatatagaaggccaagtgtggcttcttgtctataggagagagaaaatgtggaggaacttttggaaggcttcagagtttttttggctattctctctctcttgcaaagcaatctgggtgcattaactataaatgaatgagaaacatatggattaaattttatctgtgatcacatatgagtttcaagaatgataaagaataaggaattcagtgtttaaggagtccagaatactttgcaagtaattcaggatattgcaggcaacatttggctgcctccctctatccaaatttgaggactgtttggtagggtgacagacctgctcagtgccctccccacccactcagattgctaaacctcaggagatacctgtggataggttttgtgtgtatcttgttttgctgagactgaaataaagagattgggtttctaggaaaggcaaactctatgagaacactcttaaccactttgaaacccccaaatagaagaggaaaatttggtaagcccgatctttattaaccatgtcttgcttacagataatattagatgtgttttatatcctattattgcccttaatgttagtgtcattgtcctgttaatgataatggtagccatgtcctgcacttgtgtagtgatctaatttacaaacaggtacacattacctgttaatacacattacagatgtatttgtagagatgtacacttacaacatatgcagagtatgttatgacaagctacaatacaggaattacagagttaagtgaagatgcaggcaggagtacctaacccagcattgtggtagaagtcagggtttatggaaggcttttcagaggagataacattgagttcagtcctacacatgttcgtttgtttgtttgtttgtttgtttttgagacggagtctcaccctgtcgcccaggatagagtgcagtggcacgatcttggcttactgtaacctccacctcctgggttcaagtgattctcctgcttcagcctcccaagtagttggtactacaggcacgtgccaccacacctagctaatttttgtatttttagtagagccagggtttcaccatgtcagccaggctggtctcagaactcctgacctcccagtgatctgctggccttagcctcccaaagtgctgggttatgcatgttcttaaaagaatatgaataagtaagtggctgggtgcagtggctcatgcctgtaatcccagcactttgggaggccgagacgggcggatcacttgaggtcaggagttcaagaccacctggccaacactggtgaaacccatctctactaaaaatataaacattagctgggcgtggtggcatgtgcctgtaatcccagctacttgggaggctgaggcaggagaatcacttgaacccaggaggcagaggttgcagtgagccgagattttgccacttcacttcagctgggggacagagcaagactcaaaaaaaaaaaaaaaaaaaaaggaatatgtataagttagctaggggaaagcgagagggagtgccctctaatcagtgagacaagaatttatgaacactaagagttgagaaagaaaatggcacaaggggaatttcaggttcacttaagtctgaggcctagcttatgatgggcttggtgcaataaaaatgatgggggcagaggattgggaaatgataacataggggatttcaggagacaaaaaggtaaaagctacatcagacagtcccatatgtcgtggcaagctgctcaaggactttagtaaggagaatgatagaattaaatttgtgtattagaaagatcattgtggtggaggtatgaaagattctctgagtgacgcttaagagagtacaggatggaggacactatttgggtcagggaaacgagtttaatccagtttcatcacccttgtaataatccaagcaagaaatgatgaagggctggactaacgtagtggcaatagttggaaacaggaagacttgtgtttgaaaaatatttgacagagcaccgtgacctactgtggggcagatgagagcgatgaatgatcaggaagtcaagaatggtatcctgagacagagatacttctgacatgtcaaaaatataacgtgccatccttcatcccagagctacagaacaagacatgtcgattagccatccaggtcaaaggttccatgtggagctcaggagcaaggcctgagtgtgggataaaaattgtcattgcacacataggactggatgagctgaccctaagagatgtaggcagtgagatgaacataggagagaatccaggagggaagagaaagaagagcctaccaaagagacgaagctaataatgagtagaggctggacctgcacccagctctttggacaccaaacttttccaccgtcccagaaagttgcagaattaagccatctgtggcttaacatgccttgagagcatactgtgtcctaggatctttatacacattaccccatctaggacttagacacagctctgtggttaatgagatgatccccatcgacagataaggaaactgagtctcaggtcagcaaatgacctaaccagaaatatccaagtttgtcagactcctaagtctgtgctcatgttactaaaccatgtttctgcctttaagataagatatggctcctcactatttcctgggagaggcagacattaacagctatttacaattcaatctgagaaatgtagaaataaaggtgaatgctgagagcccccattcataaacaaaattctctatgcttttttttttttttttttgtaccatgtggtgatctaggagttggctggattgtgtataaatggtttttctctagtaagacgatagcaccgtccatttggagggtgagatgagccaccatggaaatacccggtcccacacatgcctgtggctaccctctaaaattcccaacctggccggaggcactcaaaacaaaacctcctgttccctcccaggacgactggcgcctggagcctgccttttgcccctgccagaggcttaggccagcctcggagtgatggcgttgcagggaggcagaacaaacggagctggagcagctccccactctgagcccagtcatctctcccagaagaggtgtgagcaggcttctgggctttgtcaccacagggaaactcggctgacgggcacattgccttagatgaaactaagccaatggcatgcactcatggagccagcttgagcatagacaaaaagagaggcaggagcacatggaaagaggcttctaatcccagctccatcatttctgatctttatgatcctgggcaatttgcttaccctcttcatgcctgtgtcttcagctataatatgggctgactgtgtttgactctatagactgtcagggtaactctaagtctgaatgcaaatgtacacctacaagtcacttgatatctgagttatgccccagcccatactgaattccaagtccccctagattataaacttcgggaggacggagactacatcacttattggctctgatgtctgtctttctatatcttttcatgtttaaaacagtagtttgaaatcagtgtgtatccaataatatttactgaatacttaatcagctaatgtaagatgttttagatagtagccattaaatacaactcatgaagttgacagaaaaacccacaataatcttggccacaggttatggagcaaagcaagtactaggggtactaccaacagagcaaagtaagtacttcaagaagccccaggagttagcccaagacaatcccatgaagcccaggccatgtgagggcagagtctgtgttgaaatagctagctgaagagttctgattgaccagctgggctagaacaactcagcttcatgaaatcttagaaaacctcaaagacaaaagagatattaaatatttctagtccaatcaattgattttatagctaaggagagttagttatagagagagaaataagttggtggttcataatttggatcctgaaagccctcctcttctatttactagctatttgacctcctgcagcttctatttcctcatctgtgaagtaaatataataataggacctctctcattgggttgtcatgagtgttaaatgtgataatatatgtgaagaacctagaagagtctgtagcatatgataaatgcaaataactcttagcaatgactattttattatttctatatgatttattattataattgttaactgatttaaaggctcatttcagtgggttttttccccaaccataattgttttaaaattggatttttgagaatcagtaggatctgttgatgcaaaactatacccatccttcaaaccatgcgatcttttatttaaagtaaaatgcagaactttatatggggccccctgaaatcaaaatgtgtttacagcttcatgactctgagccttgtctacatgactgtttctgcccgggctgcccttcctctctgcccaagcaagtatgtcctcctcgttcaaagccttgcttcaaggtggccatctctgtgaaatgctcactcttttcccaggcagtgagttattccttcctttgggctcgtactgcactcctctcttacctttttgtagcacttgccatgttttgttgttatttttttatttctacctggctgccctgtcagattaggaactccctgaggtaagcgaccatgccacttcattagtagtagtagtaatagtaatagtaatattttgccttattgttatagctttattgagctcagtgtctgacatacagtatgcaaccaaagtttttattactgtttttgaagtttttataatgatatttatatcagacacaaagagtacaccagatgtctaagtacagtttaaacaaaataccaaaatgaacaccagtattcccaccaccaaacctgtgaaagagaatattgccaataccttttaagtgtaagtttttaactgtgtgagtaaataaatgttacttgttttcttaattttgcttagtgttttagctctttgaggtaattttgaatcttgatttgaacatgtcccataataagctatttttccaagtgttagcatctgaaaatataagcttttcttctgtatcatcttctactccattattaagcatattgattaaaccaagaccaaggacaaatctagagacccctttacatggttgtgattactattgcctgtggttgttcagccagtcacctgactattccatcatacaagcctcatttcaaggagagctaacgtttatttggtgtttaacatataataaaccattgatatgtgacagcttacttaatctttacaaaagtcccccagcattcatgcattcctcccattttggagttgaggaaactgaggctcagaaaggctaccttacgtaagatcgcctagctgagaattgggcagagtcaggactagaatcacgatgggcctttgtcccgacccatagtttctcttctgttgttcactggtatatcagggaacacttaatggaaactttttagaaatgaagattccctaacctacttgtcatcaaggccagaaggttatgttcagtttgagtaagtctgtgttggctctaatggcccttgctttctgctcttcaaaacagatgaaagactcaaagaagtaatggtagcctaaaattaagactataatttggcagagacaaatatagaacctgatgcctgactgctttcagtttttgtaacactgggcatgttatttaactctctgcctcagtctacatatctgtacaataggaataataacagaatttttaagtgatttaatacctgtaatatgcttagaatcaggcctttactaagtacacagtaagtctcaactattgttgttgttgccaacagtgccgttattactgggaagtcagtgtcctgcatggacacctgtcatcaatgtagtatgatgagctccccttctttagggtcatggagcagtctccaggccaagacagccatcagcatggaaggggctttcacaaaaagatttttaaatatttaggtttgttgcaaaagattaaacaacacataagtacacaagtgtacattctttctctctctctcaaaacaaactaggaattcctagattcttctaagaacacagggtttgagagtgactagaagtactctttgtttccttgctttacacaggatgtctgaggagaagcatgtgctattccagatgagtgggcacaaacagaggtcaactcaaaactttctccctggacagagccaagcaaaaccattctctgacatttctgagcagcaaagcagcaaagccacaatcttctaatgaagtcttgctgcagctgatgcagtaacatccccaaattgtgggacaggggatggggagaagggaggtgaagtgtatccttcctaagcaatttatgcatacaagtaaagagcattatcatagagtttgaggtcaacatctgcctcagttgaaatcccatcgtggtcatccatgtactaaccatagacaacttacacaacctcttggggactaatctgtcaaatggggccaagagttctggaggcaaggggctgcaagacacagaaagagatgacttggctttggctctacctgtgcaaaccctgggtcctaagtggtaatgaatatggactgcctcattcatctcaaagaagctctgggacttaggaaagcaatttctagaattggcacgtgataaaattttcactgggcaaagaaaggcagagtggtgaaaataagtaccagttagtatgctctccttgtggctggaacattcaccatagctcactcgtgcattctttctctctcatacacacaacactcacactcacccacctgaataatttccatgcatgttttaaatcttaattcatgtaccatttccttggagaagcattccctgtcacctagactgaattaggtacctcccttgtgtgctctcttactaccttttggctttccctcatttacttctcacagttggtaattacatatttgtgtaatgatctgattaatatttttcttaaggtagccagttgccccagtttggctgaaactgaggggttttccagaaggcaagactttcagcgctgaaactgggaaagtcctggccaaacctgcgtaattgttcactctggtctgcttccctctcaagatcggatgctctttgagtacaggcactatgctcttgttcaccatttatctctgtgcctggcacagacctggactgggaactcaggaaacatctgttaaccagtaaagaagtaaatgtatatgttaatctaagctgaacttacttttcttatgaaagcctatcttttttctccctgaaattattctattttgatgttaaaatatcccttttgaaaaactgtccttatttgacaaaatttaaagttcacaatgttatgctgtttttgttttttgccttccttcccccccttcccattttgtggttggaaatcctactgatttgaggaatcacttgtttagtaaagagagaaccggggtagctgaggtcaagacaaataaggtctgtccccatgctaaaatgctagtaatcacttctgtatcctctgggcctagcacattaccaagcacatagtaagggctgagtaaatatttgtgaaatatataaatgaatagattttctgcccagcctcaagacctgctggaatacaacttgtatgcctaactcccttttcttccctaccctctagctaaacatttctgtgaccataaatgtgacttcagcattccttactgctgaatagatgagaaacatgtaccactgcagatgaatgaacacatggtctatccccacccgttctagttcatctctttaaatgctttccttactgttgaagggactgctatggtctgttaaaaaataataataataataaaataaaaaattttaaaaaaatggcactatcttgattactgagagcacctctcttacccacatggctttgttcaagctcctccctctacttggaacacctgtttcactttagcaaaatcctactagtcttttcaaacttagcttatgtccctttctctaagaagccacctctgtacccttccacttgtcaaaagtaaaatgagaacaagttagggaaaaatttgaaagttttctatcttacaaaaagtaccaattgccatcagcaagacttcaagtggtaagaagctcaccttacggcagttacagtgcagtttatgaagcattaaggagaaagtattttgacctttttagtcattggctgttatgtattaacatttttttttcaggggaaacaggactgtttaaactgatttgtctatagttgattgatttaattttcctgaatcatgctgacaaggacctaaagcttatgttttaatttcatcaaatcatgctgacagggagataaagcttatgttttatgctttgtttataatgagagctagcaactcagggaaatcagaatgacttaagttttaccacttgactctgggcagttggccttggggtatatatctaaatggcggcctctatctttgtataatctttagtacattcctcacctcctgtgcccatccacaatattttgtattttgtctttaccatctcatgaaccacactatattctatttgtctatttttttgtatagctcctccactagatgggagcttcttgaaagtaagaactctgattcatctttgtgtccccagcacccaatagggggacaggattgctattaggtagcagtacatatttgtaaaaggaaagaaatctatcagttattatagtcccccaaatgctaagttacagacaaatagaaaaccttagtgacaaacaacagtagacatttatttttgctcacaagtttgttggttggctaggtgagtctgatgatctgggctagtcaatgctggtcacctacaaatatttgctgatgttacctgggttctttcatatatgtgggacatcacctgagacaactgaacagactcagctctgttgcacatctcctgtcacccagcagccttgtagggcatggtcttgtggccaagtttgaggagcgaaagacagaacagaagcacacagcccttttgagacctaggcttggaaaactgacccagtgtcacatctgcctcattctcttggcaaaacaagtcacaagactggcatagattgaaggggtagggagatagacccacatctcaatgtgaggagctgcaaagtctcattgcaaagagtgttgacacaggaagggtggagaatggggaccacctttgcaatctctgccatagtgagggagccaacagggaaacaccttatcagtttctttccaaaatgaccatttttattaccttaacatttaaatgaatttatcaggaaagtttctaaaaaaaggagccatggcctttcttgggagagagtgacttccccaccataaaaggcattcaataagaagctgaattccatggtcatagaaatattaggaggagaacccttcccctacccctgagagtcaatgttttcacatattttccatctttctttccagatcagcaaagacccgatttttgtaccaggcgtctgggggccttatttctcagccatggtacctgggttctggctgaatgaaggtggtcagagcgttactggaaaattggtaagttgacactttctcaatagggtcatggatgtttttatgtcattgattagtccattttgtcacatgacccatatacccaatatctggaggatttgcagacccctgaatcggggtgtactttctcttagtgcacagcctaacatgtcatacacatgcagcatatattgcttaaggaagaagtgttacagcaggcagtgatgaccagcccttcttctcacctgatctttccttacatcaatccatttttctcagagtgatgagaatgatattctacttagagaaaacgacatgttactccccagcccaaatccttcagttttccccatagccccttgagacatggctcagataatattctggctgcattatacacttcatggtctatcccctccagtcccacacatgtgcctgtaatttacactaggttgctctcctcacagcttctccatgcctcctgtcattgcacttctctgtccctttatacaggcttctttccctgcttggggagttctttaccacctcaataattttacttgtcctttaagatccaactccagctcttagcacactctgttattcttattggttactaatccccttttctagaacactctgagttccttaaagacaagggccatgcggtacacagtggctcatgcctataataccagcactttgtgaggctggggcgggcagaccacctgaggtctgaagctcaaggacagcctgaccaacatggtgaaacctcatctctactaaaaatacaaaaattagctgggctcgatggcaggcgcctgtaatctcagctactcagatactctcctaagacaggagaatcacttgaatctgggaggcacagattacagtgaactgagaatgcaacactgcacttcagcctgggcgacaagagcgaaactccgtcttaaaaaaaaaccccacaaaataaagacaagttctctttgtatccacctcagtgccaggttcatagaaggtacttaatacaaacttgttgaattattaaggctgtccaataggggagagagaagattcataaaagtgagatgagtgctgtaacagaagtacacggtacagagttggcacaaagctaggttaggaaactctttacaggggagaaggcattggtgctgagccttaaaagataaataaggacaaaccaggtaaagaagggtacagatagtctacttggtaggaaacttgtatgggaaaaaagacatggaagtgaaaaataacggctaatttgagggtaatggcaaatagtccagaagttcagctgtggcacaaactattcttagaaaaatggcttacgataaaagttagagagtagggcagagaccacatccctgtaaaacatgctaaggaattgaacttcgtctagcagaccaagaggaaccagtgaaaggttagaagagtatgtggacatgttcataactcagttgtaaaaatctctgcttagaagccatgagggtaaaggcctgaggacacatggccagaggcagggagactagttttagtaggttagtcaacagacaaaaagccacaaggacttgaatgaggacagtaataatgatgactgggaattgaggtcaagagattggcaggcttctgagagatcaaatgtggaatacagagaaagtgagacctaggctcagttacacacactcacatttactgttaaattggaaatatctgcttatgttatgatgtgatttgcctaccaactcttctaaatgttcagccaattggaaatgatcttattcaaagctggatgtatatgcaaatatctgtgagtttacatttcttagtataatcctattttatacatgactgcctcaaattctctttcaaagtaaatggaagcataggtgggtagatggattcaaagggcatgttctgtacgttactgttgtgccaggctacagaaatgaattaaatgaattggacctcatcagtccctggttttaaggagctcatacttggatggggaatccctgagtatgaaataaatcatgtttgattggtctcagtaaccagtgctagaaaagttgagaaggaagacatcatctatggctacagtacagtagaaatgcagcccactttatattctcctatttaaacttgtgctatgtacttagtcaacttattttattttactttcagttccgggatacaagtgcagaacctgcaggtttgttacataggaatatgtgtgccatggtggtttcctgcacctgtcaacccatcatctatgttttaagccttccatgcattagcaatgtgtcctaatgctctccctccccttgcccctaactccccaactggccccagtatgtgttgtccccctctctgtgttcatgtgttctcattcttcaactcctgcttatgagtgagaacatgcagtgtttggttttctgttcctgtgttagtttgctgaggatgatggcttccagcttcatccatgtccctgcaaagagatctcatgcctttttatgaaggcatagtattccatggtgtatatgtgccacaatttcttaatccagtctatcactgatgggcatttgggtcggttccatgtctttgctattgtaaatagagctacagagttccaagatggccgaataggaacagctccagtctacagctcccagcatgagcgatgcagacgaccagtgatttctgcatttccagctgagatactgggttcatctcactggggcttgtcagacagtgggtgcaggacagtgggtgcagcccacagaccgtgagccgaagcagggcgaggcatcgcctcacccgggaagcacaaggggtccaggaattccctttcctagccaaggaaagccatgacagatggcacctggaaaattgggtcactcccacacggctactgcgcttttacaatggtcttagcaaacggcacaccaggagattatatcctgcgcctggctcagagggtcccacgcccacagagccttgctcactgccagcacagcagtctcagatccaactgcaaggcagcagtgaggctggggtaggggtgcccaccattgctgaggcttgagtaggtaaacaaagtggcctggaagctctaactgggtggagcccacctcagctcaaggagacctgcctgcctctgtagactccacctctgagggcggggcatagctgaacaaaaggcagcagaaacttctgtacacttaaacgtccctgtctgacagctttgaagagagaagtggttctcccagcacagggattgagatctgagaatggacagactgcctcctcaagtgggaccctgaccccctcagtagcctaactgggagacacctcccagtaggggccgactgacacctcatacaaccaggtacccctctgaaacaaagcttacagaggaaggatcaggcagcaacatttctgcaatatttgctgttctgcagcctccactggtgatactcagggtctagagtgaaacgccagcaatctccaacagacctgcagctgagggtcctgactgttagaaggaaaactaacaaacagaaaggacatccacaccaaaacccaatctgtacgtcaccatcatcaaagaccaaaggtagataaaaccacaaagatggggaaaaaacagagcagaaaaactgaaaattctaaaaatcagagtgcctctcctcctccaaaggaacgcagctcctcaccagcaacggaacaaagctggacggagtatgactttgacgagttgagagaagaaggcttcagacgatcaaactgctccgagctaaaggaggaagttcgaacccatggcaaagaagttaaaaaccttgaaaaaagattagatgaatgtctaactagaataaccactgcagataagtccttaaaggacctgatggagctgaaaaccatggcacgagaactatgtgacaaatgcacaagcctcagtagccgatttgatcaactggaagaaaaggtatcagtgatggaagatcaaatgaatgaaatgaagctacaagagaagtttagagaaaaaagaataaaaagagacgaacaaagcctccaagaaatatgggactatgtgaaaagaccaaatctacgtctgattagtgtacctgaaagtgacggggagaatggaaccaactgggaaaacactctgcaggatattatccagaacttccccaacctagctaggcagaccaacattcagattcaggaaatacagagaatgccacaaagatactcctcgagaagagcaactccaagacacataattgtcagattcaccaaagttgaaatgaaggaaaaaatgttaagggcagccagagagaaaggttgggttacccacaaaaggaagcccatcagactaacagctgatctctcggcagaaactctacaagccagaagagagtgggggccaatattcaacattcttaaagaaaagaattttcaacccagaatttcatatccagccaaactaagcttcataagtgaaggagaaatgaaatactttacagacaagcaaatactgagagattttgtcaccaccaggcctgccctaaaagagctcctgacggaagcactaaacatggaaaggaacaactggtaccagccactgcaaaaacatgccaaattgtaaagaccatcaaggctgggaagaaactgcatcaactaacaggcaaaataaccagctaacgtcataatgacaggatcaaattcacacatagcaatattaaccttatatgtaaatgggctaaatgctccaattgaaagacacagactggcaaattggataaagtgtcaagacccatccatgtgctgtattcaggaaacccatctcacgtgcggagacacacatagtctcaaaataaagggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaaccatcctaaatatatatgtacccaatacaggagcacccagattcataaagcaagtccttagagaactacaaagagacttagactcccacacaataataatgggagacttaaaccaccccactgacaacattagacagatcaacgagacagaacgttaacaaggatatccaggaatagaactcagctctgcaccaagtggacctaatagacatctacagaactctccaccccaaatcaacagaatatacattcttctcagcaacacaccacacctattccaaaattgaccacatagttggaagtaaagacgtcctcagcaaatgtaaaggacagaaattataacaaactgtctctcagaccacagtgcaatcaaagtagaattcaggtttcagaaactcactcaaaaccactcaactacatggaaactgaacaacctgctcctgaatgactactgggtacataacaaaatggaggcagaaataaggatgttctttgaaaccaatgagaacaaagacacaacataccagaatctctgggacaccttcaaagtagtgtgtagagggaaatttatagcactaaatgcccacaagagaaagcaggaaaggtgtaaaattgacaccctaacatcacaattaaaagaactagagaagcaaaagcaaacacattcaaaagctagcagaaggcaagaaataactaaaatcagagcagaactgaaggaaatagagacacaaaaaacccttcaaaaaatcgatgcatccagaagctggttttttgaaaagatcaacaaaattgatagaacgctagcaagactaatgaagaagaaaagagagaagaatcaaatagacacaataaaaaatgataaaggggatatcaccaccgatcccatagaaatacaaactaccatcagagaatactataaacacctctatgcaaataaactagaaaatctagaagaaatggataaattcctggacacatataccctcccaagactaaaccaggaagaagttgaatctctgaatagaccaataacaggctctgaaattgaggcaataattaatatcttaccaaccaaaaaaagtacaggaccagacggattcacagccgaattctaccagaggtacaaggaggaactggtaccactccttctgaaactattccaatcaataggaaaagagggaatcctccctaactcattttatgaggccagcatcatcctgataccaaagcctggcagagacacaactaaaaaagagaattttagaccaatatccctgatgaacatcgatgcaaaaatcctcaataaaatattggcaaactgaatccagcagcacatcaaaaagcttatccaccatgatcaagtgggcttcatccctgggatgcaagactggttcaacatatgcaaatcaataaacgtaatcctgcatataaacagaaccaacgacaaaaaccacatgattatctcaatagatgcagaaaaggcctttgacaaaattcaacaacccctcatgctaaaaactctcaataaattaggtatttatgggacatgtctcaaaatagtaagagctatctatgacaaacccacagccaatatcatactgaatgggcaaaaactggaagcattccctttgaaaactgtcacaagacagggatgccctctctcaccactgctattcaacatagtgttggaagttctggtcagggcaatcaggcaggagaaggaaataaagggtattcaattaggaaaagaggaagtcaaatttttcctgtttgtagatgacatgattgtatatctagaaaaccccatcatctcagcccaaaatctccttaagctgataagcaacttcagcaaactccccggatacaaaatcaatgtgcaaaaatcacaagcattcttatacaccaataacagacaaagagagagccaaatcatgagtgaactcccattcacaattgcttcaaagagaataaaatacctaggaatccaacttacaagggatgtgaatgacctcttcaaggagaactacaaaccactgctcaatgaaataaaagaggacacaaacaaatggaagaacattccatgctcatgggtaggaagaatcaatatcatgaaaatggccacactgcccaaggtaatttatagattcaatgccatccccatcaagctactgatgactttcttcacagaattggaaaaaactactttaaagttcatatggaatcaaaaaagagcccatattgccaagtcaatcctaagccaaaagaacaaagctggagacatcacgctacctgacttcaaactatactacaaggctacagcaaccaaaacagcatggtactggtatcataacagagatatagaccaatgaaacagaacagagccctcagaaataatgccacatatctacaactatctgatttttgacaaatctgacaaaagcaatggggaaaggattccctatttaataaatggtgctgggaaaactggctagccatatggagaaagctgaaactggatcccttccttacaccctatacaaaaattaattcaagatggattaaagacttaaatgttagacctacaaccataaaaaccctagaagaaaacccaggcaataccattcaggacataggcatgggcaaggacttcatgactaaaacatcaaaagcaacggcaacaaaagccaaaattgacaaatgagatctcattaaactaaagagcttctgcccagcaaaagaaactaccatcagagtgaacaggcagcctacagaatgggagaaaatttttgcaatctactcatctgacaaagggctaatatccagaatctacaatgaactcaaacaaattcacaagaataaaagaaacaaccccatcagcaagtgggcgaaagatatgaacagacacttctcaaatgaagacatttatgtagccaaaagacacatgaaaaaatgctcatcatcactggccatcagagaaatgcaaatcaaaaccacagtgagataccatctcacaccacttagaatggcaatcattaaaaagtcaggaaacaacaggtgctggagaaataggaacacttttacactgttggtgggactgtaaactagttcaaccattgtggaagtcagtgtggtgattcctcagggatctagaactagaaataccatttgacccagccatcccattactgggtatatacccaaaggattataaatcatgctgctattagacacatgcacacgtatgtttattgtggcactattcacaatagcaaagtcttggaaccaagccaaacatccaacaatgatagactggattaagaaaatgtggcacatatacaccatggaatactatgcagccataaaaatgagttcatgtcctttgtagggacatggatgaagctggaaaccatcattctcagcaaactatcacaaggacaaaaaaccagacactgcatgttctcactcataggtgggaattgaacagtgagaacacatggacacaggaatgggaacatcatacaccagggcctgctgtggggtgaggggagtggagagggatagcattaggagatatacctaatattaaatgacgagttaatgggtgccgcacaccaatatggcacatgtatacatatgtaacaaacctgcaggttgtgcacatgtaccctaaaacttaaagtataataaaaaaataaataaaatattataatgatggtaatattaattgtaataattgtagcttactgagtatttttttgtgagagggatttatagacataattctgttaaactttgaatgatagtcataattacaatgcctaatattattttgaaggcttgtttccaatctcagttccaagaacttttcatgtattatctaattaatattctcaaaagtcctatgatcatacctatagatacagtcattatctgtattttatagttaagtgactaaaggtagcaattacagcctggagagtctcctcacccaccagtgatggccttttaatatgttttatttactactcacctttccttaccatttactaattcttgtttattctcttgtaaattccaatctctggttttaaaatacatcattgtcacataggacatgataagaaaaagttgcatcttttttattcccgcttgcatatgcacatcttctctaataagccacatctgaaggtgtctgctccagtagtacattgtccatggtttcaacgatgccacacagtcataaatacaccacctaaagcataagagacgggaagtgagaaaacagagaaaaaggaaagtaaaggagaagaaacaatagaaaaaaagagaaggaaaagaaatgaaaaatatattaaaaaccatggattttaaaaaaagatatttgtctcatttttacaattaaatgcagatcttccattacaaagcaattatttcattctaagtatgtgaatagatttgtatttttaaaaaaaatcttcatctggttatcctcagaatgaaggaaaagaaacaggacaggatcttttgatatttacttcttcttagaaaacacatactcccttcctaaggatgattgattttagtttcatcacacatcaaggcctgtctcatgcttgccgatattctcttctgaatagttgtgcaaaaaagcattgctttttccccagactttgtccacagaacactgaccccgtgcagttcctacatccagatactgaagcttatttccagctggaccttggccatcaccctttccaggtgctcttgtttgtctcacgtggagtgatttttattggggatggcattgggtaaggaaggctaagacaagttcctaagccactgctatggtggcattgactttctggaacaattgtgcttggattgagtcacaaggtcacaatgcaacaagttactatgtgctcttgggattttaggatgtgtacattgtgagtgtctatctgcctcctgcgtcattgccaaggctgggactagcctcaggatgtcacctatggaagacattctgctataaatgggtgtatggaatgacttgcagtgtgcacagtgtagtacagattatggagataatgatttcatgccttcattcattcactccttccatcgcgttacagagatttcctgagtgattccactgggccagccaagaatacggtcactccagtcatccaccatcaaataagaaagttggatacagaactgatcattataatttattgtaggacataaaaatagatagtacaatcactatagcctactggaaaaatagaggctaatactgagtacctattatgtaccaaatatttttaggcccattaggatttggtatttcatctgatcttcacagcatgtgtatgtggtcagtgttgttatattagttttactgatgaagaaataggctgagaatgtcaaggtaatctgatcaaaatcttacagttataagtaggagagccacaatgcaaacccaagctggccaccagaggcccaagatctttccaaaactgaatctgacttttgtggaggtgcatttctgagtttttctttcagttctcttgtagacttctttgagaagcaactgttgtccgttaacatgacattctctttaagtgtcttgaaacaaatacagttggcaggctttgtaaggccatgggagaaaaataattaaatacaataaattaaatacaatatctgaaatacatatatagtagatgggcctaagagctgactggagatgacaaaagtgtcctcagtgagaatgagacttagactgggagacttagagagaaagagagagagagagaatatgaatgagaatatacactgaaaaaattaacaccctcagtctctcaggggcatgggagacaatagccaaaggtcaattagcattgacacgatctatgtacagatgtaggtgtgtccccagcatttcacatccactaattataattacttcatggatacaaggactaactctgcaaaaacaaatgcctccctgttcccttctcccgccctggcttttgcttattttttgtatacccacctggattgctacacaacttcctaattggcttcttgcctgtaatctttccccctctaatccctttgttgcattgtaggtatagaagtctttctgaaacagttatgagtctgtcacttgtgatagctcttcagttgtcattagaataaagtcttaattctttagagtgatgtttatttatacagccagtatttacggagtgcttactatatttgaggtactgttctgagtgagaaagtagcagtgagtaaaacagcctcttctgcactctcctgcactccaccaagactcctgtacccttctcaagcttacattctaacaggaggagacagataatacacaaaaaataaataaattccactttatggtataagttattaagacaaatagaggaggtagcttgtgagttcagatgggaaggttgtagttttaaatagggtggtcagggtagacctcactgatgtgacagttgaacaaagaatgaggaaaggaaggaatttagctattttgaaacctgggggaagaatataccaggtcaagggaacaaccagtgtaaagattctgagagggttgcttgcctggggtattatgggaatagcaacaaggtcacaatggatgcggcagagtgaaccaaaatgacagttgcagggaacaagttcagagaggtgatagggtctacattattggccacagtaatagtttttactctcagtgaaatggaaaccattggagaataatgagcggaggagtgatgtgatatgacaggttttcaaagaatcattcttactgctgcctactgtgttgctgattgttaactggggagtggaagtagggggagggaagcacagaagtcagaaagaggctattgtagtaagccagctgagtgaggaggatgatggcatggagctggtaaagaatggttagattttggatatattttgaaggtagagccaccttcaaaccttgaccttgaccttcacaccctgatggattaagtgtgaagtgtgcagaaaagagagaggccaaggcttgaggaatgtagcattgctattaatgggtgaaggtggattcaatgttatggagtcagagggaggaaggagtcaagaattactacgttttctgatggtagtaactgatccccaaagttgaccctccattatcttccttcatcttagtaaagagtaccatcatttatatttttattaaagccaaaaaataaaataaaaaattaggattaattcttgactcttcctttcccctctctcctcacatctaatccatcagtaagtcctaagggttccacctccaaaatatgttgccaatccatctctcttttttcttctcttttcttttcttttctttcttccactcctagcactgttgggcaaatcaccgtggcacttttcctctcctggtctatgtaaagtatattttttgtacacagcatatagttgggtcttgcttttcaattttatgatctctgaattttacttgggttgtttagatactttatataaagataaatatgatttgatttacatctttcattttgttttttgttttctgtgatcacttctgtctttccttcctgacttcttttggattaaatgactatttttcaattttaagaattcaattttaagttatctattggcatcttggctttctacacatctttttgcattattttttaatggttgctctagtaattataataaatatcctaaacttttcagcctactttgaatgcatattatgatacttcatgaaaggtataaatacccttcaactgtgtagttctacttaccactcctatcccagctcttcacgctgtagtttgtgtgtgatatctacatatgctataaacccaataatgaaatagttgtcatattgtttgctttaaacaatgtattagtctactcttgactaccataacaaaataccacaggttgggtggcttaaacaacagacatttatttccttacaattttggaggctaaaagtctgtgatcaaggtgctggcaaatgcagtttctggtgagggctctcttcctaacttgtagatggctgccttctgtgacctcacatggccttttctcagtatgtgtatatgaagagaaaacggttgtattccttccttttcttataagaacaccagttatatcagattaaggccccactgtcatgagctgtttaaccttaattacccccgtaagagccatatctctaaatacagtcacatttgggattgaggcttcaatatatgaatttgaggtgaacacagtttagtccatgtcaaagatacataaatgttttaaagaaattctgagaaataaaccatagtcttttgtatttacctacataattactatttttattgcttttcctttctttctgaaaatttgagtttccatgtgatatcttttcccaagcctaaagaacttgtcttagcctccgtctcaaaaaaaaaaaaaaaaaaaaagaacttgtcttagcatgtcttacagtgcaggtcaactggcaaaagacattctctctattttttttcaatgcatttattttatatgctgccttgaaagatatttttgctcactatagaattcttgatttacaggtttttttttccatcagcaccttaaaatgttagtattttctattctgacattattatttcttataagaagtcaaccattatttttgtcattctttccctttatataatatgtcatttttttcctctggctgctttcaaattttctcttaatctttggcttttattacggtatggcgtggtcttctttggattcatctttcttgaatttgtaagttgattcctttcaccaagtttgggaaattttcagcatttaatttttttttgtttgtttcttctccttgctctcttccctcttactgtgactccaattccacatatatggtacctttggctattgtctcccatgcccctgagagactcagggtgttaattttttcaatatatattctcattcatattctctctctctctttctctctctctaagtctcccagtctaagtctcattctcacgaggacacttttgttggtcatctccaatcagctcttaggcccatctactatatatttatttcagatattgtatttaatcaatactattacatttgtattttaatagtttgtttctttgctgtttcctctctgtttaataactatgagaatatttttcttttacatccttaagcattgttaaaatacctactttaaaattcttatcttctaacgcctgtgtcacctcagatttggtgttcactaagtggcttttctcttaagtatggattacattttcctgttcctcaatatgtataatgatttggggtcatattttggacattgtgattgatatattctagagacactgtattatttctgtttctcttttgagtattgattttttggtttagcaggcagtttatttggctgaactcaaacttcaagttttgttactctcctgtgatgaacatgtcctaaaatctctgttgcattattttagccttagctggactacttctggtgttcccatgcacatgtaattgagagatcatccagaaattagggtagcatttataggcacagtgttgcattccctttctatggctctctctttctgacatcccctccacaacttacttcctagctactatggttgccttgaactctaacctctcatttcttaatcagaaagactgtgtatttctatctgagtattagttatcttgcatgccactgactggggtccacccatgggcaaaaatgtataaaatcaggaaacacacaaagtactgttttttccttccttgtgtctactcctctccagtttctacctggttttggccactttccagtgtcttcagagaactatttgctgtattttgatcagcatttttaattgttatcaaaatgtgtctcatcattcattcattagagatgtcagcattgctctaggcactgaggagtggaaaataatgatgctcttgctttgaaagagctcagagtatagggtaagagacagacatataactaaggattgtaaaagaacttgatagatgctacagtagagtaaggatagaaaatatctgtgccttatattcccattgccaacctgtgatctttgtctgcatttcctattctccatgcctggtcatctccctgtcctttatacattaccaaatttttcttaacttttcatcatttttctctccaaatcaaaataatttttatggcctttgatctaataaaagtataaactcttatgacattcaagacacactgtctgccttcgccctctttattcatccttattttcaccagtttactaattctgtaatttaacctacagtaatcctatgaccaatgtatgcacaacacaaatagatacaaatgcaaagtgtggtaagtgccaccaaggagaagtacatggtgctatctgtgtttttcctgtggttcactcatcccacatttattccacaaacttttattaaccacccatgttatgccaggcatgaggctaaaccagtccgttaccattcaaatcatatatgtctttccattttcatgtctctactaaccagcctcctttctgtcatgccttgcctctagccctttactcctccaaactctacctatttatggcctctcagctgaagcttcacctactccaactgtataatgattgccaaatgattgatctctcactttgtgctgctatgcatcataactatttcttatttttcagtgtatctccggaacctaggtgcacagttcctggaggcacattaggcatttagtaaatactaaataactgcattcatgcttacaccacacatgctaggttctagctcactcctggaagctcatttaaatctctcttctctgaactcctaaagcacttcccataaaaattagcatcaaatcaagtaatgcctctaattatccattactgttcccagcgagtttatcttgatgctctcagtggattgcaaactcaggggatccaaagtgtgatgaggatatgcttcatcacagtaatgcaaagttgaacctgaaggagataaatattcaataactgcatgagtttttttttttcattgaaatgaccaatgtctttgatatcattttgaaacatttccacaaaaactgcaccaatggtattcaacaacgtatacctggaagttcagtagacaatatgacgtggtggttaagaacaaggtcttaaaatatagagactgcagtttgagacctagatttgtcgttactttactgtgaccttgggcaagatattcaatctctttgagctcagtttcctcatctccataatgaagaatagtatcttctccataggagtgctataaggaataaatgaaatagagtaatgtgtgtacaatgcttaagttagtactgatgtatgggaaatgagtcagtatatttcacgtgatatcatttatactactgttggcactatagtagtgtattagtccgttttcatactgctgatacggacatacctgagactgggtaatttatacagaaaaagaggtgtaatggacccatagttccacatggctggggaggcgtcacaatcatagcagaaggcgaaaggcatgtctaacatggcggcaggcaagagggaatgagagccaagtaaaacaggaaaccccttatgaaaccatcaaatctcatgagacttattcactactacgaaacagtatgggggaaactgcgcccatgattcagttgtttcccactgggtccctcccacaacatgtgagatttatgggagttacaattcaagatgagattttggtggggacacagacaaaccatatcaagcagacacacttaacttcctagaaatcctgtttaaaaggaggccatggaagttcaaaacagtttagtgacttgcacaaagtcactcagctagtgagactcagagccagaacccaaccctggcctctgtgtctcctgaacaaattatcttctttacacagccctagctctcaggaaacatgctcagagagcctatccctgtgcagccaaaagaccaaatcttttccttgttggaatgaaaataaatctatcagaatggttgttttagcatcctagaaactcaagtaaacattcagaaaatatacagatgaggttcaggaactcaagcacggtgttgcttgggtgtgttatggcaagcagagtaaatgcatggagaaacatttctgtccctgatacatatttcatactattttgtttagagccaccaagtggattaaggaataagatcctagacctgggatttcaaatgagaggtgattatctgcagagctcagacatttctgtccttggagagctgtgtttcccatgtgatgattgttcagtcaggagagtttctcctgacaggtctggggcatctcaattttttttaactgagagtttcaaaaaatttttttaatgagggttttttcaaaaaccctcatcatagtctctttcattcagcttctccattagtaagacacagtgagtaattcaaggtttgacattgcccagggatgacagcctagatcaagaaggggaaatgatgtgatccagaaaaggttggtgcttttaacactcagaccccccccatttgacataagttacccttccttctcattcttgggcctgttgctaacctgcttctaccagtttagccttggaaatttcatttctgtttactcttctctctaaacttctttgttttatgtatttaagaggctagcagtaggttaaatcaaagctaaatttcttttagctgaggcactcttgctacattggcattttaatgttcttggaacccgtatggacaaagagttgaaagaaacatatactcattttaatataaatttttctatcttatacataaattaaagaagctataaaattgacccatgtctcttatttttcagatagaccacatggtacaaggccatgctgcttttccagaactacaagtaaaggccacagccaggtaactgctgtctctgttccctctaaaattttccttgtgtgactgtattgagagaattcacgttgggcagttgggtgattttcagatcctacagacaatgaaaatgcctgttagtgcttgaaagatagtcacctggatgatccagaagatagatgtattaattctttaaatgaggtaagagaacttagagaacctagagataccccaagaatatacccagggactatagataagaaactctgatgtagaagaaggaccatggattctggagtcaaaacttcttagtttcacatcccagccatactccttaatagatacaggaccttgagctagttacttaacctctttatgcctgtctcttcatctgtaaaactgaagataataactgatatggagtgatttctagaatattttgaagcaagctgagtgcaaaaaaaatttacgatatactccctttcatgtaaaaagaaagacataggaaaatacatgtgtatctgttcatttttgcaaaagaaatataggaagtggccaggtgcggtggctcactcctgtaaccccagcaccttgggaggccgaggcgggcagatcacgagttcagagatcgagaccagcctggccaacatggtgaaaccccatctctactaaaaatacaaaagttagccgggcatggtgatgtatgcctataatcccagttacttgggaggttgaggcaggagaattgctcaaacccgggaggtggaggttgcagtgagcagagatcgtgccactgcactccagcctgggcaataaagtgagactccgtctcaaaaaaaaaaaagaaatacaggaagtttaaaccagaaaataataagattagttacctacagggggtgggtaggaatggggtggaaagaatgtgggaatgggaccatggtagtaggaagaaatgacacttctctgagtatacctttttatataactataactcttagaattattgtcatgcctcatgtccctgataccccgataaaataggtgatagataaccaggatatatgtgtatgttggcatgggcaaaatgaaatgcacacagtaaaaactgaacctactgtattacaaagggggttgggaaaagaaaagaaaggaaaagaaaaaagaaaagaacctaagtaaatttgggaaagaatattttgactatatgccatatggctaaagagaaaaataaccatacataaatattatactctaattggtaaatctgtttttcataggtgtatatgttagctatagtgacaactctttatgtgtatgctacagttgagtgaagaaatcaatatattgtggataataagagccaggttcctcacaaatgggaaaaggagaaggttagaatgaacctcatggtgtcaatatcaacttatgattttatatatatatatatatatatatatatatatatatacacacacacacacacacacagctggatataaatataagtaaatatagatatgtatattcatgcatgaatatacatgcatatactccctaggtctctctgctgagatggcttggaagcaatgacacgatagtagcaatgtgtgtacctagctcacaggtactgtattctaagtaccattctcccatttctccaataaaagtaatcaggacttcttagaaagatggctgagtctacgctgcggcagtaaaattatggtgccagaaagaaaaaagttactcaacaaggaattgtcaaggtacattggaaccaactttaagaatctctcagtggcctactcaggataaaataaacagtaatagcgtaaagtaagtccataagtaaataactttgtaagtaaactactgaagaaggaaataaacgaggacgaaatgacaggtcttcctcttcactgtcaggacagtagccttacaattaataaatgtagaagaaataatggaaatagataatcaacattaggtaaacactacagagataaatgttgtaggcaagaatcattaatggatgctaaaattagtgagtaaaagtgggaagcaggatattttcataaacccagaggatttcagtacaagatactgagtaataggaagaggaaaataataactttccagtagtatataagtatggcagacaccaccttacccaagtgatgaaagtaaacaacaccagcaataacatgtagtgatatcatgtatctccttttatgaggcaccgataaagatacaacatcatttctgccatgttcttgcccaaaatgattaaactcagtgtaaatatgggaagcatcagacaaacctagattgacattccacaaagctattagccagtttgctccaaaggaaaattaagaaacttaaatactgaagaactgtcctagattggaggagacttaaggaggtactacagctgtaagcagtatataatcatggattcaactctggaccagagaaaggacattggtggaggaaaactgttgaaattcaaatagagattaatagtattgttatttatggcaatttcttaggtgatgagtaaaagggaactctgtgtattatttttgtaacttttgtgtaaatctaaaattattttgaaataaaaagtctaaaaaataatgaatggattttcatgctgataatgcttagttgtcaggctgtttaagtaaagtaagatatttttatagaattatcagagaaacccatgtagctagctagcacaggacaaaagagagatagtctaaggtggccactaatagactctgaagccaaattgcctttgcctcagctttgtcgcttattcactttctgtttctgggctatttacttaacctctgtgccttagtacctcactgtaaagggaataatagtaaacatttcataaggttgttgagaaaattaaatgaattagaataatgggtgatacagagtgatgattaagagtcaggctgtaataggtgttcaactaaaaaaatggtaatgataaaaattactgttggggaacatcacacaccgaggcctgtcgtgggatggggggataggggagggatagcattaggagaaatacctaatgtaaatgacgagttaacgggtgcagcaaaccaacatggcacatgtatacatatgtaacaaacctgtacattgtgtacatgtaccctggaacttaaataaaaaatgaataaataataaataaataaataaatgattgttgtagttagtatattagacatttccattctactaagtgacttacattctaataggatcagcacacctacacagagcagaataaatgaatactgtagtaaaatatacgtagtgtgttatcaggctgtgtagaaaaggaggactgattttgacaaggagtttaagaaaagcttcataggcattcccttctaggagtctttagttataatgccattgcaattagtcattaattacaattaccattgagagggattatgtcacataaccttaccaactagcatattagtggcatagagaccatataacctagaaaagggattcctaatttcggatcatcaatgaacctctttaaattgtgtactgttctgctgattacataattctgcatgtatttctgtgaagggaccataacggtcattattttcttaaagggtttaagcatttataaaccactaagccaaagaaaagagcactaaatttatagtctggagacctgaatccaaatctcagctccaacatgtatcattgtgtgaaacccattttcttcattataacataggatagtaatggagaatcaacccgaaacacctctaaggatttattttgagtttagaagaggtaatatatttgacggggccttgtaaactgaattgtgacaataatgatgatcactactactctgttagtccattcttgcactgctgtgaagaaatacctgagactgggtaatttataaaggaaagaggtttaattgacttacagttctgtgggctgggcaggcatcaggaaacttacagtcatggtggaaggggaaacaaacacatccttcttcacatggtggcaagagagagaagtgctgagcaaaaggaggaaaagccccttataaaaccatcagatctcatgagaagtcactatcacaagaacagcatgagggtaaccacacccataattcaattacctccaaccaggtccctcccacaacacatgaggattatgggaactaaaattcaagatgagatttggtagggacacagccaaaccatatcaactactactattactactaatgattgtaagaggaggaagtttggtggtggttgctatgggttcaagcagcatacgtcagtcattcataccttgcctgccttcttatggaaagcatggaggaacagcaaggacagggactgtgaattagagtccttgagttcttgtacctgttctgccctgaatgtctcaatgactactagattcttcatccataaattacaataatgataccctacttacttcattttacaggcattaataggatgaaagcaggtcacaggaatgtctgtatatgaacattttagtgtgtaacacaaacttactgaatatttagttttgcaatgacatactctaaacttccagaactttcttctatagataaacttcatttgagtagcttctgttgcaaatcataataaaaagaagaaagaatttatggattaccatgcaaactcagagaaacaacagtatcgggtggttcagaagcagcaacttacagaactcagtgatggagtcagaactggatttaaatcccacctcttttcacataacttcaaacccacttccagctactttcctgtatttctccttctgtttagagtggagtttctccaaagcatcgcctgtactcttggtctctacttctccacttcctactccttccttgcccactgcagtttgaattctgtcaccatcagccccctgaaacgtttcatattaaggttatcagtgacctctattttgctaagtccataggatgttttttattcccctttctttagttctcagcagcatggggcatcagtgatcactttttcctccttttaacattctctttccttgactttctggaatgtcaccctgtctgttttctccctatatctctgattcctccttcctaaccacttttcttgagtttatagtccttttcttgaccattaacattaatttttgtcacagctagcttcctggccctcttctctctttgccatctcttccaagatgatctcagctatgctcttgacttcatttctgtctatattttgatgactcttttatgtccagcccagatacttagtaggtattcagtaaatgttagttcggtttccttccacttttcttttattgtcttacaaaggaaagtgcatctgtgtcttattagatctatgagtacaatattctaaaactatgggaccctttatgcttccggtcttagaaagaaacaggcatagctgtttttgaaatgaagttagctgtttggaagagtggacaaatccttctgaatcaagaaccatgtgtctcttttactatgacttggggctttctgaaaacagcaatgcaggtcacccctatctcagagcttagggtcagcaaatcctgtttgaaactgtggaaacaagtgttgataaacagattgagtattttatactcttgatttacaataatcctcttaggccccatctctgaagagaagtgttttgcaagcttataaattaagtaaacaagaactggatgtgcccgtacatgtaactggtaaccaaagtttctcttcatgtggggccaaatttgcagatatttcactctttagcagagatcaccttatgtcaatcataaattttgactcttttcctctaaacttgattctcttagaggttcttaactaacagtgtctctgaattaggttctggtgacaacagggtttagtgagaacattttggcataatccacaagtgctagattcaaggttggcagcaaagcaaaacttaaaatccagggtctgtggcccatctgtctgatgagtatcttttgagcatttgtgatacatgaatgaaccaagcaaacaaagtctttgctttcataaaaatatacacacacatacatatataaacatgcagtacatacatgcaaatatgcatactatatacatatacacatatgcatatatacagatatagccagccattgataaatgctctaaggaaaattgtagataaataaggagatatagagcattggtttcaaagcccttaatgttgtctttgttgtgctagtgcatatttttttcctcagcctttcttttttcctactttccctgaatttttctgttattcctctgaggacagctaatttttcttgatctgatttattcctcaaacttcttttgcttttgtaattcccataatcccactaaatatcaatttcttaaaattcactagtcctctatatcgcgaatcgcagatagattaaaacttcccattaaaggctgtacaaatccccctcaagcaaagaaagggaaaaaaaggacaataacatttattaagaatctgcagtatgtttggcactgtgcttagtgataatagtttcacgtatattatctcatttaattctagatgaggaaatgaggattattgggagctctcaaacttcacttctaaaaatttttctctctttccattctgctcttttgtattgagagtccccttttagcctttatgactttttaaaccttggaccgtcattctgataactggggtgttgagtctatcactgaatatttacttagccttccctgagctaggacagtcagtgtgataatattaacacctttcattcccccatggtatacaaagataatcagtaaattcttgatggctctgagttcagaaagatttcttacagaaattagctggatattattatacatttctttttttttttttttttctttttttttgagacggagtctcgcactttcacccaggctggagtgcagtggcactatctcagctcactgcaagctctgcctcccgggttcacaccattctcctgcctcagcctcctgagtagctgggactacaggcgcctgccaccgcgcccggctaattttttgtatttttagtagagacggggtttcaccgtgttagccaggatggtctcgatctcctgacctcgtggtctgcccgcctcggcctcccaaagtgctgagattacaggtgtgagccactgcgcccgacctattatacgtttctttggtttctgttttgcatgcaaataaaagaaagtgctcagggcattggggtcttctctagaagaccaagggtctgtgctgatttaggacataaatcctcttattttctacctcccaactggttaccagtagctcagcacagtgcctggtggcataggggcatgtgtagggaagtcataagatgcctgttcctttgccctgtccccatcttctgtatattccagcatgtctggaaggctgtgtccatctgaagggttttagatggtgtgggagtaataatcaaggttgcattgtagaagaaccaatcaggaaagagtacagaaagcctgattggacattcttagttgagttgtctttggacatctaagaggaggcatttgaagagtggttggatacttgacctggaactcataagaaagaaatggacaggagttaaggtcatatatttggaagtcctcagcactagatggtaactggagcaatgagaagaggttaggatcatccaagaggagataaagagtaagaaaatggtgaaagacagtagatctctggaagacgtcatatgtttaatgaacaagtgaagaaggagaaacagccaaagaggagggaggaaaatcaagagagaatagtgtttcagaaacaagagaacaaatgaggaaggagtggtcaaatgatgtaaaatgcccaaaatgattcatcggcattaacaacaaagagggtattgttcctcatggtagtaccagtttcagtagaatggagcaggcagaatgcatagtgtattgggttaagaagtaaggaactaggccggttgcagtggctcacacctataatcccagcactttgagaggctgagacgggcggatcacgaggtcaggagatcaagaccatcctggccaacatagtgaaaccccatctctactaaaaatacaaaaaatttagctgggcatggtggcacacgcctgtagtcccagctactcgggaggctgaggcaggagaatcacttgaacccaggaggcagaggttgcagtgagctgagatcacaccactgcactccagcctagtgacagagcaagactctgtctggaaaaaaagaaaaagaaaaagtaaggaactagagacaggcaatatggaagcttcttttctaagactttctcttgttggtagaaaaggcacaagtatattttgttataccatgtattctgattttttggtttaagagtatgaccaccatactctctgggcagcctgtgaacccatagaattaggtgatttatggagagggagaggacatgagagatttcagggatgttgtctgcatttaagatcacaagcaataggtccgaaaaaaaaaatcttctttgattcttggatttttaaaaaactagaaatgagtttcttatgatggcaaagaagaggaaactatttattgataaacctgtcattttatagtgctcagggctctatgtttaatcttcatagcagcctttaagtagacagtattagccccaatagcaaaaaagcaaataggctcagagagggtttgcctacctgatcatccagctggtacgtggtaaagtcactttatgattattgaaactatattttcttcatgatacccagtgggatgtggacagcaaaagtttctccttttgagacaggatatatcaacctggggttcatgagagagagggtgagcgatccacttgggatcacagttaatatgtgattccctagctagaagaaggcaggctgccatttgagaaggaactgataaaacatgcaaaatgacacaaagtcagaaccaaaaaaggcatcatgcaaggttaaaattatgtgaataatgatgtgtattagttagtttaatgtcttccaagtgcatttcattttgaatgatatactcagatagcacacatggtaaggtataattgaaaaaacatgtaggagaatggctgcattcaaagaataaacatacagctgcaaggaggttaggagtcaaaggggtaagcatatgccccatccctcagggatctcattagtgcatgagtggccatatatgtagaggctaaatgaatctcactgtttgcaaagacctgcagtaaatgagacaatgacgaatcaataataattaggcctatacgttcttattgacccagatgtctgaaaccaaatgccctgctcagagattccttgagaggcagaatgaaaagatttatagacatgcgtttccaaaaaaaaaaaaaaaaatccctttactttaagaacagtggctattctgaagtggaaagtcgcaagaattagtgcagactcttgacttctggctagaaaagatgttctcaaggcttttcttgtgaatgtgattcctgttggaccaggagcagagagagcaaagagatggaaaaccaggaggttatcatattcgtgttcgctgatacgttgttctggctgtaccttgtatggaggcttcagaggatcctttcctgaagccataatagaatcattctaaaacagggtttgtgtttttagggctttgataaataatttctgacctaagatacagaaagtccatggcttcagaatcacaaggagaagggtttaaagctggactcagacctgtctcttcacctcttgaagcatctcctctgtatgttagtggtacctccccaactgggcagtgttggaaggtctggtgtacatttagggaatggcaactggtgttaactgtagttgttaagccttttcccagtaatatcttattcctcctaataagatctaaggaagaagatttttgcagatgagaatgagctattacagcaagaagcaaataaactgctggtaggtagggcggttgggctgccctcacctccaccctagtacacatcacacgcactcacacacacacacatatacatgcattcacatttacacactcactcatgctcacacagagcagctttgcttttctatatttttacattgaatatttacatacaatttttgtttaataaaggagttctactggacgggtgtggtggctcaagcctgtaatcccagcactttgggaggccgaggtgggcagatcacgaggtcaggagattgagaccatcctggctaacacggtgaagccccgtctatactaaaaatacaaaaaaaattagccaggcgtggtggcggacgcctgtggtcccagctactcgggaggctgaggcaggagaatggcgtgaacccgggaggcggagcttgcagtgagccgagatcgcgtcactgcactccagcttggtgacagagcaagattccatctcaaagaaaaaaataaaataaaataaaaaataagtaaaggagttctactggtaaatggggaaaaaaagagaatttaaaaatcaatgctctactcattggtttgtttccctacaccaagtacaggaaacttttggcaacttcatgggatccatgggatcactcacccaatcacaaactagaactagaaatcactgagccttccttctaaaacacttttaaaatgcaaagcataaataatgccttaggtatcttagatattaacctcctttggatattgatttcctatacttttttttctgccattatacaagccatgtttttaacctttaaagagacttccaaggaccccagtgggaagtagcacagatgccaactactgcaatatccactttcttttgaaatcattggttcagaacttttagaaagcagcatcttttaagaggggaaggttgaccagctttcatctttgtgtcatgtggtgtgatttaacccggtgaggtaggtgttattaaacctattttatgagtgggaaaattggaggtcagaggttaagtcactggcccattttaccgagctaggagaggtagtatcaagatttgaactgagtagtgctctcatgcccatcatcttctctccacctcctcttcacctgaacatgtaaagaatgaaggagttggtttgactccctcattctacacatgaagaaactgagacttaaaaaggagaaaaaaaaccaggcgaggtggctcacacctgtaatcctagcactttgggaggccgagatgtgtggatcacctgaggtcaggggtttgagaccagcctggctaacatggtgaaaccccgtctctactaaaaatacaaaaattagctgggtggggaggctgaggcaggagaatcgcttgaatctgggaggcggaggttgtagtgagccgagattgcaccattgcactcccacctgggcaacaagactgaaactccatctcaaaaaaagaaaaagaaaaaacgtacacaatgtcatctggtgggtttaggttgaaaatcaggtctctaactcctgatcctaactgcatttatgacattcagtcactttacttagcaaaatcctatcctgagtctgggaacttataatttctctccatttatcaactcatcatcattattacaattaggaatactgattttaataaattattgacatatgaccagtactgtacagtttacaaaatactgcgccttcacatacataatcttctttgatcttcacaataaccctatgaggtaagttggacagggattatgatatctgtttttacagatgagaagagggtggttcagaaagtttgaataactttctcatggccatacatctactaagagtaaagccattcctggatccagtcttctgactccaaacctttctactaggatgtggcacctttcttggtgatagtacagtgtgatttgagagtacagtgggctagcttctctgaagcttttaggagcctgcttactttcctggatctggaagtacaaatggtttctttctatagaatgatttgctccctgaccctatcccccctttaaaaataaaattcacttctcttccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtaagtaacagctagtccttgcacatgggtgaaggcaggccaaagggctacaaagtttggaagaagcaaagtgaggaaaaaggaaaagaaaaaaataaaacaggccaacagccctctggctttgtgcagatgcattgctgttgctgctccctgggatgagctgctgaaagttttcattgtttctgagccaaccttgaaagcgttaaaagcagcatttcctagttcagctactgctgcctctttgtcctgtggagtggctaaaagtcatgcctatgtaattttggcatttatatcagtttgtaaagtcaaattttccagctgcatctttaggttgcccagtaaatcagtagtaaatattaccacccatggtcttgctggccacagccacacatctgcctaggctctgagtcagggctgttcagattctacactaatatagttaggatttcagattaaactttggtataagtaaatgtaatttataacttatgttggaaaataaatcctgctcttagtgccctttagggtcacttcctctgtggatattctaggctctcctagaggggccagatgaacttggtgggagaactctcaaccaccccagttgagatataaaagtaataacatcttagacaccaggagaatcatgtttgaggtgtgatgaagcaggttaaaggtagaggaggggccaggtgaggccacaaataagaaaataagccatgaatgcaggaaccaggaaaatgtcatgaagctgagaaggtgagtgtgaggtacattaaggcagagttcagaatggaggctgtaaacaaggcaaggcttatgcaaaggaagccgcgtaacagtggagcaggcctgatggagtcaagaattcaagactcaaactactacaattttgtggttagttttattgagattgttttaaatatttttatgatgccagcaggaagacctgaaatttattttcattacctagttgacatgatcaacttctattactaaaagggagtcatggtgaaaagaaaagaaaattagacatgacaaaggttatgttgatctggagtccatgaagcatgcctacacaacaaatcatgagcttggtgtccttttttatagaggcagaagaataatgtccagagagggccatgtggcaacagaccgcaactagaaagtcatactttcagataaccaactctctctgtaaacagggggtaggggaagaacacatttcatatgggtacagaaataagtgtcttaattagagacaaatatctgaagccaaatagagctagatatttaaaatgttgaagcagttaagaagcttgaccagtgttttaaatgaccccaaaacaaagcagtgttgcatagtaaaatggtcattgctctggaggtcatttgttgctttagataaaactgacctaggagccttccctagccaatgtctgtcatacccaaattcagtacccagcatgtcaggcttcatgtctcccagtagcttttatccattttttaaaaccaatcctgacatccaagacctaagaattatcatcagaaggatattctaatacagttgacccaaatgcagaatgaaattccaaagaaatcaatggagtgttctgaagaattctcatatcatgagaataagtatgtatgcaccaaaaggaacttcttacatggggacatatgcccagttgtatctaaaaatcctgggtatgtttacttttttaaaaagttgtatgtttgttcacatacctcatatatcacttggtagttcttggcaatgattccctttataactgtccttgggttaggctgcaatggaacagttatcactccatgaatttgcatcacaacactggaaggagaagatgacctaaataagatagaaggaaagcaattctgagctaaacacttcaccccaaatctccttccttcagtccagttttggaaaacatcaaaataatgaccctgaaattcttctgttatgttatatccttttgctggaaactacgatgatgcctatctccagcactcattcagcaaatattaattgggttcctattgtatgccaggcactgccgtagatatgagtaagatgcaacaatacctaccttcatggagtatgtttaaagttgggagtgggcgagtgcttgaaaaaatgttaataggaactagcaggataattccaataaagcaagatccatgtacaatttcttcttttggcccctaaaacgtttccctggacacagagtaagtgctcagtatatgcttatttataatttataggcaacatagagataataaagaggtcatttgttgccttagataaaacaaacatatgaagaatttaataataccaaatgaattaagtggctactgacactgactatccatatcgtaagtatttaataccaatattaatttccaagtaaatgaagataaactccaattgtatcataattatgagactgtttattcatcaaacaaatacaggccctgttacagttgttgggggatataagagtagctagacacaatcccagccctcaggaatatcaccatctttgggaggcagacaaaatatataaacagggaatggaaagatagtattaagctccagatgtccttcactgtccagagctctccagatgcatggaagacgattgcccaacctggtcccagcggtcaggaaagctccagacaggaagtaacattgacactgagtgaagctgggaagggggtttgaggccaagggaatcatagtatgtgcagtattctagagggaagagagcatggcatgtgaatgtctacaattttggctccttgtatcattgtctaaccaatgatagattgcctttagcattttatcttaataataaaaaaagaaaattttctcggatttctcagagaaccactggatatctgtatattccggctttggcagcgttgcactctcccagttctctactctcccctcaggtgactcttttcttgcattgttaaacatttacccattcactgtgtttttattgaatacctgctatgtgcaggcctgtgctaaacccaggtaatacaaagaaaacagaaaagtacctatcctaagttcacataaaagtaggggaggtaattattgtacatgtgtgtatgtgtgtgtatataatcattttacagtgtgatctctgtaataatcagtgcaagctgaaggagatgctcaatacatgtctgactttgaaattgtttttatgtggcattgggctagcaaaccctgatgcagcctttttctgcttctcttgaaaatatttgtaaaaatgcaaaaaagtcatgaattcatgcaggccttaggaattaggatggtgttcaactaggaaaactagaattggtattcccaattatatgatgaatgcaacttgtttgataacatcatatatgacataagaacaaagtcatgtgtgatccactgtggaaacagtttggacctcgccaccttctgctcccttgcataaaagcacaaggttcttttaaacctgaaaacagcatagctattcctctactttactgctaatggttgggttttttgttttctttttggaaagcagccagtgagtttaaattcctagatccccccacaaccctgttcccagccactctttcagttcattccatttgaaaactgccagctcaagaatccacccaagcaggaagtgtgaattaggaggaagggtgatggcttgcattctaagcatctgttaatggggcagatgtaggaaaggccttagtagttctgtaaacttgggaggaagggtgtagtttgcactactagttctaggctcggaaagccaggcagtgctgatctacctcagtccaacaaagctacagaaaataaaaactgctgtactctgccaactggcatttagctgtagatctgaagagacaaatttaagtatacagtgagtggggataagagcaaatcacggctgtgtgcggtggctcacgcctgtaatcccagcactttgggaggccgagccagttggatcatgaggtcaggggttcgagaccagcctgaccaacatggtgaaaccccgtttctactaaaaatacaaaaattagctgggcgtggtggtggacgcctgtaatcccagctactcaggaggctgaggcaggagaattgcttgaacctggtaggcggaggttgcagtgagctgagattgtgccactgcactccagcctgggtgacaagagcgagactccgtctcaaaaaaaaaaaaaaaaaaagagcaaatcatgtgtactgtatgctgggaaatactgaacatgtgtacctgtctagttagcgtaaatgttgaaaaataatggccccttagaaaaaccattacatacggctggacgcggtggctcacacctgtaatcccaacactttgggaggccgaagcggatggatcacgaggtcaggagatcgagaccatcctggctaacatggtgaaaccctgtctctacttaaaaaagtacaaaaaaattagccgggcatggtggcgggtggctgtagtcccagctactcgggaggctgaggcaggagaatggcgagaacctggggggtggagcttgcagtgagccaagatcacgccactgcactctagcctgggtgacagagtgagactccatctcaaaaaaaaaaaaaaaaagaaaaaccattacatacaaagaaaaaaataccattgtgaacacttaaaggaaagccctcttgaaaattatttactactgaaaccaaaagaaaatgttagagaactttgtggtatattcaatggaatatttttaatttttttttaagagacaggatcttgctctttgtcactcagactggaatgcagtggtgcagtggcctaatcagaacccactgtaaccttgaacttctgagctcaagcagtccttccatctcagcctcccaagtagctaagactacacaggcacatgtcagcatgcccagctaatttttaaaatatttttttgtagagatggggtctcactctgttgccaaggctggtctcaaactgctggcctcaagccgtcttcccacttcagtctcccaaagtgttgagattataggcatgaaacactgttcccagccagaaattttgtttcaaggcatatctctatgaaataggccagaaacttattaggaaagaacaagttaagatgaaaggacaatggaatgagaaaaagggggaaatggcaaagaccacaagacaactaaaaatgcaatcaaagaattaaaacctacattgaaagcaatagggagtataattttcactgaagaaaataagatcaaggctgtcataagacataacatatgttttaaatttactctataggaaaaacattttgaggataggagcaatggcttatttactttttaaaatatcaacagttcttaggtcagaagctggcaccaaataattgccttatggtcaaacagttatttcaatcactgtttgccaaatgaggaatgaacagtgacctgcccaaagtcacaaagccaagaagtggcagcgcttgccttttaggatgcaaactctggactttgcaaaacgcatggaggactattaagaaagggagtttaaacatgcattatacatggtttcatagtgaaccatgttccttaagctagtccttggctcttctgttcttctgaccaccaaccttgtggcttgtcctcccacttttaccctaaccatggtctttggatttaaactctgaccctgtctcttctcagtaaggtactagtttccttcccaccctaactgactcagatttaaaaaaaaatagccactcgtggtttgacctggttctaatgccttccacactaggtgcctaccttggtaagtaggaacaggacataacccaggaatctcttccttatgcttgatagtatcattttctttttgttctggtaacagttgactcctatcatgtgactagctgtttcatttttcttttgatgatacaatatcagcctgaagcactggactaaagagaggtggaggaggtgggggatgagcagcctaatagcatggctggactaggtaccccactatgtaaacatttctcctttccagttgataaatgaagcacagaaaggtgagggctacacatacgattatttaaaagaagcagaatcttaagtaataacagtcggtctcaaaacagtaagcgctgatgattttaggttcattaaaaacaagacagacacgcccccccccacccaaagaaaaatgcttacttttaaagtaagaaaatgacatggtcacacataaaggtagatgaatataggccgggtgcggtggctcacgcctgtaatcccagcactttgggaggccgaggcgggtggatcacgaggtcaagagattgagaccatcctggccaacatggtgaaaccccgtctctactaaaaatacaaaaaattggctgtgcgtggtggcacacacctatggtcccagctactcaggaggctgaggcaggagagtcgcttgaacccaggaggcagaggttgccgtgggctgagatcacgccactgcattccagcctggcaagacagcgaggctccatctcaaaaaaaaaaaaagatagatgaagataaatactcaccatcaggaatagttgcatgttttagggatttttttggtggttatttttattttaaatgttttgttgaatggtttttaccactgcaaagcagtaaagagggcccaggttttgaaatcggacttatgtttgaacttgtcttgaagatataccagtgtatgacctttggcgggttaactctgtgcagctgatctgctcatgaggaagcaggagtggcccaggcttctttgcagggtcactgtcagcgccagacagtaggtgttggcacgatggacagacagcacaacaatgcccttgaattggcagctcctgcttggtggcctttacttgcatctttacgagatggccagtaggatcctgtgtggcttttgaaccctgagcagccagccgtgggcctcccactttagccccagaactgactggactcaccagcccaaacaaccagccagagaagcccaccagtcccttggtcctcacagaaagcaagtttcatacagctcttgagattgatcttctttgttcaagtccttggccctcagtttcctcatcaatacaacaggaaactcaaatgtggtgtaccttatggaatagctagcattgtaggaattttcaaagagtccttgccgtctggtatatatgagcagtttctattcacaaaaaattggcgtggcctttgttttgtggtgtttgggatttttaaaaattattttcctgaaataaccactcaaccactcaacaaagcaatgaccttggagacatatcaggccctgaaaacacaccaaatgcaccctattcatcattggttgaaacatgttttctctgcttcatgttaaaagtacagaactacccagaacaaaaagtgattttctgcttctttgaagagctgtgacttctaacatcagagcgtatgctactcaaactgctggagaggttgaatgctgctccaacaactcttcaaagcaaacacagagatagtgtgtatgtgggagaccaggagagagtcagggaggaagcactgggagatcttagccagtttccaagggactgaatcccagctagctgtaggcatcactaaacagatccagatgtggaaggagtcagcaactcagggtatctgcaagagctcaatagagagcagaggttgcacccctgtggcttttccgatagggagatggatgatagagctggaagctcatgagctaattgaagtagctttcaaatgatgtatttataagctttggaaacacatggtctctttgatatgagtttgtggatgtttttgctgttatttaacactgatttattcggactttttttttacatatttttgcttatgaaaaatcaaatcctataacaaagcttaatatcctcagtgtctttacctggttttctgattatatatatataatcacaataccaaattggtgttttccaaattggtcacaaattttactgaatatatatatatgttttactgaaaatacatattttttatttgtatatttatatataaatttacatatttatattttatttaaaatatgtattttactgaaaaaatatatatattttactgaagtgactaattcgccagctggtattgtgatttttaataggtaccatttttcaggcacctgatgcaccaggcaccatggtagatgctttccatgtatcatcaacaaccttcacaacaaccgtgcaagacaatgttgttgtcccatttaaaagaagagagaaaccgaggctcaaggagtttaagtagcttactcagaggagaaaagggtataagtggaacgggaaccagtcaattcaaacctgggtcaatgacattctttggggaaaaagaaaaataaaaaactagatctttgtcattactgttgttttcattgcttctgctttgtttttaatgtgcctggcatctttctttttcattttaatgactttttaaattctatcacagaatcagactttcctttcttactgctcctttatctttcctatatacactaaacaacaagtaaaaccagggaatggactatgggcaggagtgtttcccaaggtcatgtggcatgataaaagactgaggggcgaatcaggtggaatctactgggaaggtccaagacataaacaatgcaaaggaactaaggccagaggaccaaggatagagtccattgtgtataatcttggtgtgcagacccaagacagggttagacaacagcaagtatgggccagaagagttgtacagaccagcttcgagaaacagtatatgagcatatcaaaatggcttagacttaaaccctcagaagcaaggcaaacaaggtgtgaagggcctttgggtaaacagcaaacaaagtagtgttgtgtggtgtagaattcaccaatagagtaaggtcatgaggggcagtgtccatccatcatttttgcttgctataataaattacacaaatctagtggcttaaatttattctcttacagttcttcaggtcagaaatctaggttggttctactggttcctccgtaaccaaagaaagtgttcacaaggccaaaatcaaaggttttattggaaggttctgggaaaaatctgcttccacactcattcaagtggttgacctaatttagtcccatgcagttgtagggctgaggtccctgtttccatgttaaaggtcagccagtgatccttctcagctttcagaggcctccggcattcctgggcccaccacccctgccaccatcttttttttttttttttttttttatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatcgagtctatcattgttggacatttgggttggttccaagtctttgctattgtgaatagtgccgcaataaacatatgtgtgcatgtgtctttataacagcatgatttatagtcatttgggtatatacccagtaatgggatggctgggtcaaatggtatttctagttctagatccctgaggaatcgccacactgacttccacaatgtttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttggttgagttcattgtagattctggatattagccctttgtcagatgagtaggttgcgaaaattttcacccattttgtaggttgcctgttcagtctgatggtagtttcttttgctgtgcagaagctctttagtttaattagatcccatttgtcaattttggcttttgttgccattgctttttgtgttttagacatgaagtccttgcccatgcctatgtcctgaatggtcatgcctaggttttcttctagggtttttatggttttaggtctaatgtttaaatctttaatccatcttgaattgatttttgtataaggtgtaaggaagggatccagtttcagcttcctacatatggctagccagttttcccagcaccatttattaaatagggaatcctttccccattgcttgtttttctcaggtttgtcaaagatcagatagttttaggtatgcggcattatttctgagggctctgttctgttccattggtctatatctctcttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtctttggtagcttgatggggatggcattgaatctgtaaattaccttgggcagtatggccattttcacgatattgattcttcctacccatgagcatgaaatgttcttccatttgtttgtctcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattggataccctttatttccttctcttgcctaattgccctggccagaacttccaacactgtgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggctttttctgcatctgttgagataatcatgtggtttttgtctttggctctgtttatatgctggattacatttattgatttgcgtatattgaaccagccttgatcccagggatgaagcccacttgatcatggtggataagctttttgatgtgctgctggatttggtttgccagtattgtattgaggatttttgcatcgatgttcatcagggatattggtctaaaattctcttttttttgttgtgtctctgccagggtttggtatcaggatgatgctggcctcataaaatgcgttagggaggattccgtcttttctattgattggaatagtttcagaaggaatggcaccagctcctctttgtacctctggtagaatttggctgtgaatccgtctggtcctggactttttatggttggtaagctattaattattgcctcaatttcagagcctgttattggtctattcagagattcaacttcttcctggtttagtcttgggaaggtgtatgtgtccaggaatttatccatttcttctagattttctagtatatttgcatagaggtgtttatagtattctctgatggtagtttgtatttctgtgggattggtggtgatatcccctttatcattttttattgcgtctatttgattcttctctcatttcttctttattagtcttgctagcagtctatcaattttgttgatcttttcaaaaaaccagctcctggattcactgattttttgaagggttttttgtgtctctatttccttcagttctgctctgatcttagttatttcttgccttctgctagctgttgaatgtgtttgctcttgcttctctagttcttttaattgtgatgttagggtgtcaattttggatctttcctgctttctcttgtgggcatttagtgctataaatttccctctacacactgctttgaatgtgtcccagagattctggtacgttgtgtctttgttctcgttggtttcaaagaacatctttatttctgccttcatttcgttatgtacccagtagtcattcaggagcaggttgttcagtttccatgtagctgagcagctttgagtgagattcttaatcctgagttctagtttgattgcactgtggtctgagagatagtttgttataatttctgttcttttacatttgctgaggagagctttacttccaactatgtggtcaattttggaataggtgtggtgcggtgctgaaaaaaatgtatattctgttgatttgggggtggagagttctgtagaagtctattaggtccgcttggtgcagagctgagttcaattcctgggtatccttgttgactttctgtctcgttgatctgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtatctctgcacgtgagatgggtctcctgaatacagcacactgatggttcttgactctttatccaatttgccagtctgtgtctttcaattggagaatttagtccatttacatttaaacttaatattgttatgtgtgaatttgatcctgtcattatgatgttagctggtgattttgctcgttagttgatgcagtttcttcctagtctcgatggtctttacattttgacatgattttgcagcggctggtaccgattgttcctttccatctttagtggttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatcagccgttagtctgatgggcttccctttgagggtaacccaacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttgcaacttggttccattctccccatcactttcaggtacaccaatcagacgtagatttggtcttttcacatagtcccatatttcttggaggctttgctcatttctttttattcttttttctctaaacttcccttcttgcttcatttcattcatttcatcttccattgctgataccctttcttccagttgatcgcatcggctcctgaggcttctgcattcttcacgtagttctcgagccttggttttcagctccatcggctcctttaagcacttctctgtattggttattctagttatacattcttctaaatttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcgttcctttggaggaggagagacgctctgcgttttagattttccagtttttctgttctgttttttccccatgtttgtggttttatctacttttggtctttgatgatggtggtgtacagatgggttttcggtgtggatgtcctttctgtttgttagttttccttctaacagacaggaccctcagctgcaggtctgttggaataccctgccgtgtgaggtgtcagtgtgctcctgctggggggtgcctcccagttaggctgctcgtgggtcagggttcagcgacccacttgaggaggcagtctgcgggttctcagatctccagctgcgtgctgggagaaccactgctctcttcaaagctgtcagacagggacatttaagtctgcagaggttactgctgtctttttgtttgtctgtgccctgcccccagaggtggagcctacagtggcaggcaggcctccttgagctgtggtggactccacccagttcgagcttttgggctgctttgtttacctaagcaagcctgggcaatggcgggcgcccctcccccagccttgctgccgccttgcagtttgatctcagactgctgtgctagcaatcagcgagattctgtgggcgtaggaccctccgagccaggtgtgggatatagtctcgtggttcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggcttgcgcatggtgcttgcacccactggcctgcgcccactgtctgggactccctagtgagatgaacccggtacctcagatggaaatgcggaaatcacccgtcttctgcgttgctcacgctgggagctgtagactggagctgttcctattcggccatcttggctcctcctcctgccaccatcttttaagccagcaatgatgggtcaaatctttctcatgctttgaaccactccgatttctatttctgcttcatctctcctgtcttcctcttctactgtgtcgcttgactgactcctctgcctttctcttctgcttttaagagctcctgtgattactctggatccaaccagagaatccaggataatctccctattttaacgtcatctggctattaaataattctatctgcccagttcctttaaagcagggcctcagttagtgtttaattgaataaccagggtacagaatattgaggggacatatttaggattctgcttaccacattgtggtagcacagtcatctgcatttctcaaatgtggataggatttaggcaatgccaagtgttagcctagattccagacacttactgacacctctaaatatttttggtaagatgtgtccccctttctcttccaagcgggtgattatctcagacttgtcctccaatgtcccttttccctttagaggcttcctataaatctttctctgatcctcctcattgccttgtccatcagctccaccttcattattgactgagcaagcagagcatttctgcctctccattgtgttctggaaagctttcagtgaattcccctgagccttggatacccccatcaagctctgatgaccatagaaaaatctcaggacttgtgaatcccattttcttgtcttttgtaatcttttgagatcccttgggaaactatttttaagccttttttttcttgctaatatgtataaacacttcaattcctttaacaactaggaaggaaaaagtgtaattgctaatacatttattaataatctcaactattttagaacctatgaacctataatttataataccaaggtttagagcagtcatttccacaatttattgtgcattaggactgtggtgaaatgcaaattgctggacccacaccaaaggttcagtaaatctagagtaggatcccaggaaacctacactcgactaggatcccaggaaagagttgagagaggtgccgtagtttagacagctactaagttgcaagatttaaggtgaagtccagggtggacagtaaccatctgtctcttctttttatagtgaatggaagtgtgtaggttgataagtactaaggcttcctcaaggagttcttgcaagagtccccccactctgtgtccctgggcactcaggggcttctccatactcctgcatgcctgtacctttaacattatggtcccagcgctgatgagcaacttctgccctggcttccctacactgaacagtcactagtctccagtgcccctcattaatatcctcagtagtacccacagcatggtgaaggagatacgttactcccatatcccagtaaatgaatgggattgagcctttcatgcaattcgagagaaagagaatgaacacttattaagagaaacggaaagaaaatgaatacttattttacttttgtaagtttactttacgttctgggatacatgtgaagaacgtgcaggtttgttaaataggtatacatgtgccatggtggtttgctgcacctatcaacccgtcatctaggttttcagccccacatacattaggtatttctcctaatgctctccctcccctccaccccaccccaccacaggccccagtgtgtgatgttcccctccctgtgtccatgtgttctcattgttcaactcccacttatgagtgagaacatgtggtgtttggttttctgttcctgttagtttgctgaggatgatggtttccagattcatccatgtccctgcaaaggacatgatctcattctttttttatggctgtgtagtagtccatggtgtatatgtgccacattaagaaaatgaacatttaaatgccacctctttgcacagttggcaccataagagttacaggagtatgtagctcttgtagactcagtacagcttactgaaaaaagtaattcactttgcaaatgatacctcatgtaatcctcacaaaaataatttgaggtattatccctttttttgtggatgaaaaaattgagctcatagatgttacaaaattcatatagtgtcatgcagctaaattagagaaaatgtcaatatttaaacccaggtgccttcctctaaagctcattgtttcaattggcatacaccgctaacctcgaaaatcccaatatttacataagtgctttatattcataatctaggaggttaaaattaggcaatgcagttatttgcattgttttggccattatatatagttttcatgcaccctaatattaattgtaagagctttctcttatagttctcttcattacacaatatccaaaatagataaaatgtgcttacccttgcaactctcacatcgggcttccctacacatttgtctgtctcgcccaaacattcaaaataggcacaggcacatcaataaacacactccttctactcatgcttcctctccacttcctcttgttggaaccattcagcctccagctagggaatcagttcatctggcctatcctagccttttcagccatttcaaagctgtgcctctcccaggacttctttggcactcccagggcactgtcaccacctcccttcgaagacagctccccgagggtcctttgtagcctctcaagcagtcttcatggcactccttgcaaagttccgtcatgggttgactgggctgaggtccctggtatttgagagaaaattaaatggacttaacgatcatctgcatatcagatgagatgtcaaggaaacaaggacctcagaccacagtgtctttgcacttgagagataaatatctttcactaagtcacatttcaataccatggctctagtgttagtggtgagggaatactggaaacggttgtatgagaattgtgtttgtggcttcccttttgatactgaataccttctatattatgatccatgcaagaaatctcttctagaatttcttcccaggaataattttgtctcccttcaaggatagctatgttttatttatcagaaaaaaagctatttcaccctcatgtgtccctttttgccatagctgctagcaagctcaggatttaaatttagtgctcaattacattgattatatcattctcagtttctggggaaaaaaattatcctcccgtttctgctctatgatttctgagctctggaggcactggaaatttagagaagggtccgtgatatctttttgcatgaataccaatgctttttggaaattctcgtggatatctgctggggattaaggaagttaaatccagctatgtcacaccctttcttctctcttatggattcttactaattgagaaggatatcagaacccattacattatcagtattattatacaaagcactggggttcctaataaatattgttaggggaatgcatcttatatacaaagtcatattttacccccactcccaacaaaaatcatccaaatctggtcttcaggagtgggtcagccacacagaggatcatggcttaatcctcttcccattgatgaccagagagaggaagccaaagggaggcagcctcctggacaggctctagaacagtgcactaagccatggcccagcaacttccctaggagacctaatagcagaggtgctgttgaggccaggccagtacaggagagacagagaaaccgtgtgtgaatggtgttcatgactagtgatcattgccaggaccaccgcatgctagcatggtgcaggcagctcgcagaaagtgttcagctcagggatgttcagctcatgactggtgttcatgactagtgatcattgccaggaccactgcatgccagcatggtgcaggcagctcacagaaagtgttccactcagggggctatgaccaggctgaaatcctgcttactctgcacctttttataattcatactcccagatggggtgcctttttcaaactcaagacaaaggctctatatgaggtacagggacccttccttttaccctattctcataaaagccacttctctgatgagaaagggtaagtttagggatggtggagggcaggtggcaacatggagcaagtaactaaaagtgttcttccagtgttcttttctcttggggcatggtctcctcctctctgattgtgtgaggagctgaggcagtaaactttgtccacctgtacttgtagaatttaacaaagaaggataggacataaggagagaaagtggtgtctaaaaggtgaaaagaagcattgaattgtcactggttcatagttcacagtgctgagtgaattgtcactcagcaaatattaactgagtgcttactatgttccaggcacagcactggacattagagctttggtgagtaagacgagcaaagaccatcagaacacctacattctggtgtccattctctgtgttcccttaggcacattatttcctcactgtgaaataaagttccataatgtcagcattgttcatgttctctctgagttccagaattcttaccatatgcttaggtctctgggaaactttgtgaaggatgttctttcacagttaatggcttaggatgattcagcgccagagttcttctcgtgtctctcatttaaattttccatcttcttgtgtattaaaaaatcaaagccatcattctaatctgattgcccaattatttgccaagaaaaactgtcagcaggtagctctactgaatgtaggaatccccgcatcaacagacttagataaataattcagcatagctggagcataggatacagagtgaggagggacaagagtaaacactggagaagaagcaagggcgagcccaggaagaagcacatgagacagtgaacgcatttctactgtgaaatgagggcaatggggagaacgttttacagggagtaacacgatcagatttgcatttaagaacagtcgatctagctctagtatggaaaggagcacaattagaaacagtgagatttgctcagggcctctgtcagcaattaggaaggacataatggtggcttgaattaaggaagtgaatgacagtaaggatcaagaaaaggagatgcattcaaaagagatttgggagatcaaatgtacaaaactttgagactgcttaaatatgggaagacaggggaggtcaagaaagatggcttctggccaggcgcagtggttcacaactgtaatcccagcactttgggaagccaaggcaggtgtatcatatgaggtcaggagtttgagaccagcctggctactaaaaatacaaaaaaattagccagatgtggtggtatacatctgtaattccagctactggggaggctgaggcagcagaactgcttgaacccaggaggtggaggttgcagtgagccaagatcacaccactgcactccagcctgggagacaaagcaagactctgtctcaaaaaaaagagggttcccaagtttcctggtttgggtaactgaatggtgcctgtgcactgtcataagccaattgcagtggggttcagggtgaaatctggagagagtaattaaatggggccagagaatatgaaggaagggacctaggtagaccactcagctcccttattttgatgcaaaccgcatgtccatacctggttgagctcaggacaacacacaccataggaactgagtaaatgaatgttggtgaattaattttataatgtgataatctaaagtgaactatggtgctgatgcccacaaaagttgggctcggcttgaagaacccagcagccctcaccctttagaaatgtcccaagagaacaccttgatgagtgggagacatgaaagcaggactgtgagcaagtcctgatggcatacaaatccggcatcctgttcagttctggactctctcagagattgacatactccatataaacatccgattctgattgactttaatgggatccccttgcaacccacagattctaagttatcccctagtaggtataatatttgtaggagacatattatattaccctggattggacactgaatgctgttacactgaagtctgacagtagcagaactcaaaacaagatcatcttgtactagaatgccactgttagtgttgatttcttgtaagccacagaaaataggtatttgtaagaaaagaaaatgttttaaaataaaaagtatttaattatcgtctaagaaatatcaaacataatcttcctgtggtatttgttttgtttttgtttaaggtcagggtattttctcttggggaggaagggatagtttttcccaggtctggagattaaacaacttaataggcatttcacgttccgctcacaaaaaggggatttgcatatgaacttgtttcggcaagaaaacacatctgaacgtatttcatgggaactatctttatccacggcagcttcttttgaccatcttcttcttttcttcccttcatgcctgcaggtcaccggattgaaactgtctcaggaccttgatgatcttgccattctctacctggccacagttcaagccattgctgtaagatactgtaatgccatttttaaagagacttagagccatcagtatactctaggccactggctccccaagatacagcacatgcttttgtgacagagattcttaattaaaagattgtttgcaaaaaagagattcttgtatgtctggaaggaagtgttgatgaaaggcctcacctgctttaactaataacctcacataacaaaaagctgaaaggagttaaaatctgtgaagattatacttgtcatttatctaatttgtcttctaaatttaattaaatagaagcaagcaaacagatgctatgtatgcttgcattaagaaaagttgttaagaatgtctgatttataaaatacattatattgttcactttgcaaaaggattcatgataggggtcctttaaatagtaagcttccttagaacatgaaagtgtttgtttttagataattagctgcttaagtgaggttaggatgattagggaggaagaggggaatttaaatctgaaatgttaggagtttctacactaaagataaatcaaaaatggaaatgaaatcctaaaagcttaaccattgtctaaagaatcttcttatctagaggtggctatggatgggctacaagagggttctaatcctgaaatcacatccagaaggttgtgtgtgtgcatatattacaaagtgcattttaggagagtagatcatggtgttcggggtctcacagcaggtatgtaaccgaaattaagttaatccagtgaggcttagccacttctgaaaagagaataggaattaacagaaaggaaaaatcagtttatctaattttaattcaaaatttatttttcagtaacacctgttttaagcaaatatgtttaatgctatacgtacatatatgatattcaattattctgtttcttcacacaactgttttcataactttattcctttaaactatatgtatatttattcacaccaccaacagaagtgcttttttaatgctcagatttgtccatgcaccatgtatgtgcaataaagaatggaacctcccagatagtaataatactaatactgaagggatataacttctttaatgcaactacatagaagtatggaatcagtcaacttgattaaacagcccttttagattctacactagttttactatatcttcctgaagcaattttcttattggtcttaatagcttggccaattcagtgaaatcagtcaaatatctttatgcatggaaacttggtcaaaagcacacaattctgacatctgtaaaaatgtaggaaatgaacagtaagatgaaaatagagaaaaaaagtgtgcatcagtagtaaagataattatttagctgtcctgttttataataataatgatgattatgatgataataatgagtgaattaagagggtgttttgtttttgtttttgtttttgtttttgtttttgtttttgttttgagacagagtctcgctctgttgccaggctggagtagagtggagcgatcttggctcactgcaagctccacctcctgggttcaagcgattcttctgcctcagcctcccgagtagcttggactacaggcgcatgccaccatgcccagctgattttttgtatttttagtagagatggggtttcaccatgttggccaggatagtctggatctcctgacctgatgatccacccgtctcggcctcccaaagtgctgggattacaggcatgagccaccgcacctggccgagttaagaggtattttataggccaggcgcggtgactcaacgcctgtaatcccagcactttgggaggccaaagagggcagatcacgaggtcaggagatcgagactatcccggctaacatggtgaaaccctgtctctactaaaaatacaaaaattagccaggcatggtggcgggcacctgtagtcccagctactcaggaggctgaggcaggagaatggcatgaacccgggaggcggagcttgcagtgaactgagatcgcgccactgcactccagcctgggtcacagagcgagactccatctcaaaaaaaaaaaaaaaagagagagattttatatgtgccaagcactgtgctagatacattacacacacctgatttaaccttactacgtagatattataattcctattccacaaactagaaacctaaggctctgtgtgattaattaacttgtgcagggccatatagcttgtggcagaggtgggatttgaacccccagcattctaaaacaaaattagacatgtgaagtacagtcatctgctacataacgttttggttaacgagggacttcctatatgatggtggtcctataagattatgatactgtatgtttactgtaccttttctatgtttagatatgttcagatacacaaatatttaccattgtggtacagttgcctacagtattcagtacaataccatgccgtataagtttgtagcccaggtgcaataggccatactatatatagcctaggtatgtagtaggctataccatctaggtttgtggaagtacactctatgatgtttgcatgacaaaatcacctaacaatgcatttctcacaatgtattcccatggttaaaggacatttgactgtattgaggaacttttattttcagatttgttaatgttattgtataaaagagtcatagaatgaatagcttatattgaaatgaataatcttggaaaatcagagtggtgtgatattcccccttttgagcacatgctaagaggaggacatgaaggatgaggcaaacaggagggaccaaggggcaccatcacatagtggtaatgacagttacctttcgtcagacacgactgtgtgccaggcaccaaagacggtgccttgcctactggtagcttaacactgtaaccctgtaagtaggtgggtttgttctcattttacagacaaggggaggaccatttgccgaggtcaaacagctagagtatggtagttggaatctgaacctttctccatctcactcccaggcttctgctctttccactttaccatgctgcattttcctttgatctgtttgtaaaagctacatgggtgaaataagctttcagatattcctaagaatcgtttttacttaatatatattagaaaatatcattaatttggccaggattgtctcacagaggttcctttcctggtaagagtactgcagcagaagtccagaaatgtataaatgaggttaaacttaatgcgggcaggagaggggaagaaaaaaagccagctacattttctcaagtaccacacacttggaaaatcaatcttgtatttaatgggccgtacatgtattaaaagctatcatatttattctgtccattgtcttaatgacctttataataccatgaaaggaaggcattttaagacagagatttttttcaataagccttttttgtggagtcaagtgaattgtgaggggttcagtctgttttgcaaatgtatctggatgtgctgatcttttaggcaaaaaaatgtgcattttaatgaggtattctgataacagatattttcccataatgttcaacttgggaaaaaaaaatgttgtttcattagccctgaatattgccggagcacttatttgttgtcggtcaactgaaagttaagcaaatttctctctatatatagtcatatctttgggtgctgttttgtaggggtgaaatgaaattaaagaggattgtaatcaagttaacttgggactgtgcaaaaccctccatgaagtaaaattctctcttgatcatgcttaattgaaagacctgtcaaccacccggtttatccatagcctgttcatctatagttttctttgcagaacagacccttaaaaggtactatttgcatttgaagtctcttgatttgcattcggttctgtacattcccagtggaatagcctaattttaatttaaatttctctgtgaaaacattttttccagaaaggtgagcacaaaatcattttcacacaaagccctttggtggggcatttcagtagggtggagtattacacagattggagtctgggacaccgaaagggaaggtcctctaaggaaccgccagactgagtgggaaattccagccgacaataccacatgggggagagacaggctgtctgtcacagcccctctcgagggagtgcctctcattcggatcatttctttccttttcccaggaaatgtgctttgttttattcttgtctcaggcctgctaatcgcaagcccctaggtccctggttttagaaatatcaaagataccagtttttcctgacatttccatacaaattaggagacagcaattctcccattccatacagactgtattgcttagtcaaattatatatctcctaagtggagaaaacaatatgcaggtttcacatttgccttaagattagagatgctattaaagtgcatagcagagtgcctagcatatagttgataaccagaagaactctccttgtatgcacctttcgtgagctggacacttctacaagttttacctttgctgcctacagcagcagacttgtatggtaggtattactagatttcatcaagcctaagaccacatttttaatttttttgcatgttgacatttctgacaatctatagaatttttaactaaatgaatatgatactattattcccatggcaaaaaaaaaaatggcaattgagttatagaaaggttaaggtacaagaaatatgtgaaatgcctaaatgccagcctgggttttttgaattcaaaactcatgctcttagctactacaattcatgccgttagagcagactggggttgcccagaatccacaggcatcaaatgatccatgatggacttcaggcatctgtagacctcctgaaattatttatagtactattttgtatgtgactttttttttctggggaggtcagtaggttttggcatattctcaagggggttcatgaccccccaaaaagcttaacaaagaacatctgggaataatcagccctagttagtatgtaggatctggccttatatggcacaacatgtttgaatttttttaaacacactacatctgtagattgtttatggaggcccaggttttacctaatccatatttttaccagattcatgaatagcttcaacaaaccctcaagacctctgggctagaactgctgtgccttttgctcctgaactgcccctgtccctcatgatttatgccaaaccaattaggatttcatgtcctatggttcccagatcaccctctgaccactcctgtccccaggttcccccatcccctggggtgacagctccccagacagccttgtcaaaggaggctccatttgccctctacccccaacccccctaagacgtgaggtcagggcagcatcctgctgacttccaaaaccctgttccttttttttttttgagatggagtgttgctctattgcccaggctggagtgcaatggtgtgatctcggctcactgcaagctccacctcccaggttcacaccattctcctgcctcagcctcccaagtagcttgcactacaggtgcccgtcaccacgcccagctatttttttgtatttttagtagagatggggtttcaccatattagccaggatggtcccgatctcctgacctcatgatccgcccgccttggcctcccaaagtgctgggattacaggcgtgagccaccgcgcccggcccaaaaccctattccttaccttggctaaactccgattcttcttgccctcagctaaaacacctcctctccctcactacattcctaggtttcaacctgaacaatactgtcacactttcactaaaaaccaagatattggctcatgccttcttcttggtggctgtgccatctgtggagacacattgtcctcccagatccttgactttcttatctcttctgacttctcttccctcctttttagcaattcactcccaggtctacacttaggactgtgacatctccccagattgctcaatctctaaacatttcaaagacttgctacccaccaaaaaatcctcttcctctattttttctggagcccctttctcaaacatcaccatgtggctgcccccttatggccacatcacagttcatctttttgtttttagtccttatcccaaataaattttgattttcgaactctagtttttgaactttcaagtaaattaagatttttcagatgttcaactatcctatctaaaactgaagaattctacattgagattcacttccataactctaaggcaataatggtttttactgagtttaatgaacttagcaagacagacatgaggataatgcatattaggaagatattaatgcacaagaactgagacacaaggctgaattgaaaatatggtgaagccctgaaacaaccagggaatggatttggctcagaagtctccttttagagaaccactacctggtttcaggcaatagcagcggtaattttagcccttagccaccctgaagccttggatctcaccttctttatgcagttagagccctctttccatgattctgctgctggattttttggtgctttttctaaggaaaaagcctttagttcccatttagtaaaggaagactgaccaagataccattgactctgtttcagagtactattgcaatcactgctaatacagggcctgggctatagtagacactcattaaatatctgtttgaatgaactatgttaccattaactgtgttgacattgtcaactgtttttgtcagtgttgtgtaactactgatagaagcaaatggtgtaattaagagggttttggaatcagtcaggcccaacttgaaattcccactctgcgatttaagtaactgtgtgatcatagacaacataatctctgtgagtctcagctttctgagatagtgtatgtagagcttagtacagtgtctagcactgagtagacatttaagaagtgttccctagtgtttacttttgtgactatactgatgctatcttctgcttttcctttcaagttggggactcgcttcattatagaagccatggaggcagcagggcactcaatcagtactcttttcctatgtggaggcctcagcaagaatcccctttttgtgcaaatgcatgcggacattactggtaagtctgggaaagaggagagaaggtcactttttggcttggcagcaaatgggcatggccaagttctgggtgaagtgagaataggaggatatatgcggtatgccagattattagaataatcctgaagtctttatattcacaatggagaaagtgacttctatgacgtctttatatgcatgatggagaaagtgatttctgtgtatatccaaccattgaataatggtgagaaataacacgagagaagttggccaggactagatcttaattcaagcatttacacaacagttttgaatacctcttctgatccacacattgtggagaatattgaagatacgaagatgaataggacatgatccttgctccccaccacccaggaactcacagtctattgaggaagggagacagcaaacaggcatattaaagatagtatggcaaaagcttggcgtgagaaaagtacggggtatcatggaaacatagtggggcaccttgtctggtttgggacctaatggcagctcagggcgtgtggtctggaagaagtgataagaaagctgtcttgaagaaagaatgcagaggctggatgctataggatctgtgggtatgattgcagactgggaatttgagccctaagaccctgagatcctgtgattccttctcagctcatcagaatcagggatcataatagagatgcagggaatcacaaataatgggctgagctctttgtgatatcagcagacagtgggggagaaggatccttagcaagcccctaggacccaaggaaggggccccattggcaggaggctttctgttgtcgcagagagtggcctggacctctgtctctctggacctgataccctcaccccttttactccttgcccctctagtgtctcctggggactggagacccattctctcccaggacccatcactgggtggccaggtaccaccagggcagggcaaggggagggaaagtggggaagggttgtacccatcccatagtcccaactccagcctgataagagcccacttgaccctacctccatttatcattatcctttgctgtccctcatcccctactttcttacctctgacttctggccaggtcaaagtccctgccccattatatcctccatccccctctaagccacacagattcctgcagatgagagccttgtctaacacgatggacgtaactgatctttgcacatcatgagatgaaactaagtaagtcacttattcccagcttagagataagcagactgagacacaagtctgaggacagtaagaaaagcatacagtcagccgggcacggtggctcacgcctgtgatccccacactttgggaggccgaggtgggcggatcacctgaggtcaggagttcgagaccagcctgaccaatatggagaaaccccatctctactaaaaatacaaaaaaaaaaaaattagccaggcgtggtggcgcatgcctgtaatcccagctactggggaggctgaggcaggagaattgcttgaacctgggaggcggaggttgcagtgagccgagattgcgccattgcactccagcctgggcaacaagagcaaaactccatctcaaaaaaaaaaaaaaaaaaaaagcatacagtctaagggcagaactattgggatgtgaagtatagaaagtattaccattaaccaagcacctactatgtgtcagtgtgaatcacgctgtagacacttaatcctcccataccaccaaaggtagaaatcggtgcccccatcttacagacaagcaagttgatgggtgggtaggtgaattaaattggctatctaaagtcaaacagccagtatggggcaggaccaatattgtaactgtggtgtgtcggggcccaccgtccctttgtactgtactgctgacccaggtttcttgacttttctgccaagtttgtaaccagttgatgatgacgccactttcctgagatgtccaaaaccctatagaagtgggccgttcaaagcagaaggaggaaagacataaaaagagcccagattgccttataattgtcctcaggagaaaaaccataacattttatctaaaaatcagctggctagttcagataacattcaagcttaaaatttgatctgtgacattccaatttctagacttctttttttttttttttttttttttttgtattttttggtagagacagggtttcaccatgttggccaggctggtcttgaactcctgacctcaagtgatccacccgccttggcctcccaaagttctgggattacaggcatgagccaccgcacccggccccaatttccagccttctgatagccaaaaaacttcctatctggatgcaagaggaaagatgaaagtcagctttggagaacacagtactctagaaaatgggaaacagggcctcccagagcagaacagctagctgtgagtgaccccggcactgactccgcgctgcagccctggactttgtgaaaatgggtcatcttccaggccctacatccctgggctgactcagaagcacggcggggagtgcagcggcttcacagaaagttctgctttggaaactgttctcctctaggctgttgaatgaaaaggctgttaatcgttatttggattccgattgaaactggaccttttgtctctaactatggaccagttacagttccagacaaagagaccttttatttagcctggaattcctctgcctttggaagcctgtgactgacaagtgatggcaaagtgcatctgcctttgaatgctttgggttctgctaaactcattaatgcatcagataaaatagttcacattccagccaaagctgccctcttcctctccttcacccaggactcagagaaaagaacacatttgcatttgtccctgtaaaaggcacgtacacaagcagccagtatagaggtagtgtcattggtgcctttaaacattgtattgctctagttttcctacaaagacagttagggaggactgtagacctggaacatgattctcagaaatgcatgtgaaaaacacattcgaatttgggagatttttttggagatagtgtggaacagtggaaaaagcagatcagctctgtgactttgggcaagttactttacctctctgagcctcagttccctcttctgaaacaaacaaaccaaaaaacattatcatctccctcatgtagatcactgctgaggaataaatgcttgcgagtttgtgagcatcaaactctgtgcctagtccaagtaggtgatcagtaaatgtcaattctcttattccatctaggaagccccatgccaaaaagaaagaggggcatttgagggaaaaaaaaaagcagcttattattttgaaagtgaatctttgccatgttgagaacagcctgctctgtacaagcagggagagcggggccttgccagcttgggaaatgctgtctacatgaggaggaagaacctccttgtaccctggtcatttggttaactgtggtttcaagaaatacttggtatgtactaagtaattgttaagtttcccccactgacttgggactaaatgttccttcttctaagttttattttttagtactggtagtttcagtaggggtttccctcttctggtcttactcattattttaattatttgttctttcatttattcactcaaaagcattctctgtgcacaccagtgtgccaagccctgaggttggcacagggatgctaagaagaacagtaatgtccagccaagaggttctttataaaacacagaaaaagtgcccttggtcttatgaccaatatccagagtgagtagagtggggacccagaggacaaaatgtgtcggtgtcagtcaggtccaggcagggaacagatacacactccagttaggttaaccggagggaagttgaatagtcagtgtacagagctgtgggcagggtgctggaagcccagacaaccaagaagtaccttgggatactaacagtgtttccacccctgggctcacaagggtgagggtagggagcaggcaatctgagcctggtgggatgtgtgaagagggcagcccagcagaagcttagccaaggatgaaaccagagggcaggggcccacagctgtgatccccactggccagtctcccaggctcagagtaggtggagggaggaagggaagaggtgggattggtcttagaggcaaatggaagcagtggattgatttcaccctgggtaacaggtgtgaggagagacttcagaagtaaggtaaactttaagaataacaactaatgctaatttagtgctttctctaagccaagcaccattttaagagccttattataatagcagttttaattctcacagcaactctatgagataggcggaattttaaccccatttttcagatgagaaagctgaggcacggaaagattaggtatcttgcctaggatcacacagctaagtcagtggggaagccaggattcaaaccctggcagtctgggttcagagcactttgggcagcaacttgagagctgataggggattcaccaggttcactcacatctctggttcgcaaggggaggggcctgtgagtagttcctccctgctcacaactcagggagcttttggcagggtaggaaggcccgggaagtgaatggtgtttggaggcactgtcttcaaaaacgtcccaggtccatagagaaggcttgatggtcatagtcgcacacccatctgtatcattcctaggattcttcaacggcttgcagtgctctctcctgctggtgtcagcacagccctgtagtgtggcctggcatctgtccttcccctctggatggttgatgggaacctttattgtcccttccccacttatccagtttttagtccaggtctagtacatgcatagaggcttcacttgccatctacctgaattctaacagtagcagccatcatttctccagggcttactgtaggccaggaaatatgctaagcaccaagtgtgtgccctctcattaagcctcacaacacacctgtgtggtacatcttatcatcatccccattttacatttgggatgatccccatttgcatttgggaaccaaggcttaaagagtgtaagtgacttactggacacagagctagtggaaccaggaaataaactcaggtctgagcttctcccagcattcccaccccacctgacaccatgttggcaatgtcttaagtcctggcccagttgagagctggtattcctaaattctctggggtgtctgtgggaatttactcccctgccctttttctctgggtagctggaggaaagaattgagtggggaagtaatgggatgtagagagagtgtcttctcagacaagataggaaaagaaatctaggctttgggaaaataactcttatggcttgagtagaagacagtttttacaccacaagtttacctctgtaaagtttgctgccatctcccgattagcagactaatctatacattatagacctaagaatcctaaattatttctgttaatcttaaacctaccatgaaccctcaacctctgggcattggcatatggagggctcctccctgcctggtggactcctgctcacccttcagatgcctgtttaagcctcatctccaccgtaatctgtgatgaccgctaccccagaaatgtaagtgactcatcattcagtcacttaccatgtgctagatactggtctaaatgccagggattccgcagtagtcaaaacagagtccctaccctcaagtagcttaagtttttggaggggagacagacattaaacaagataagtaagtaaaatacaatgttggaaggtgggatgaagcagttaagggggtaaggagtgttgagggaagttgtaattttaaatctgatggccagggaaagctcagtaggaaggtgatgtttgcggaaacacttgaaggatgggccggcaattagcatgtgggcatctaggaggaagtgttccagacagggaacagcatgggtaagggccccgaggcacactcaggaagcagcaaggaggccaggactacgtggctggaaggagaagaggaggatatcagagagggagaagtggggccagatctgggagggagagccccttgtcagccactgtaagggctgtggcatgcaccctgagagaggggagaagcccctggagggatgaatcacaccctctcttgctatctcctttcccttagcacatctcagttagagaaccaaccccctccgtagccttcatctctctcatccatttccctctgaaacctgaatagcagggcacagtccgattcatctcagtattccctcggccagcagagcgcttaataaacatcagtggatctgaacttgaatcaaatggcaggtagcagcttgcagaagcctgaaaaacctgggcactgaggtctcgtgagttgatatatatggtgttggttcccttgggctcttggctactgcaccagcaggcacaggcagtgaaatcttttagaaccaaataatcccaaggaataaagaagggaggactgcagggagtcgggcggggggcctgctgctgccctgatgtcaggtgtttttgccactgcggctgcttgttggctcctcacactcccctggctctgctccctaaccaaggtgtggccttgtcctgcgcaggcatgcctgtggtcctgtcgcaagaggtggagtccgttcttgtgggtgctgctgttctgggtgcctgtgcctcaggggatttcgcttctgtacaggtatgtgaagaccagggggtgggctgtggctcctcccctgtctgaggccatccttcctcttgacagcagctcgcattttacaaaatacacacaggatataattaagaaatgataggttccagccagggaaagcacaaacacttctagcctcagacatatttattgcagttttcatttgacttggcctcggttcgtgttggtcgttctgtttttcagttgttttttttctttcttctttaaaataccttttaaattattccttttaaatttccccttgaccacttttctttgagcacatgaaacaggtaaggctcaaaacttcagtgtttcatgtgtatttcagatttttatttgcttatgtcaacctcaccattttctaaataccttgaaggcctctatcaacaagagacacaaatgaaactgtcagtatgaaataaaaaaggaattaaaagggaaaataaggaacaaagatataggaagaaggaaacaatttggtggctgtgattaaacacataatttggctcagagcttcctggcaggcaagacaaaaaagaacacatgataaattgcataattcttactttcaaaaagaggaaacatactagtttctggtgagagggaaaacttttcctcccaccaaattgcgaaagaccttgcacacatggggctttgtggagaggttttgagtgctaaaataatacaaggtaaacaatgaatgtggtatggaagctaagagcatacaggctctggcattagaccacctgggctcaaatcctagcttgattacctaccagctcttgtggcctaaacagtcttctctgtacttccactcctttatctgtaatagtaattgacagcgcatcgtgagttctgtgtgtcaagcatgctcatttagtccctgcaatagctctattatccccattttatagttgaggaacctgaggcataaagaagttaaataacttggcctaaatgaaacagctagtaaatgccagaatcaagaagtctggctcccacttctcaactgaacgttcaagagatatttgttcagcaaagcagcagagtccaaatgacttgcccatggtctcaagcttaggactacaagccaggtatctagtagctcagtaattagagctttgtttattgtgaacctcttatgttccagacactatgctaggtgctttttgtataatcttcctaatacctataacaatgcttcatgagccacagagattgggccatagagatccaaaatttaagggtacactattgggaacagacagatgtaaaagtgtgatgctgtttgtactgcattttggaaaatgtggtacactacacactatccaagcctctgaaactaatgactgtgaaatctccctcacaaggaattaaatccactcatgaattcttgtggattctgagtgagtctttaaacaaaggtggtatagttcagttctcgactttttctggatagtctcgtcctttctcaaaaatagcacatggagatatttgttgttgaaatatcaatgaattgtcaattattattttagtgtatcagctgacggagatgttctcacaattaaatatcttgcccttcctgcggcaaattataatagttaaaacaggggggatgcttactaaggttctgcagaggttaccctgtgttgtgaactgaatatttgtattcctgcaaaatttgccctgaccctcaatgtgatggtatatggaggtgggtctttgggagctaattagggttagatgaaatcatgagggcaggagcctagtctgatgggttatgatggtctgatgggcccttatacaaagacaccagagagctggcttgttctctctgccatgtgaggacacagcaagaagtccatttctataggccaaaagagggctcccacgagaccctgacattgctggcaccctgatctcagactttgagcctccagaactgtgagaacatagatttctgttgtttacccagtctatggcattttgttatagtagcctgagataagacacctcatttaatcttgacagtcatcctgcttgcaggatgcgtgtttttatccttctgtgataggaagccaagcttcagagatgttttaagtaatttgtccaaggctacacagaaagggcagaagcagaattgaaatgaaggtctctctgggtctatatcttatcctgtcattctttttctaatttgttcgatttgttttttctttaaaaatattttctggcttcttaagtgttcagtggtgtattttctgaaaagaaatgccataggtcacaaatcaggagatagtctgtagctcaaacagagaatagcctttcaagatgaggctgctatactagatacatcataccatgactcatggcttcattgatatcttattcaaaactgggatctccagctccaaaggaattccactcacatcttcccctaatgggaaactgagcttaattccacactgacatcttgactacatgagatttgctgttagtcttctgtaacagaatctaagatatagtagatcagatttggaactgatgacttgagtagcagctgcaaggctcacagcattgtaaagacaagctcatgtctcctattcaacccaaggatgtgtgtgcctgtcctgatcgttttcaggagacacaatctagtaaagggagccaccagctgagagagtcctgaggtcttatctgtcatcacttacctgacagactccccatagtctggagctctgtgcttgctttactgtcctcagacgatgtcacttgttctctctgggtgcttgttttatttgtctgttttatgtattttttttaatgtttaaataagaattgccacccatatgggactatcgagataaagagcctttgaaagttccagtgacctctcaggtgtaatcaatatcattagaatgataaaatatttggaactgctttggaaatgaaaatgcatgtagacttggcgtcatttgctcccctccaaagaagaggggccaacctttgtgccccaggtctgaggaccagcttcagattctggcaaggtgaggcaaaattgaattgctttctttctgtgattcatattttcaacctgaacttcaacacagtcttttctttgaacttcagggaccctggcttggtttgcagggtacctgccttcccctccttaagaaagttgagcaattcctgccagcacctcaactattccagcaagtcagatgttttatcttctcatggaccacacatctggtggttagatggaggatttcacttcttatctagataggccaattttggtagactcaaccagagtcacctccttcagatgctgggaaggctgggaagaatccagaggacccagacagtagaggtaggaaaaacttttatgtgcttgaggagacagggttttcataggcccctgaatggatgattttcagccgggggtagagtcctatacctttcttgggtgataccaatggatccacagctgtagattttacttgtagcttttgtagactctgtgtatctcaattctgggagaattttatcaggggaagggagactggatggaatattctggtgggcccttaatgaaagattggccaacaacaagatctattgatattgcaaattttgaaacatgctgacaattcctagcttccttcttttgttcttttatccattcagattctccttctcttagtttgtctctgtctctcttcccttgtcctttcctgctctctctctccctttagacatctaaagtcttcttactatttctttgtcaaattcggatctcacaaaggatactgacatagccattcgttcattctaaagaatacaatgactaatactatcttaaagagttgcccctctttagaaagggtgttttccttttagtagttttcaaaactgtgtctttactaaagagaacagtctccttgtggacaagtattcttgaaggcaaatcatgatcagctttatatctgcggtttaatgaaaaatatggaatcaagccacagatatgctgctctcacagtaaaaatttagctattgaataagtgggaggggacacaaagaaggcagttcacttcccctccctttactcttaggaatgtggaatccctgcagtcttgacctctgtgacctttctacttgatccctcccccatcatcagtagagtacaaaatgatcctctgtaattctgaatatcttggaaaacaaataattataattagaagctgagagtgttccataacacttctctaggctcccaggtcctggaaaatcaataaactggaaaaaaactaagtttatgaaatatcactatgcttacactttctaagcacagacagttaaaagattctaagaaatacaaggacaaataaataaaacaagaagcagtttcaagtcgttgtgagagaaaactcaatcaaatggcaaagagacagcaacatgaaatggctctccactttctgtttccttcaggccccctgcagatgtcattagctttctgtaatttcttatcttcaggggcagtttttattcaagtctatttagacaaaacaagctttaattccagcagtgctatttgtcttgaaccaccaccccccacccttgaaaaaaaggagtggaggaagcatctgaagcaaaaatcagtaaaaggagacagtgacaagagatcaaaatgcattcagcagtcattttaaggggagtaccagtgtaaagaaaataagcccttggaatcagccaattaatcacagaccttccttcctcccactgtgtgagtgttgccacccctgtaaaccactgactccatgcactctcaccatcaactttccctgtcacgttccagacagactcctgtgtcttcaagaccaatacatgtaagtggccagttgagagctgtgattactcaccctttctgtaatgtgtgcccacaagataaaccatccatgctgaccgcagtggtctacccttgaggtcattccttgcaaacatcctcattgcttagctgaaacctctacttctgttctttttcatgaaattcacttcatttagggccagttatactcatcacctgttatgcatttcagagcctatgatttttgtatataacatgtctcccattctattttattttgtaagagtcaactttctgtgatttttttttttagctctatttggctttctgtcacgataaataacagttttgctatttgcaaaataaagctgattatcattattttagtttccagaggttagaaaaaactgaaataccgtagatgttcagaagtatgaaaccatcccatttctcggtgcattcaatttagtttacttgcatttttttctttgtctggaatactaacatttcatgttcattggggacaaaaataagaaaatttaattaagatgagtgaaaatatgaaaacattgatcttgttatcctaaaataacctattttaaattatttacttattaactatttaatattatggtttctattctcttagtctttttgtacatattttaaaatcattttatacttttaaattacaaaatgtattatacaatgcataaagttttatctttttagacctttttcctatactcaaaaatatgtagtaaacttctttatttatcatttttgtaggctgcataattttctacctaatagaatatattatagcttatttcaccagtcctccagacttgaatatttaggttttctccattgttttaaagaatgctgcaactgacatctctgttactaaatgtttgcacacatcctaaattatctctataaaataaaattagaggcatataattgttcaggcaaaaagtgtgcccagcatttagggttctgatacatagtaataatttatactcccatcagtagtgtctgaaaactcagggtttacatttcttgtatataaggaatctcttgccatggattttagttccattttagttctatttagctttcatccccaggcctcttataatcctacttatttcacatatggtcctgatattatcagcttttttttttagtagccttttgccctttgctgcttaagcatgtgtttctggatgagattctgattcctaattaaatagattcagattactgattgaattttctgagtatcctgtcccatatgtcagtgtccctcagaaagtcaacagaaaactttggaatggtataataattaataattgaaagaagaattcaattaagaatatgaagttggccctaacattcattattcttattgccacacctggttaacaatacattctttttttttttttttaagagttttttcgacccctccagaaaaaaaaaaaaaatagaataaaacaaaaatagatcaggttctgattaattataaaacctctggtttcaatccagtttgcagaatgataccatgggtataaaagtcaaaacattagctgaaaattgtaattttttaaggaaattatttcaatataagatacacatcatttgactctcttgttccttacagagtgatccaagaacaggacctgttactttccatccattgtcatttcatagaccccttgaagcaacccagtggttggtagcagcaatctttgtgcagatgaggactctgaagctcagaaatgttgtataacttgtttaatacaaagcccacgctctttgtattccatcagaccatatcctgtagatacatatacattgctagggaagtacactatggcaactgagacacctctcacaaggtggtatcgtttataaaaaatagcattatgtatttgtcatcattgcttggttgagtgtccaacacagaaataaaaataagcagggtgccctctttggcatggaaatattctaattcatttccccagagaatgaccatactcaccagtattattttgctctacttgtttgcttttaatcataatatatgcctgtttactttttgtagctataaaaaggtagataaaagaagcactttaggtagatataaaaagcactttaattaagaacatgaattaaaagatacttcaataatgaagtacaatagattaaggaatactttaatagattaaaataacttgaattaaaagatacttaaatgctattgttattaacacaaaggtttaggctaacaaaacgcattttcccaaatatctctctcacctccccccacaatttttattcaggaatgtaagaattgggcttttataaaagcaaccaagggctaaacatctactaagttcttagaaactttgaaggattacagaactctctttctataataaggtttacctgtttgacttgattttgttcaagatggcatttcatactggtgtaaacctaaacaaaaatgtgtaagatttatctcatagaaagacgtgcctgtaagtaattaattcctcactctaattactatttatgcctttactttttattgtaaacattcttgttggaataaactagaaataggttttttttctttacactaaaataactcatgaatagcaatgaaatccatgctgtataatattcaaatgagagatcaggaaagacaaggcttttagttaaatcagtaatattctgtgatggggaaaattgccttgaaaaatacacacacacacacacacacatgcacacacacacacacatacatactactagaaaaagtttgaggttcgattcagagtgtggaaggtacagtgtcttaaaagagtttcagttgcagcatttaggcagatgatcaagaatatgcagaagaaaacaaaagaaatcataattatagtttcctaacagaggtatttgatcctctgcagtgaaccataaaaaactagcgtgggatcagaatcttgagtagcatgtatttaattgtatgcatttcaaagaaatttgaacattttaaaaagttacaccatatgaaaaattgtatataaagacattttctataatattataataattttacaaatgaggaaacagggttagagagagtaagtgagttaccaaagccaatggctagaaagtgagagaggcagaatccaagtactagcctgggattcccaaaccaaagactgttcagctcagccacaagtggaaatggattcttatggggctaagtgattaccattactttaaaaactagtatcagaaatagatgacaagaatttaaatgtatatcaaaatatccctttggtaaatgttagtgtcctcacaggtaaacagagggcaccctcaaatttgagtaatttgagagggtttaaaagagggactgtttacaaaattgcagtcatagagacatagagaaatcacagggagaatgtgaccctcgggtttgtaacagctgggcctgtagaggcgagggaaaagtgcagttactggatgcccagaacagagggctgtgtggagactgcacagtgaccctggaagaaaagggctgcactgttaaccctattctccctctctctaatctcctgcctgcctcaccattggctggaatcagaatcagagagcaagggaacctgttgatgtattctgtagaaggccacatctctaagctcagaggagggtgggaaggaatcttcagaagcacttggagacattcaactgagtcacccaccctggactattcagagcggtctgcagactagagggcagtctctaaatggtttgttcagatttgctatgaaacaaggaacttgcatcagaatgtaaatcaattatgtcaccaagtgtactgtttagttcagctgtcattttattcatagcaagatgttctcaatgaaggaaccggtgtgctggcttacatcctggggccaactcctttcaccacagatgggccctttgaatagcactaaactagattccttgctctgtaggtaatgataaaaacgctggaatccctttccttgttttgattttcctaccttaacttctgctaaagagaagaataacgagtatttttctgtacctaccctgagcctggcactgtgctaaggtactttagatgacatttaattcttgcaagttagattattcacttcatctttacagacaagaaacagggccagaaagtttaagtaatgtgcctgtggtctagcaagtgagagagccagcactcaaattcagatcttactccaaagtccatgcccctcactgtttgtaggctatcccaggactgtgcttaaaattatctgacattaacaccaagaaataaagcagggttgttgggggattgccttatatggagacctatgactatgttctgtatacatatgctatgcatgattcctgggaatagataaaacccagctccccccaaatcagatggcactgtttgtgaatacgatgttactccacgttacaaggccttgtccagcccagccagccaggtcagagatgaattcagtttgtttctaagtggctgttgtctgttgccatctctttttaaacctgggaggtcaggaagaagatagggagaaagaattcatgagagggatgcatttccttagaaatgttattaattggctgggcaaaacaagagaaggaaataaaatagctgctccttactaagtaaaggcatcttcttcccttatctcattaaaaattaaaagcactcttggtttaagtagggcaaattagtaattaagtgctatataatgaacttgtataaacagaatattgaaggggaagccaaattaatcactctgctggcttgtttttgcccccattaatgcaccttttactcaggtccttcctgtgataccaggatgcattttctgctctcctctgctgctggagattgggtgggctgtgatagttgggctgacagatgacagtggactagatctggaaaagtcatgtgtaggggcctcgatggccatttcattttttaagccaaggctcatcagcacaagcctgcatgtgacgggaacagccttagacagtagcagggcaaggaagaattagacacaatgtcggtacccaaggaattcccagtctactggtggcgggaggttgggcacagatggatacagttatgaaaaagtctaaggtgtaatggcaaagactatttccttggactcaaatcttggctcagccacttaccttgggtgagttacttagtttctctgtgtctcagaggcctcacctgtgaaagattccattgcaattactctgcaatggaatgatggagcatttgaggagtgacttccactgtcttaagagggctgggaaagtcttccagaagaggcaacctttggctggtgacggagctagaactcagggtaccgtgggaccccccaggcctatgctcctcatctttgcagcatagtgcctcctctgaaagcggaagaaggagcttgggcctcaacccaggacaaatctctctccatttcagctcaacatagtaaatattagtaataacatctggatcctcagtctcatgatatgttagcaactacctgccaagtatgtggggtgaggagtagaaagagtaagtgagctgagtccatcacaggctgggtaagatgaaatcaaatggagcagcagaaagtagccctctaagtcaccttgctgaacctcacggtgatgccatctcctcggcttgctagctgtgtgaacacacctggctgggcaagctacttaatttctctgatctcagttccatattaactgaccccattgagtttctgcaaagattctgtgaatgaaagcacatttagcacaatgcctattcagcagaaaagtactattatcattccctgtgttcatttgatcttcaccacaaccctatgaggtaggtggcatcattgtgccactctattaagcaagaaattgaggcaccaagctattgaaaatctcgcctaaggtcatctagatggttagtggcagaacgatggtttaaactcaagtggtctggctccagccctgccctctgcgtatcccccacagccctgtgctttggagggcacctatagctaggtttgcatgtcacatgctagaaatagggtagacgcttctcaaggatgtccggacctctctctcactactgaggaagaagttatttccttctgcttgagggaatggtggggcagagcctacagctgtggtgaccctttgacaggtggggcaggtagagcaggcacaagtgactcaccagggagcattagccctaggatgcagtaggaatgcagctgctgcactgatcttggcagttttgattagtgaacagaataatttatttgtcattcatactctgcttccataaaggatttaagaaagcttacaataagtgactaaatagttactggaataaaactcataagttagaaatgatgtaaaaagaggaaaatacacatatatatacatataaacatgggaagataccagcaaaggacaaggtgatttgattctgtatcaggtaggagaaaagtactagaaaagtattagtattaatatttgtattcaaagtactgccaaagaatgttgaaaatcagattgttttaattctggattggtgagtgccacaccaaatatctatgggacagatctggcttatctatgggtctctgatctggactaggcagttattattatttttttttaaatgaggtctcgctctattgcccaggctggagcgcagtgacataatcatggctcactgcagcctcaaacacctgttcaagcaatcccctagggggttactttgactgaacttcaggcaaccaaggcaaaactgggaaaagtgtcaagtcatatggagtcaaagaattataccaattctttgaaagagaccacatttttccttataccaaattctaaaatcattatttctttaaaaatgaacttagaaatccttccatggaactcttatagaagaaggcagaattcattatataccaccttgctgagagcccagatcataacattgaaacctgacttcgggtctaggataggctgggtttatagctttttggagatgtcacttgactcagtgatagaaccaagaatacccagtttggtagagagatagcatgtcccttcacctttttccatgaatattccttcccttggccagctttgcaaacaaagctgtgttactgacctaggagtgtctcatagtacctcagtactaaagctttttacaagcctggcatcagagaagtgctaaaatgaagcacccgtcaatcgagaagggcaacagatgttgaagcatatcaaatatcagtaaacagcaagccacagagactgctgaacttggcatcctcatagcaaaaataccctgttgcctttaagagagaacgctgtggacttttataaaccacattaagtgatgtatttttttctccatttggacaattgctaccctatgaaatattttccctgaaagatggtctgctatcctctattatttttttttaatctctacttttttaagggcaaacttaatgctcacagagtgttctaggctctcagccctggaaatataggtctccagaaattgagaggagtttcatattcagcttatctagtaccctctcttttactattagccgtatgattcatattataagtaataaatcgagctgtatttcaatcctgtagctgtgcactagattagtccctttacctctctaagcctgcttactcatttgtataaaaataagactattaagaacacatacctcatgcaattgttgtgaaaattaaatgagatgatatgcaagaagtatttggcacagttgctagtatgaataaactctcaatgagaggtatacaaaattatagcaatatttatgatgatatctatcattactattagctgactataagtcacatgctgtattaatgctttacatatattactgaaaggtggctgggctggtcctttgcctgtttgctctcagagagtgctccttcccctgctctgctgtgtgttacacttcctaggctctcttgcacctggcctctgagcaggcttggccattgggaggtaatggtgggagaatgactgatgtgcaggcagaagtcaggtcatttctccccttcactacagcagcagctgcattttctgtctgattccagctcccagcctctctcagatcccagttctggccactcagcttttctttggtttccgttctatactgacattccctgttcctggctctagtcacaccactgcctcctgtcatcccttgattcctaagaggggtagcatctgtctgctgtcggtaacctctgtgtggcttcaacaacctgttgggcttctaggtctcttctgtcactaatgaaactaatttcttttttttttttgagacacagtctcactctgtcgcccaggctggagtgcagtggcacaatctcggctcactgcaagctctgcctcctgggttcacgccattctcctgcctcagcctcccgagtagctgggactacaggtacccaccaccacacctggctattttttttttttttttaagtagagatggtgtttcaccgtgttagccaggatgacctcgatctcctgacctcgtgatccacccacctcggcctcctaaagtgctgggattacaggcgtgagccaccacgtctggctgaaactaatttcttatatttaattcctcctgttcaaagacctagagtaggtctttgggctacctagctaacttgactggtagtccagctacctgactggactctgactgatatcattgcttttaactactaaaagaaaaggtagtccttatagagaattcacttctcctcctctccctgttggagtgagccaagccaactggagaagggatggctggttatcatggagagacgttcacttggactaaagctcaaaagacaataaattgacctaagcatctttgatgaatactgcctatacacccagctgagtttggcattgaggccaggagcctcaggtagcttaccccctctctgaggagacaagattcaagtacaagtcatagccaagcacactacaagatagtgtctagtcagaaggaataggaactcctctttcttgagccagagccctggaccattcactattctaggtaagtaactataatagatatgtgattattctcacatgaaaaatgaggaaatggaggctcagagagggcaagtgatttacccaaagtcacactgcaattaagtagtggtcttagcagcttaagtctgtatgtcctagaacctgtttatgggacttatatctgttcctcaaagttttctaatctttttgtcagtttcaaagcagatagtaagaaaactacatacataattcatattgccctggtcttgtagaaatgaccttacagaaacaatattcagccttattcacctaattctcagaacaggtttatgtggaaagtttattgtgttcattttttacagatgacaaagcagaatcaaaaaagtaaaggaatttacccaagttcataccgaacgttcatattcaacctggaatttgaatgcaggtttttctctccccaagcatatgctctttccacttggggacgtccaagaactggaccatatgtagtataagaccaagtgttttttagaattttttttttttttttgagatggagtctcactctgtcgcctaggctggagtgcagtggcgcaatcttggctcactgcaacctccacctccctggttcaagtgattctcctacctcagcctcccaagtagctgggattacaggcacctgccaccacacctggctgatttttgtatttttagtagagacaggatttcaccatattggccaggctggtctcgaactcctgacctcaggtgatctgcccacctcggcctcccaaagtgctgggatgataggcgtgagccacctcgtctggcctagacatttttttaaaaggttggggagaaaggccaggtaccctatcttccaggaacagacagttgggttagagaagtatatataaagtgacctgaaaccagagagtgctgttgcataatctactctctggtagtgactaccagcaggaaagagtagcctggctttgtgtaagaaatggggcttgaaatgggctggagtggaaacattaatttaggacaggcagagaagcagcaggaagagggatttttagataaaggtgctggtgagagcaaagaaacagatacagacagaacggagatcaacgttaactcctgggaagggtcccagttcaggagtagtgaaaaagaaagttggatagataggaccacagttgattacaggtaggggttgttaaccacaaacagatcaattaggaatttgatcagcagtcttgggagtactttttgctcagtattcccttatcctttaactgtcttttaaaaaaatgttgcaagctgatagtctcactttaaaaaaaaaaacgttaagtccttcttagataatactgctttctgcttaagaaaaatagcttttaaattagttcagcctgtgagtaataataaaagtttattacttatctctcacagttttgaagagtctctaaaatagaagggaatactctttaaatgcccctaaagtgctatcctctttcactacagttcatttgtgtatagggtgttataaaatcacacatttgagaatttcaggatggagaaagcaccttctgaagcaatgtcattgagagatggggagcaagccactttctaccagctcaaaatctactccctcctccctccccaacccctccctgacacctgggcctagaggagcctgtgtgttggatagagttgacggcagtgaaattcctaccaagttggccctttcagtttcacctgtcagtgtctctgatgaagagggatcttgacaaaccagactggtttggataattggactacagcagttgtcttcatctcagtaaactgactaaccactacagaggctggaggagaaatttatagaaaatcctaaaatggaaattgaagcaagtgtttcaatgactaggaaacaacaggctttagtgaggttccaacatattatagtatggtggggtgctgggactcctgtcttcaaggggcccctaaaagtgatagaggggattcatttagtatgccccagctgccatttaagcactttgtggttattggctcacttagtcctcacaacggtcccatgagatcctgatattagttgtactttgcacacaaggaacctgaatcaccaagaggccacgcgctttcccaagcttacatagctggtaaaaggtgaagctcagatacaaacccagattttctgactctgtggtctgttcactgtaaatactgaaacccatctctataaagctcctttgggaaactcatcttggtgaggcccacctctacacggccctacccccatgtgcccatctcttgcaccgcccttagatgttgccatgtttgctgatctcactcaagtgtgagcttccatataagggtccaagtcttactgatccttagccagtagtcagtgctggatacatgtatgctgtaccagactggaggtgaagttttacagagactttgtaatcttcctgaagctggctaagaaggcagccacctgtgactagttacacagaaacccagccacttaaagcagtggcactgctggggatggacttagatttaaagtcgctagcaggtaaaatctgacctatgtctccagaaacaactttacttgtgcacattagctgtgactgtaaactgctgcttaacggttctcacttgctctaatttttcaaagactgactccccagtcattagagtctgttctgttactagtaactcagtggatgatctggaacaagaggtctacctctttgggccacagtttcctcatctttaaactgaaagaatcagattctggttttcaaaaatgtaaagcagtggaacctttgggaggccaatacagaaaacagaaggtgaactgtgtctctggcttatccatcacaccctctttccccactgcctggcagccttggagggtctttgctgaacataagcactggactagatctttccaaaggaaataactgaaaatattataatgtttaataatgatacttaataattcaataataaagtaacttcaaaatagcctagcctaccttgagaaaagcaggttggagggccctcaccatggggtcactgtgcctgtctgtgttactgtcaaacattgtgtgttccaggcacggaggggtgtcagctcagcctgataatgtacagtggattggggaagctaaagcctctgggcctcattctccttggctgaaaacagactgcgtgtcatggcactggtgaattagaaattctatccagccactcttggagattgattttccgtctggggatctgacctcttgcttcactagcagaggggatcagactgttctgggaggagtcaacgagctggccctcagaaaagccttctctttcttttttgttctttttttttcttttcttttttttttttttttaactgtatgtttcaaagggaaagtctgattactttggggacttaacactaccagtttgaattcttcttggtacttacagccttaagatatccatacacccccacatccgtcctttgtgctagaagattactgaagatttaattccatttatgtcattggatttgtaaaaaaccccttttggattcaaagatgaaggcctcacttactttatttttgtcattttcacagaccccttatgtaaatgcctcaagagtaagaatcttgctcaagtgatttttgtatctccaatggctaacaaggagcctgacatagagtagctgcttggtaaatatgtgttcattcattcaacaaatacccccaaggtacaacgataagaaaaataactatagtcctaatactgatcacctctgcagttgactggaagagacagttaaaaagataagtacaaataaatgtatcttgggttaagtgctataaaggaaaagaacaggttcaatggaaggaaaaattagaattgttgatacatgaatggaagtaaatgacccggacttccaactctaaatctctgtctcatttcacctctttgtaaataatcattgctattatgttaaatatcacaactactgtcatttcttgtttacccactacattctaagcttggtgctgacatctttgtatttattatataaaattctcaaaattactctgcccgttaggctttcttatcacttattccaaatgcaaaaataaggtccagggaagataattatgtaacttgttcatgattggagagctaataagtgtcagagatgaattgaaccaaagttggtgtgacaaagcctctgttttaagcaaaagggaaaaaaaattctcattaactccaaggattatcatcaggagtccaacagggttcccaatttgggaactactatatcattatcatatggcaaatggtccactatgttagatgagaggacaaaaaaaaaaaaaaaagttgggggagaaactttgctgtagagtgggagggaaaaagaggaagatagtcttcttgcatgggccgtcttatcagcctagcaataataaactatcaccatagcaacaggaagtctaattgatggcagatgttgagccactttaaaagccacgccaactgaatgccaagctgatgctgtaaacctctctcctctcccgcggctagactaatcatgctatggtcatattggagagacccatctttcaagggtggaagaaactctggacttggcatcagaagacttgagtctgagcctcacatctgcccgtgctgagctctgttgccttgagcaagtcagttcatcaaaagtagaagatagttatcattaattttatcatcattattactaccagtagtaggaactctctgaaattcaatttcacaatctaaaagatagataatatttgtgtaagcatcgtcagaaggtttaaatggaataaaagatgtggaagtgcttagtaaactataaagtaattcacaaatacaaaatattaacaccaagagacagcttgacgtgctagaaagagtttgcattggcatcagacagatatggctgcttacagactgcttcatctgaacgcatcacttacatgctcagcctcagttttctatcagtaaaatttcttagtgtaaatctgtaaaatgttctacccatgttacaaacctgtggcttaattaacctctctacacttcagttactcctctgtaaaatggaggtggcactggcacctccctcataaggtcgttgtgatgattaagtaagttaatacaggaagaacatttagaacagtgcctggcacaggcagcgtgtcatacatattaatggtggtaatggtagtggtggtggagaagaagaagaggaaggagaagaggaggaagaaagagcaattgaaatcatatacgtgcatagaactgtgaaagctggtggtaatggtagtggtggtggagaaggagaagaggaaggagaagaagaggaaggaagaggaggaggaagagcagttgaagtcatatacgtgcacagaactgggaaagctggccaggctcggtggctcacacctgtaatcccagcactttgagaggctgaggccagtgaatcccttgagcctaggagtttgagaccagcctgggcaacatggtgaaaacctgtcactacaaaaaatacaaaaattagctggatgtggtggtgtatgcctatagtctcagctactcgggaggctgaggtgggaggattgcttgaacctgggaggcagaagttgcagtgagccaatgttacgccactgcactccagcctgggcaacagagtgagaccctgtctcaaaaaaagtaaatggccgggcgcggtggctcacgcctgtaatcccagcactttgggaggctgaggagggcggattacaaggtcaggagatcgagaccacggtgaaatcccatctctactaaaaatacaaaaaattagctgggcacagtggcgggcgcctgtcgtcccagctactcgggaggctgaggcaggagaatggcgtgaacccgggaggaggagcttgcagtgagttgagatcacgccactgcactccagcctgggcgacaaagcaagactccgtcttaaataaataaataaataaataaataaataaataaataaataaataaaatactgaaagctccatgtgatacaagtgaggacctccatagtcaatgtcaaaatacttttggtcagttcgtggactggttcacatgtcttatcagttttctcaaagtttccattgtctacatagccttttttgtcatgcccagtatgcatgcctgctctgatccttggctatgaagttttcaatgggaaagggacaaccaggacaaagaattggtagaaaccatgagaaatattttctcagagaccaaggtctccacaggccaggatttctcagagtcttcttcgatatattaaaaagtatttctggaaaaaattagtttgaaaactgctatgatgttcaagataactaggtgtcttttttttttttttttaaagagatggggtctcaatgtgttgcccaggctggactctaattctgtgcccaagaaatcctccctcctcagttttccaggtagctgggactatggatgtacttcacagtacccagctctaactaggcgtcttcatagcaaggcatctgttaagactttaaaatgtaaacatgcattgtgaatctcccaggttggataggcatagagagtatggtgtttcccaaatttacttgatcgaagaattagtttttcatggagcatcttactttgctaaagtttcaagtaccaaaattgggaaatgttgatgtaagcccatagccaagacaatcaagccttaagcatagtaccacaaaacaggtttgaaaactcctactaatccttccatcaattcatgtatctatttaacaaattaaaagagttctatatgtggcagtgactatgtgctagatggtggagaaacaatgacaagcaagactagtatattctctaccctctcagagttctggtgggcctactggggagagggaaaagttgcccactaattttattgcaatgacaagtgaaaagatggagaggacaggtgccatgacaccgggagcagcggcttcttacctaacctggtgggtcaaggagagtttcccagggaaaataacttctaagtggagacccaaaggaggagttacagctgtaggacacataggagcttgcaacacactcgcccatgcattccatgttgtatcctcatgacaacctttcttggtagatgcaatgagagtggtaaaagttactaagtggtcattacgacctaatgagttcctactcaatgagtcaggcactgtgctaggcatcttacaaatttattgcatataatcttgacggcaatgagcagtatcctcagtttacaaatgagaagttgaggctcatgggagataagtggtttcccaaccctgtacatgtagttagtacaaaaccaggactttcagatctgcctgattccaaagcccattacactgtggtcaaccagtgctgggcctggaccgtggctggtccataacagggtttttactagtcagaaatacggaagagtaagcagaatgtcatgagttcttccttaagctaatttttttcttcttaaatgacatattatcctgagatgtccccctcccaaccatttgatgtagaaagtcctgtgggttttttttttatatattacttgtcagagaaaactttgagcttcttcttagcaaaataaaaactttctaaccatatgtcagtctcccaagtcattttggaagtgttgccatctatgaaatctaaaaatcatggaagttctgtgtatgcaactttctagaacatattccttctaaaagtgagagaaatatgaaccagcacattgctgtgagttctgctggttcaaaattggatgagttgctgaattccatgggcaccagcagccaaaaatggagataaaataagatcaagtgtcatcttccaaaatgtacagacataccaccagtgacattcaggcattctacgtcctggtttatagacaccctttttctaagttttaatagatactagaaaagtacctagcattaaacctgggttttcatgaacatttttccctagaaaattttaaaaagaaagaaaagtttttttcccaggacttaaagaaatattttatgactaatcaatactataggtagtacttgagaaaagaaaataattgtgaagataggacctgaattactaaaatgtgtgaaatagtacgataatatgtataaaagtgcctcatgcataaaaggccccagtaaatgctttcttcctccctgattcacatggtgagcaagtggcgggggcccaggactaaacctcatagcatcagactcccagtccagtgctccttccaagaggcctttcaattgttttctttctgtctacctacctcacactgtgtccttcatctctctgtctagcccccaggaaaagtgcagcaagtgcaggtatttctgaaatgacgagtggctcgcaaaaaggatctgatgagtgttaatagtaagcaatgtgtacctaagagtgtagacactattagcatttggaaaaataggaatctgaactgagaactggaagggcccttagagatcatcccacacaaaccctctttttacagatgaggaagttgagacccagaaacgggaagtgctttgtgcatggccagagagctcgttgctgatcaaaccaggacaagcatccatatgaaacacgcaaatgtaaaattacatgaaaaaaaaaaaccctttacctccagatgtactgctttccagaaaagtggcgaggaaataccacaaaaatacctttacttcaaaaaatttgaaaatgttgaaggtcatgcttcatattgtgccaggcaagagaacattgtacataattgtaaatcaccattggaggaggtggtcctggttgtattcttttgtttgtttgtaatacacataacataaaatttatcatcttaaccatttttaagtgtacggtttggtggtattaagttcattcacattattgtgcaaccatcaccaccatccatctccggaactcttttcatcttgcaaaactgaaactttacccgttaaacaataactctgcattgccccctcccccaacccctagcaaccaccattctactttctgtctctgtgaatttaactactctttagatacctcatataagtggaatcatacagcatttgtcttttgttgactggctaattgcatttagcataatgttctcaaggtttatccatgctgtagcacgtatcagaatttccttccttcttggttgtattcttaatgcaacatagcttgttctctgtgatctgctgattataaccatcgtcgctgtgaagactttggcgtgcttaacatttttgtgacttctttccagtgggggaaatagatagctcagttgtggacgatagcagcaatgggaagcagtatttgagaagaaatcagactctcttcttccagtcttttgcaagtaggtgacacaagaggtaaacagaattgcatgctgtgcccctccacatcaccccctattttctttgtttcttctgcccaaggcttcagtcaatcagagaagcaatgagagttgaagattttaaaagtgggttttcaaataagacaagcttgggttccagtcctacctctgaaacttactaaatatgtgatcttgggtaacgtgattgaactctctgagcctcagttctgtaatctgtacatagagataataatacttttatcaaaaaagcatgtcttttttttccttctgattgatgagatgctttctgtattttttctggatttaaacatagtttccaaagttaaaatattaatagtacttttccctgtcccattgggttgtttagaaatgtaatgtgatatatgacattttggcctctctgagatgtcttgttccagcccaaagattattagggaacctcatgtcatttgaaaggggagaaagataatttattgataaggttctgcatgtcatatgtatcatttttttctcatcaaaaacactgagtagaactctattatgatacttggtcctttacttcatacttttctatcttcccagctagtcagaaccatgcccaccccgcagttcccaccccttggtcagtacctagcattatgcccagaaaaactacagatgcttcttcacactcccctccaacccccacacccccattaccaaagtgtttctataatgctctgggaatcagcatctcaattcccccatggcctcatggttaaacataccattcattcgacctctcaactgtgacaaagaaggaagcctgggtgtagaaactgatttcagctcccctctgaagttgggcgtctctctttgctgaccacttgggaatttttttttcttgcttctgacccacctctcccctttcttttgataaacaggacagctgtccccaaagggatgaatccattacctttcaccagagttgagttcgttttccatttcatctttctgcttaaagagaaagccctttaaaagcgcagcgcatacattgagtgcgtgtacttaatttttaatatgtgtgtgcccacagccaagagaacagagaaccttaaataataatgaaactgaattgtacatgtcgtatgttttatgtggcactgattcctaaatatgctcctagcagccaggtattatttaatacatccccattaatcaagctgccaaatctaaatgaaaaccatgtttaaatatgtttaataagattatagcttttggttgaatatcaaactaacatagctacatttttccttccagccagctctcatttactgtcttacatttttactctgaaagcttttgtactatcaaaccaatcttgattataaaacaaattataccacaaacttttagtatcgtgagcttcagctgagtccctcagtgtaaatgttaggagaaagaacagttctgagattttttttctggctaaaaaatgatatttttcttcttcttggggtgagcctttgagtttaaaaggaaattaaaaattcaattagagatactaaattgtttgtagcttctgtattaaatgatgtctgccttttgcatagttattgaaagtgtttcatattaaatgtactttttctttttgacggttcaggcttctgttagttttgcaatagtgacacctaggggctgtagagaacattgcatgggctgctaaaatctcaaaaacaacccctctgctcttttgccatggatagaaaaagtatttgtgggtcattggggctgatggagaaagaaggcaaatggtaccctgggcgaggtaggtttccagttctatttaccaggcttccaatatgcaaacaaaaaaaggaggtaaataaaaagaggtttttataaaaataaagaactagctgaacttggagtaacatacagtattctagcagatttttaaagttattgataaaacaacatcatatttattaacatgtttaattctcgttcttatttgcaacagtttgcctgctgttcttgcctttgtaacaggcatgtcccgcgttgattgcagagaagtgatgactgtatgtggtgctttgacttgttctgtgcgaatgtctcgcttctcacatctctaattcttctatttgccttgttcaatattctatatccatattcacccttataaagttgtcattgagacttttagcctatttgttctctccactgatatcattatttcttctagcttctcagagcccttacattttctccatgtttatatggcttgaagcttttaaattcttgatcaaagcaatcataaatgtgtctgttacaaacacattaaaattcttcgattatataaaaactgacaaacaagtcttataaaactgtttttgtactacattaagttcaaaataggtggcacatgtttaactttgtacactgtaggaattctaagaatcatttcaaaaagaaaaagcaaatacagtgcacagcaatgcatataattcttatagatgagtattatctatctgtcatatctctctgtaaataatgatggtgacaatgatgataggcaaagtttattgatgttttttatatgccaagcactgttctaaccactttgcatgaattaactcagtcaccatgggacaggaactgttattatcccaatttttacccacattcacagaatgcttctgtgttccaacaaggaaacttcaacaaagtagtgcatgagcttatcacaggtcgtgtgcaataagagtttatgttattagtttttccttgaactgcttgggagtcagtgtcacttttcttagccccattagcctgccctccctttggagtgtgcacgtctcctttactgtctgatacctgtctgctttcctcactgagtgcctctagctttgtctagcaacacctgccctcatagaacttacattcagttgggaagatcctaagaaacagcaatcacaacaagtaatattgatttcaggtaacaagaaatgttacaaaagaaagcaaagtgatatcagggagcaaaaatggaatgacagactgggtgtgaagggctggctttgtgagcaggagagaggccctcctgaggaagggatgttcgtggtgagtcccaaatgacagaaaggacagcaagtgcaaaggccctggagtgggaatgaattgaacatgtgtgaaggaaagcaaaaaaagcagggaggctggaatgtgttgagtaaggagaatactgtggggctcctctctctttcctttctctgctgccaacacttgtgttttctgtctcagactctagtttcactgaattcaaagaaatggtttggaattgcaaaatcctgagatgtcatccactgggagtgctggggatagggggacacgtgcaagagaattggcctaagaaaggttataccctgagtatcttccatatatacccatagccccacacatttttatcttgcaaagtcagttaagatgaacataaggcagaagtggaatcccagcacagttcatcctcagtgctccacagcacggaacagaccttggatatcgtacttcacacaagtttggtgactctttttttatgtctgcctctccactagactggaaattgactgaggacagagcttatgtcataatcattcttcagtcatttttctttcttgcattcattttatcagtaaatgcttcttgagtgccatctgtgtgccaaccactcgtactaggcccatctatctctgcttggataaaattccaagcaagaaagatacagtccctgctctcaagtttccaacagtattgcagaagaggcataccataaaatagcatcatacagtgtgctatgcctcagctttggggaggcagagaaaatgttccaaaggaagtgacagttgagtccagtcaggacttggaagtataaataaaggcgagtatatgtctgtatgtgtgtgtgtttctgtgtgtttggagaggggtatgcatgtgtagtgggcccgagatgggagagaatgtgtgcagaattttaaaccttgggaacaaaggattcatgaactcagaggtgaactcaactgtgtactggatgaaaatgtgaatgaatgagtacatgaatgtataaatgaatgaatcagtgagtgagtttttcagaggcagctcatgaaatggagattgtattagcgtgtttttacactgctataaagatactacctgagactgagtagtttaaaaacaaaaaaaggtttaactgactcactgttctgcatgacttacagtcatggtggagggtgaaggggaagcaggcaccttctttacaaggcggtaggagagagagagcaggggaaactgccatattaaaaccatcagctctcgtgagaactccctcactaccatgagaacagcatggtggaaacagcccccatgatccaatcacctctcaccaggttcctccctcaacatacggggattacaattcgaggtgagatttggatggggagacaaactatatcagaggtataaagccaaaaggcatttttattaatttaccctgagaaatcactattccaaattctgcccattatttccatgtaggcagactcatatggagacctatatctttatcaaaaatgtgcttgtcaagtagattattcagtgacttattgggagaaaaggttaggcattcatcttattgtagggatggctttatcaatggaactgcatatagctgatggccaatattcatctttatcctgaacattgcttagatgagaactatggggtaaacaaatgagtgaaaaaaataagttaaaatgtcaagggtgttcatagaagagagagaggctgttaatgtggtctagatgccagaggtggagagctggcttggaaagtagggactagattctagtctttgctgtactactctcttgtgtgacattgagcaactagccatcttcaaacccgtaaagtggaactatgccaggcaatgtctaaatttagtctctatcagctctagaattttgtgttcatcttagttatacctgctgaggagggagaggtattgaatgtgtatggacaccagctgggcagcttcctcatggtccctggatgacagctttgtcctggggcactcaatcctccagagtaccttaagaagctgtcctaatctgccatacacttgggagggttctggctgttaaccacctatgttggacacactgctgctattctccttccccacttttatctgttattctaaagtgatctgagaatttggctattcctgatgttgccttttcttatactccacgtagggagcctctgctcagagggttattcgtaaaaattaatgagatacatgtaaagcagccagaacagtacctggcacatgaaaaatagtttaatactatttgtcataattattcctgcagcccttcattgttgcctttcttcctcaggtattttctgccttgttctccaacaagcacaagggatacaggggtaaataggataccatctctgtgctgaggggttttgtccagtgctatttactgagtgccttccatgtgccaggcactaaggttaaatcattaagcccccaccacaatccattgcaatactcattatacccatttcatcttccaggaaagtgcatcccagaacagaaaagtcatgtgacattcccagcatcacacaattagtaaatggcaaagttggaattggagctccagtctcacagactccaaatccagtgttctttccaccatgtcacccagctaccacaaggctgccattgcacagttttgaaaggacaaagaagcagcagtgcatgatggaagtcagcataatgggaaataagctctccttccctgggcatctacttctaacttgcagaagaataggaaggctagtcttgtgagcccagctcccagcagtccttgctttagcccatctgaaaaggatctgtctttaaaagcaaggagccagaaaaaataattcatactaaaaacaaactctgtcatgagtcatttgactttgctttcccctgaacacatagtttatgtcttgggtgagctaaggctaaaggaacatctgatatgttttaggctagcagagccattatttaaggaacttcacatccaatgtgcgcccattggaccctatggtttaaatcaagtcttctgcttatggggcctgacaatttgttattcttgttgtagttgtattggagtgtgattgtgtacatgttttatcaagatgacaagaatcactctggttcatgattcaaaagttctcaggctgttgaactagcctatgcagtagttactctgagtatgtgcgctagacaggaatgtgtatatgtgcgcacatgttcagatgtgtgagcacttacagaaagagaagagaatgagagaaaggcggattccagctgagcatcttaccattcctatcagcagaagagcgacccagccctggggctgggtcagaggatttctcaatcctgggagaacagcagataaccccgagcacaaagcaagtgtttctgtctctgttgccaacttgcttttctttagatcattgaaaaatgacaggaatacacttactctgtaaaagcacgaacaatgtaggaatatatagagtaaaagcaaaaggcacaaacctctcctgatcccaaaagtaatcactattatgcgttttgtatgtctgtcttacattttttatgtattcacagacatatatatacacatatatatcatatagtagagattgtataatagaatactatactgtttaaatagtagaggatgaaaaagagataactttttttatctacaagatactttggaatatattaatacatataaagctgccccatgtctattacatgctgacagtaattccagaatctgcatatataaaaaactgtttaaccaatgtgttgatagacctttaggtagtttctagtgtttagctgttacagagacacaaagattattgttggtgtagttctttatatacaaatatgaggacttcttttagagaaatacaaaaaaaaagtggaatttctagtggaaggatttgtgcatttaaaattttgttagctgtggccaaaatgtcctccaaaaaagctgtcccaattcgtattcctgccaatgatgtccctgtgcctttgccaatgctggatattgtcagttgtttaatattttttgccaattttcgggcagaaaatgactgctcattgttcttttcctttgcctttccccattactagtaagaatgaacattctctttatacccatcaagtacttttctgttaatggcctattaatatcttttcttcattttcctatagggttgtttgtcctttcctcattgatttagaggagttctttatctgctctacataccaattctttatctatcattacatactgaagacattcttatagtatgtcccttcttatctacctttgcttacaatatctggtaccggagttttaaaacttcataaacttttatctgtgaatctctttatgacatcagaatttcttggaaatgttccctttaaactatttctttacttgaagctgtgtttttcagactgataatgttttagacttttatgtgcccaagagtaaacttttatgtgcccaagagttttagacttttatgtgcgcagtaaggactgaggaggtgagtgttttaccaagggcaaagctgagatcagaacataccaggctggcaggtccctgtgtttgttaaagacattcttagtaattttatcattaattatggggaaattctaaaactccattgggatcagccacaggcaaatgagatgctgcaagaagctggatactgagcatgcagcctgaagtcatctgagcgttggatcataaccagcttcctctacttaccacttgactttgagacataactttgcttctctgagccttagtttatttctctgtagaatggagctaatcacaacttcaaatgactattgtgaggtttcacatttcccatgtttcagcacttggtatctgctcaatacatgtttgcttttgccttttctggttaaagaccttttttcccctggacctttgaatgcaactggtcatctaaaactattgacttccatctcttctgaggatttttgtagccaaatggtggaggcatatctagcttgagagtctgaggcaatttcctgatgatacatctcagtgggcctaaaggaaacgaaacacctacaccattgctcaatgctggaaaattctccacagtggccgacccctttaggaggagggaagccagggctctggggaacagctcctgtctacgtgggtggagagttctttcttcaagcattgtggatcgtaaactcactgagcctcctgcctgtacaggaataaatttcccctgcctttgagatcatctcctcttctcctcacctcaacctggcatccttctcttcttaaggcaacacagcactagaggctgactgcccagcctcttgagccagacttcctggaattaaaacccagctctgccactctttacttgtgaggcctggagcaagtttcttaattactctctgcctctgtttccctggctgtaagatgagagtgctaatgttatctacctcacagagttgttacatgggtcactatttataaagtacttggcacatagtacagtactcagggagctactaataaatcatatatggtatctgaatttgggcttctcatttcacagccaattgactttggataatatgcttactccaagctcagctctctaatttgtaaaatgagtatgaaaatatctacttcatggaattgctgggcaagtcaaatgggataatgtgtgtaatgattgtaggtactcaagaggtggtagctactgtggtgatgagtatcaaaaaagacaggaatgaatatacagagactatcctaattctcaaaagccaagagactggtagaatgtggcctccacactcttagccctgtgaccttagacctaacctcttcaacattcagtttcctgatctgtagaattagattgacaatggtgcctacctctaggttcatgatgaagaaggagtaataataaattgggttcatagaaagtgcttaataaaattaattattattgttacctgtatctcctgtccatttaagggaagattcctatttgtagtcaggggtccctgggcagaagtgatgacagcacaggcagagggctgcaccccctgccctctccaactctggggatatagcacaaggtaagaaagagaagcaaatctaaggaagggaaattgagatcaaagcctggtttctatggatcaggccaaaatgattgagggagagagagaaacacaactcaggatgtccatcaggatttatctgcagcagtgtgtctcattttaactcttaaaacagttttgttggataggtactattatttccagttttgcctagcgaaactgcgagctggagaggttaagtgactcgcctaaggtcagatagctaaaaagtagaaaaactgggatttgagcccaagtctgtccaactctaaatccctaatgatatgcttttaatacatgccttgcctctgctgggaatgactcagaggccaagctgtaggaggagggggagagagggatgactgtgtttctcagggtgaacagagtaggcagccacaggggcagtaggcccggagctaacaggccttcatgtaaaaatttggaaattttgcctgaaagacaagagagtgttttcagctgaggccgttttcaactgtaccctgtgtactaggctgagggtaaaccaaaacacagccataaatagttctccacagaattctcgtcacaacagcccactgtattccttctgtttggagatgaatgttgaaacaccatgcatgaaaatggctgagtctgttgctgttcatgaagtctagtcacagcccattcaaatgaagcccccttggatgtgaatagagatacgagaatcagcagatgatcagccatcatggactcttgacaaatggctttgcccaaagaatcggcatccttggacttcatacaaagcaggccttcccaaagcctctgttttgaagggacccagtctgtttgaataggtgtttacccacttgctacagaatatgtttgtatacctgttctttaatttaaaaaagtatcaaagctagaagggactttaacaagtcatctagtccaatgcatttaaaagaaggggacatttggttccagagtaggaggtaactgtcctaaggttatatagagagaatccgagatgaaatccagggcctcctgtttcttagtctaaaacatgtctgactctgcccttgtgaatgcagccaatacagggacaaaaagtctttgggcttctctaaagggagggactgcaatgtgttagaaatgggaaggaggttatgtttgcccttggtgctttctacctttcccatctattcttttcctcccatttcattttttttttcctcatctgtcagaactaaccagtctaatgtgctcaattttcattccctaagaatcagactcccagatttccagagttactgctgtttacctatttcagagcttttccctacttcaactgggctgccttttgaacaatgaaagggaccctagaccaggggaataccaggctcggcccctattaagtgggtctccttggttaagacattgcctacccaagtgtcaattctcaatctctaaggtgcaggtgagaaagaggaaagggacaaatagtaattgatcacctgatacatgctgaactctaattatataaccagacttaatctttaaaggaggttatgtgaggtgggtagatattattatcttcatttgcaaatgaggaactagatttctagaaaggtaattcacgttctcaaagccatggaatcagaaagggagagagttgggacctgtacctagatttgtctgaaaaatccaaagtacaggttgagcagcgctaatttgaaaatctaaatccaacatgctccaaaatctgaaactttttgagcactgatatgacacccaaatgtcatgctcaaaggaaatgctcattggagcatttccagttttggattttggattagggatgctcaaccagtaattatttaatacaaacattcaaaaatccaaaattaaaaatacttctgattcctagaattttggataagggctcaaccttttaaactaaacctgtttaagctgtttcaagtttgccaagtaagagaaagtgagatgaatatatgtgttcatacacacacatacacacacacgcgcgcgcgcatacacgtcctcactctgtattagtccattttcacactgctataaagatactacctgagactgggtagtttataaacaaaacaagtttaattgactcacagttccacatggctggggaggccgcaggaaacttacaatcatggtggaaggtaaaggggaagcaggcacattcttcacaagacagcaggaaaaagagtgagtgcagaggaaactgccacttttaagccatcagctggcatgagaattctctcactatcacaagaacagcatgaggaaaccacccccataatccaatcacttcctaccaggtccctccctcaatacgtggggattacaatttgagatgagatttaggtggagacacagaatgaaactatatcacacacacacacacacacacacacacacacacactggaagagtgctttccaaactatgaaatgccgcccacaggtggacaattagccacccagtccaggccaagaatgaagtggctgtcagcatgccacagccatcacacaaggaatctacttgcaagtgagaggagcggaggaaacatttagaggcaagcacctatcagttaggtcagtagttctcaaatgtcactggagggccactgcaggcagggctggctacaatttgtatatcccccaatttgtgggacccagtgcaaaatgaaaatgtaggtccctgaccagggacaggaaagtcactccttccaacaggccttctgtctcaacctatggctgacaggtgacttccaaggctttccaaattctacatggaacccctctgtgtgttgtcagcctgacactccatggcagtggtagccagctggggtcactgccttgacccaccctgagacacagggggcccaatgtctggcctgactctttccacacctatgctcatctttatgaggagaagagcaagagcaaaacatgcccccacccctagccatgtaaccctgccaccaactcacagatgtgtggtcagcagtgggatggggcagcagaagacagggagtggatggccaagaactggccctggagactagccccattgttccatcaatttttcacctataaaacacagattcaaagataaaataggattccttatttaataaatggtgttgggaaaactggctagccgtatgcagaaaactgaaactggaccccttccttacatcttatacaaaaattaactcaagatggattaaagatttaaatgtaagacttaaaaccagaaaaaccctagaagaaaacctaggcaataccattcaggacataggcatgggcaaagacttcatgactaaaacaccgaaagcaatggcaacaaaagccaaaattgacaaatgggatctaattaaactaaagagcttctgcacagcaaaagaaactatcatcagagtgaacaggcaacctacagaaggggagaaaatttttgcaatctatccatctgaaaaatggctaatatccagaatttacaaagaacttaaacaaatttacaagaaaaaagcaaccccatcaaaaagtgggcaaagaatatgaacagacacttttcaaaagaagacatttatgtggcctacaaacatatgaaaaaaagttcatcatcactgctcattagagaaatgcaaatcaaaaccacagagataccgtctcaacaccagttggaatggtgatcactaaagtcaggaaacaacagatgctggagaggatatggagaaataggaacacttttacactgtttttgggaatataaattagttcaacctttgtggaagacagtgtggcgattcctcaaggatctagaactagaaataccatttgacccagcaatcccattactagatatatacccaaatgattataaatcattctactacaaagacaaatgcacatgtatttttattgcagtactattgacaatagcaaagacttggagccaacccaaatgcccatcaatgttagactggataaagaaaatgtggcacatatacacaatggaatactatgcagccataaaaaagaatgagttcatgtccttcgcagagacatggatgaaactgaaaaccatcattctcagcaaactaacacaggaacagaaaaccaaacaccacatgttctcactcataagtggtagttgaacaatgagaacatatgggcacagggaggggaacatcacagactggggcctgtcaagcagtcgggggaaggggagggatagcattaggagaaatacctaatgtagacaacgggtcggtgggtacagcaaaccaccatgacacatatatacctatgtaacaaacctggatgttcttcacatgtatcccagaacttaaagtataatttaaaaaacaacaacaaagaaagaattgaaagaaattgactgcaaacaattaatgcccagcttgggctctttctggatagagctctgtgcattgcacgggtgtattagtacattttcatgctgctaataaagacatacccgagattgggcaatttacaaaagaaagaggttccatgtggctggagaggcctcacaatcatggcacaaggcaaggaggagcaagtcacatcttacatgaatgacggcaagcaaagatagagcttgtgcagagaaactcccatttttaaaaccatcagatcttgcgagacccattcactatcatgagaagagcacaggaaagacccacccccatgaatcaatcatctccctccaggtccctcccacagcatgggggaattcaagatgagatttggatgcggacacagccaaaccatatcattccaccctggcccctcccaaatctcatgtcctcacatttcaaaactactcatgccttcccaacaatcccccaaagtctgaactcatttcagcattaactcaaaagtccccagtccaaagtctcatctgagacaaggcaagtcccttctgcctatgagcatgtaaaatcaaaagcaagttagttacttcctagatacaatggggatacaggcattgggtaaatacagccattccaaatgggagaaattggccaaaacaaagggtctacaggccccatgcaagtccaaaatccagcaaggcagtcaaatcttaaagctacaaaatgatctcctttgactgtgtctcacatccaggtcacactcatgcaagatgtaggttcccatcatcttgggcagctctgcccctgtggttttgcacggtacgacctctctcccagctgccctcacaagctggcattgagtgtttgcagcttttccaggcgtgcagtgcaagccatcagtggatctaccattctggaatctggaggtcggtggccctcttctctcagctccactaggcggtaccccagtagagactctgtgttaaggctctgacaccacatttccctttgcactgccctagcagaggttctccaagaggacctcacccctatagcaaacttctgcctgggcatccaggtttttccatacatcttctgaaatctaggcagaggttcccaaacctcaattcttgacttctgtgcactggcaggttcagcactacatggaagctgccaaggcttgaggcttgcaccctctgaagccacaggccaagctatagggacgcagggcaccaagtcctaggctgcacacatcatggggatcctgggcccggcccacaacatcactttttcctcttaggcctccaggcttgtgatgggaggggctgccatgaagacctgtgacatgccctagagacattttcctcattgtcttggggattaatatttggctcctcgttacttatgcaaatttctgcagccggcttgaatttctcctcagaaaatgggattttcttttctattgcattgtcaggctgcaaattttgcaaactttcatgctctgttttccttttgaaactgaatgcctttagtagcacccaagtcgcctcttgaatgctttgctgcttaggaatttcttatgccagataccctaaatcatctctctcaagttcaaggttttacaaatctctagggcaggggcaaaatgccaccattctctttgctaaaacataacaagagtcacctttgctcccattcccacaagttcttcatctccgtctgataccacctcagcctagactttattgttcatatcactatcagcatttttgtcaaagccattcaacaagtctctaggaagttcgaaactttcccacatcttcctgtcttcttctgagtcttccaaaccgttctaccctctgcctgttacccagttccaaagccgcttccacatttttgggtatcttttcagcaacaccccactctactggcaccaatttaatgggtgacacactcgtgcagctggtccccactgcaggtccttcacaaagcttcactagtccatgagaaatgaaacaataaggacagggtattgagattttaacaaaattaaatgtagactatttaaatgattctcctttattctgatatcatgataaccacttttttggtattaaaatctccttttggttatgaaataatggtgagagtaaatatggagcagttgctttgtttaaagtccttatataatcaaataaaaagctgacaattatgttgtagatctccaaaaagtttgaatattttattggtccaaagtttgagaactcctactctaagactttcaagaagatggcccttcccacatgtggggctggaacctcttcccctttcactatcatcagaaaggcttccgccctggatacaattagtatttgttgcatacttcagtattttctaggtatatctttgctttttggaagtctaaaacatctggtagaatctttcagaagaagcaacacagaatagaggcattaaaatcaaaatttgaagtctgaaacttctgtttcttaccatcattaagagagaagtgcccaatgacaatcatttctccaaaccatcagcagctccttggaaatgaagtggaagggtgataatatatccaggacagacctagctaatgtcttaatcttggcataattattaataataacattccctttccttccaaaaagtgtctaggactcaaaggtgagttcattgggataataaactatggccaccttaaatgaaggccccttcagctctcctgagctagaaagtcccaaagagcctgctctttccctgggcaggaagccatggtgaccagtggaaggattatgtctgtcttaccagaggcctgggttgggtgccagcatgaagcctgtaggatctacttagatctgggacttcaaagacctagtggtgggtgaatctttgtggcttccatcattgctttgtctctgggagcatcaagttgaaggccaagctagtttctttcctttgatgagggaaaatatgtcaacacaatggtccactgaactctgggaatagacagacatgtggtgtctttgggggattatagcctaaatggttttactctggcacatgtggaattaaatataaaacaaacagctgattgctgttaaattcacatgcataaaaacaaccattactatgtcttctcagctacagtaccagagagtccccctagaatcaagcagttattagatgggactttggagtgagtgtagaaaagaaaaggaggaggagaaggaagaaaatgaggaaaagaggaagaggagagagaaataacaagtcaaataggtggagagttttgaaagttacaaagtctgtgccatttagcatgagttatttttcctttttattccttgtatttgacatatgaaaagaaatctttgctgatactggcttcagattctcaggtttaagtatgctatccttgacccaggaaagagttacatgcatcatacttccgaggccttcaaagaacaacttggagcaagcttgagagtttgcagggcattttggtgacatttctggatgccctttgtttccccctttcaagaaaagccctttctttcgttgccttctcacataacagcttgggattcttgtccctcccagaaatgcatttgaacttgctgggtttgttaagagtcagggcatgaagcatttttccatggtagaaaagttctggcattccaaagcagaactaatgtgggatttgggaagcttgccctatttgtgcacttaattagagctcaccaaaagcagctgatccattggtaccataaaaaaccaatgctgagaccaaggaaggctaagactgtgagtacccttagagggtggtgaacatgaattccacacctgttccctactgactggaatcaggattcaaaggcaaaaagttgtgtgctttccagcaacattcattgggatccgcagcccaatttaatcaattgataggttgccagtgtctaagtcaagtcccgaaacacttggttccccttgggtcaatgaaatttggtcttggttctaatacaaactttaagttggctaaaaatggctgagaaaactactggttttagagtcagtcaagcctgtgctctaagtctgactctgccactatgagatgtcagatcttggagaaactgttcagttacttctgagctttagtttgcttcccggtaaagggacatactaacacctattccatgggtccattatatacacaacagccaacatttgttgagtaattactatgtgcagagcactgtgctaagagcacagtctatgttaactttttaatcctcatacagacctaaggaaatagattctatattggagattggcaaactactccccacaggccaaattttgcctactgactgtttttgaaaataaagttatattgagacacaatcacatccattcattcacatagaccctatggctgctactgtgctacaactgcagagttaaataattgtgacagcgaccaaatggcccataaaacctaaaatacttactatctggcccttcatagaaaaaagtttgcctctgctttaaattatctcaacttaaagatgaaggaaataagccaaaggtattaaaacctattttaagtaggttagctggggccacaaagctggtaacaggtaggactaggatttgaatcaaacagcctgactccagaacttgtgttagtcaccagtatcttatatataatatatatgaaatgcctagcatagtacctagcacacaggagatacttaatacatctgttttattagcatggtattccctttctttttacctcctttcccagtttcctatcaattccagttaccttttgcttttcttctgcaagataattcagttaagcatatttctggccaattctatgcccatgatctcagtctatccaacaactctatgaggttggtatcattattttcatttaaaagatgaagaaactacatcttgatctctgagctcccaggaatctttgcactccatttggggaccctcagaggaaacgttgctaggaacttttggaacatttgttttatgcggcaaactagcatcaaagaaaaaagaatctcagtggctgcttgagaaaggattacaatctaattagggagacaaaaccaaaatactgagacaacagcaggcattttaaagtaagttatttagtacagacagtaagtgagtgtgaattcagagagctgggaacaagagagcggacaggggaggggagggctctcaagtttcctggtcaaatgtgaactgtgccttgaatgacagactgaatttaaaaaggagaggctcagattcaggcatgatggaagcgggaaaaggaaccacagatttcctgcagaaatggaagtgagagctctcagacggacagaatcagcaaatccctgggaactgtagaaaatcagaatgagtaaataatgtggtgacagattctacaggattttgaaggccagagagaggtacctgggtttcagaataacaatagtgatcatcataacacttagttgcaggattgctgaccacacacatttcacatatgctcgcccttaaccctccttgtccattctgtgatgtaggtatcatcctgttttacagatatgaaaattgaggcttagattatagcaatcaaaggttgatgggaaaattagaaatattctgcttacttagttcaacagtgcagagcttttgtgttgttacgttcttccttggatacatgtgcttgtcgttgagattttatagggtaatctatataccctataaacccatttaatataatcataggttctgcttgttctaatactgttacctataaacaattccccatggactcagatggaaagtgccatgaattaaagaccttacactacctggaccactctgatactgcccaccacaggcaatgggcagctatggcatggtttagagcataggataccataatgaaaaggatcagttctttcaacaaaggccggatgggaaagacaggaaggaggaaatcgtgtgaacccagaagtgtgatattcgatggagaggcaatcctgggatgaacacccagagcttgggtttgggatggctgaagaacttatgccaagaagagaaggcacacatgtagattgagaaggccatgaccagcactgcttaagtcttaccacttagtcatagttgagggacataagacttgaagtatggagatttaggctcaagtcctagtctcacggctactggcactatgtgaagaaggacggaaaaggcaagaattatatgctgattgagttatgcaatatattgtgtcttcccatcaatagcacttaagtatttctgtgtgccagcactttctaatttctcttctaatcgcttaacatatattaacttatttagtcttcagagaaaccctattagattgggggtattatcatcttctttgtatagctggggagactgaggcacagaaaaggttaagtaacacacctatggtcacacagctggtatgtagagaaactacactttgaacccatgcagtttggcccctgagtccatgctcttacttactgtcacattacctctcaggagaaaacaggataggtgttacgagcccagttttacagatgatgagactgtgggtccaagaccataagggatttgactaaagatcaaacaactaaacaaactgttacgctggcatttgaactaggtcttcctaattctgatccagacattctttctatcagatcacactgcctcctgttggtgtgaaagcattttacaaccataaacctcctcctgtttattaacacattattatgatagatataaggcttctctgattcagtaggaaaactaaggaggtagatcagccaagctcgtggttggtagtaataaagggcttgccttctagacggtgactccctccaggagagccaccaaccagttcctaacctctgtttcttgcagttcctacagagcctggcatggggcagagggtggctctctacaaatgtttgttaaacacaacttgttccagatagaagcatgtgaggctctccactaccaccagtggcatagcaggcacacccatgcattagcgacttgccctctgccaactcctgggatggtgatatgatgatggttctttgtaagcttgtcacttgtccctcttccaaagtgagtttacccagaggagcattctgaggttgaatttgtcccataccaccccttcacctacacattgacactccccgctgtataccatggggtcagagaccttgcactacaaaggccccttgccaagcgtggtattgcttgcagcctgtctgaggctttcactactttcccccagactctcagcccctggcctcctggctcatggccactcccagtgcccttagctttagcttcctgacccccctataactggcacccaggaccacttcaccagcttccttctcagaacaattgacttttgcccctggggtacttatacctcttttgttcaaggtcacaccccagctcaacacccaggatccaccctgccagcctgtgtgagagccatccccactagactttgaaagggactggacagtgtgttcagccaccttctcaagggcctgtccctggcagctttactggtcccacctgttcctagcctaggagctgccaatccaacaagatgaggctattctgggaagaagcaggaagacctcttcaccctaattgagtctttcttaacaaagaagtcaacagaacttttttttttaagtgttttaaatactgcacaggatgctacagcagttaagagcatggcctctggaatcagaaggatatgagttaaaaatccagttctgccacttgctagccatgtcatcctagggaaattacttaacctttctcaacctcggtttctcatttgtaaaatggagctaaaaaaggcccacattactaggtaatcatgagaattctgtgaaatgatatatgtgagcatatgtcacagcatgtgacaagcagtagatgctcaataaatgatagttattatcagcattatattaaatattattaaagtatcttttaagactttctggagacatttcattcagacagttatttattcaacaaacatttatcgagagcctgcatttctccagatccatgctgagtgcaaatatgggatgtataattatgtttataaaaaagagcggtgcatgttaatcacttactataggccagacactgttctaggcattttaggaacattctttcatttaatattgataagggccttgcaagttggcagaaattataattgtcattttagagatgaaaaaactgaggttcagagaggttatccccaaaaagacatgacctgtgattgagtgtggcatgcatcacccttaaataaaccaaaatattttaagttcaagtccccactattgagagatcgacaatttactcccatgtagtagaatgcctttatataactttcttgttaaagtcaaggtcagagcaaagtggtgtgatttcctcctcattggtaaaaatctctgtaagaggtgagtgttctcgtgcctttgttagcatgccagcaatgagcctggggtctctcctctgattactggggatttcatcatcattcaggataccttctctcattatgtgggactgaaaatagagatagaaaaggcaacaggtaaggggctcatagtgaactcacccaatgcatgctttgcaagttattttgttttttaagcaagtcccagtcatgatcttgctttcggattcatgccttatgcctgtagccattgaaagccaagtatgtcagggggaaaaaaaggtccttcagttagctgaggttttattctgtttctactttggtggtttgaaactaattacagactcggttgtgcctacatgtgcaaaatgaaatgagaggttgagccaattactttaataatgaagagaggaaaatccacttttctttccattatctaaagatttcaggcatatgtgagttttatatatgtatatattaaattatgtgaaaaattggcctcaagccttcatttcactttgcctgtctagaaacagactcaaattttgtttcggaaaggagatgacatgccttaggcatcttccaggagactagagggtcttgttgtaacaattgcagctaagattgattttcttattgttatgatgaatacttgtgcctgcctgggggagggaggtatattatgaaggatgacttttaaaaaaaggctggaatacctagaataaactttaggaggaagtttccactcatattatttattcattcatttatttagttcttttcaggacctgcaaagccctcctggcctggtgctcactccctttctaatttcatctccttctgccacttgcccaaactgccccagcaggtctggcttcgttgctctctttccattcactgagcacacttccaactcagggctttcaagcttacagttccctccgtgtggaatcatctttccgttgattttttcattgttcactccctcattcccttggatctctgctcaaatgtcattttatcagagagatgccattcctagtcaccctatacaaactgcctgctccacgcctaccattctctgtcccccttgccctacttgatgtttttttctccctagtacttaccaccatctgtgtgatatatgtgcatgaacttatgtgttattttgataaacatgaccatatattttattttaataaactttatttttagaagagttttatatttacagaaaaattgtgaagatgatacagagagtttttcttttctttcctttgtttttttttttttttttttgagacggagtcttgctctgttgcctaggctggattgcagtggcacagtcttggctcactgcagcctccacctcctaggttcaagcaattctcctgcctccgcctcccaagcaactgggagtacaggcgtgcaccaccacacccggctaattttgtatttttcgtagagacagggtttcaccatgttggtcaggctggtctcgaactcctgacctcaagtgatccacctgccttggcttcccaaagtgctgggattacaggcataagccaccacacccagcagatacagagagtttttctaaaccacatacttagttacctttattattaacatcttacattagtatggtgcgttcgttacaattaatgaaccagtattgatacattattattattttattttatttgttcaccagtttggaatgcaatgtatttttaaacagagtgaaagacacctgacaggtaactgaacaagttagcattagctgggcccaagattaaccaacttgtatcaacattcacagacttctgcagattccctgaggacagcaatatccaatagtgtttacttgttttgtgagcacagtaatagaagcaaagcgagacctttgttaattaaagcacatattttatgcagatttccttagattttacctaacatcccttttctattctagcatcccttccaggacaccacgttacatttagtcatcatgtctccttaagcttttctggcttttgatgaccttgacatttttgaggagtactggtcagatactttgtagtatgtccttcagttgagatttgtctaatttttttttttttcatgattggagttttggtcttttgggagaaaacagaagactgacaaagtaccattctcatcatatcatatcaaggatacttactatcagtgtaacttatcgctattgatgttggccttggtcacctaaggtagtgtttgtcaggcttctccactataaaattactctttctccttcctttttacactgtactctttggaaagaagtcactaaacacatctcaaacttaaggagtgagtgagaagtaagttacgatctacctcctcgtgggaggaatatctacataaatttggaattatgctgtttgggagatttgtctcttctcatttatttattcactcattcatctgataactcatacatatttatatttttggttataatccagtactactttgttttgttactcagttgttccagttgtagccattggcaactcctcagttggctcctatgaccctttgacataatcccgtaattgtgtgtcttgtgaggttttaaaaaattattatattcttactttctggcactacaaggcactttaggctaattgtgcatatttcctgctccagttctggaatcagccatttctccaaagagtctgattcttttttttgttttgttttgttttgtctgtgtgacggagtcttgctctcacccaggctagagtgcagtggcacgatcttggctcactgcaagctccacctcccaggttcatgccattctcctgcctcagcctcccgagtagctgggactacaggcacccgccaccatgcccggctaatttttttgtatttttagtagagacggggtttcaccatgttagccaggatggtctcaatctcctgacctcgtgatccacccacctcggcctcccaaagtgctgggattacagacatgagccactgtgcctggccagagtctgcttcttgttactggagactggtggttagacaccaagatttgggcactaagtgtgctcattgctcttgggctattgtcaatgcttcttggccctcccagctgaaagagcaaggaaatgtgtatgtaccctaacccatgtatatacccatatctataaatatttctgtatgtaatcatctttttgatattaagctaaacatgaattcacactggtttcctactgtaatctattgccacatggatcattctaactcgctctccttgcttatatttaaattccccctcaaataatgagaaatctggctcccaccatctgccatccatttacttaattattcaatttcagtatacatgtatagaaataccagaattgttaactcataccattgcagaatacaactttattaactggaagacagtacttatatacagttttcttggcattttcttgtttttttttgggggggggtggttgggggtttttttatctttagtttttcagactctactaatttctgaagttacttaggtcagcaccttaatcacccaccacacagagtgagatcgttttatacactagtaacacagttacattgtttttgacatactacattccatcatgggatcccccacctcctgaatttttaaaatttacgtacattaaggtttactttttgtactctaacattcagtggttttgataaatgcataatgtcatgcatattcaattacaatatcatatagaatagtttcagcaccctaaaagttaaaaatcccatctgggcatggtagttcacacctgtaatcccagcactttgggaggcctaggcaggcagatcacatgaggtcaggagttcaagaccagcctggccagcatggcaaaaccccgtctctactagaaatgcaaaaattagccaggcatggtggcaggggcctgtaatcccagctactcaggaagctgaggcaggagaatcgcttgaacttgggtggtggagtttgcagtgagccaagattgtgccactgaactccagcctggacaacagagcaagactccgtctcaattaaaaaattaaagttaaaaatcccccgtgttggccaggcatggtggctcatgcctgtaatcccagcactttgggaggccgaggcaggcagatcacgaggtcaggagatcaagaccatcctggctaacacagtgtaaccttgtctactaaaaatacaaaaaaaaaaaaaattagccaggcatggtggcaggtgcctgtagtcccagctactcaggaggctgaggcaggagaatggcgtgaacatgggaggtggagcttgccatgagcagagattgcactgctgcactccagcctgggcaacagagcgagactccatctcaaaaaaaaaaaaaaattcccctgtgttttacctctttaactttccctccttttttcccaactccttgacgatcactgatctttttattgcctctatagttctaccttttctaaaatgtcacataattggaatcttgctccacatacttttttagcatttggcattgttcgtttttttattttagctattctaataggtttatagatgaatgtcactgctgttttaatatgcaatttttaatggcaaatgatgttgagtgtctttatatatattatgtgccatctatatatcttctttggtgaatcacatgttcatatattttgcttactttttcactacattgcttgtttacttattgttgaattttaagagttctttgtatattcagatacaagtttctttatcagatatgtgttttcttctagtttgtggcttgtctttccattctgttaaaaatgtctgttgcagagcagttttagaattttagtgatccagcttatcaatttttttcatggattatgcttttggttttgtatctaaacttatcacctaacccaaggtcacctaaattttttcctgttatcttctagatgttttatagttttgtgttttacaattacatatgtgatccactttgagttaatttttgcagaatgtctaatgtcactgtctaaattcattgttttgcatgtggacatacaatatttcaaacatgacttgttgaaaatattacactatatcctttgaattacctttactcctttgtcaaaggagttggaaaaggaataaatcagttgactctatttgtgtctatttctggattctctccttggttccattgatctatttgtcttttctttccccaaccttacactgtcttaattattgtagctttacagtaagtcatgaagttgggtagtgtcagttcactgactttgttctttttctttagtattatgttgactaatgtagatcttttgcctttccatataaattttagaatcattttatggatacttaaaaatagttcgctgaaaattcaatttatttatttcatcagagttttgtaattttccacatatagattctgtgtacttttgttagatttatacctaagtgtttttgtgggggttttttttgttttttgttttttgttttttttgcagcatgctattttaagtgttatttcttaatcaaattccattttttcctcaatggtaattgctagaaagaaattgactcttgaatattaaccctgtatcctatacccttacttgtttgcttattagttccaggatttggtggtgttctcattgggtgggttggttgatttgttcattctttgtgattttccacatagacattcatgtcatctgagaataaagacagttttctttctttctttccagtatgtatgccttctcatttctttgtctttttgcactagctaagacttccagtacagtcttgaataggagtggtgagaaaggacattcttgctttgttcctgatcttagtgggaaagcatccagttttccatcaagtatgataatagctgtagagtttttttgtacatgttctttatcgaggtgaggaaaatcccctatattcatagtttgctgtgaatttttaatttttaatcacaataaaaaatgattgttagatttttttgaaatatttctccttcatttatcaacatgattatataattgtttttatttaatctgttgatgtaatggattacattgactgatttttgaatgttgaaccaaccttgtacacctggagtaaatcgtatttggttgtggtatataattccttttacacgttgttggattgatttgctaatattatattaagaatattttgcatctatattcatgagagagagtggattttggctttctttttttaatgtctttgtctggttttggtaatagggtaatgctgacctcatagaatgagccagtaagtttttcttctgcttattttcctggaggacatggtaaagaactggtataatttcttccttaaatgtttgctaaaattcactagtaaaaaccatttgggcctggcactttggtttttggaaggtaattaattattgattcagtttcattagtggatacagctctattcagatgatttatttcttgtgtaaattttgatagtttttgtctttcaaagaagtagtccatttcatctaaattatttttagttgccaatgttagtaatttgtaacttctctctttttatcttgattaccctggctaaaggtttgtcagttttattgctctttctaaagaaccagctttggtttcattgatttttctctattgctttcctgtgtttaaattcattgatttatgctctaatttttattatttcttctgcttttttaaaattttaatttcaacttttattttagatacaaagagtacatgtataggtttgttacataggtatattgtgtgatgctaaggtttgggtacagatcctttctcccaggtagtgagcatagtacacaataggtagtttttcaacccatgtctcccctccctcctgtccccctctagacatcccagtgtctcttgttcccatgtttatgtccatgtctgctcagtgtttagttcccactgacaagtgagaatatgtggtatttggttttctgttcctacattaatttgcataggataatggcctccagctacctccacgttgttgaaaaggacgtgatttttttcttttttatggctgcatagtaatctgtgatgtacatgttccacattttctttatccagtccaccattgatgaacacctaggttgattatatgtcttcactattatgaatagcatggcaatgaacatgcgagtgcatgtgtctttttggtgaaatgatttcttttcctttggatgtatacccagtaatgggattgttacattgaatggtagctctgttttaagttctttgaaaatattcacagttaaaatgaattacctaggaatatactaaccaaggaggtgaaagatctctacaagaactataaaacactgctgaaagaaattggagatgatacaaataaatgccaaaacatttcatgctcatggatcagagcaatcaatattgttaaaatggccatacttcccatacagattcaatgctattcctatcaaactaccaaaatgatttttcacagaattagaaaagcctattctaaagttcatatggagccagaaaagagcctgaatagccaaagcagttctaagcaaaaagaacaaggccagaggtatcacaatacctgtcttctgctttctttagatttaaattactatttttcccctccttgtctccaatgtctcttttgcctgaaattaatgtaactactacaactttattttgattagtgttagcattgtgtagctttctgcatccctttacttataacctgtctaagttaaaagtgggtttctttgtaggccttattcttttaatcatctctggcaatttctttcttttaatcagtgtatttagacaattcacatttaaagtgattattgatatagttgggttattatctaccatgtttgtaactattttatatttgtaacatttattctttgtttacctttttttcctcttggcctttcactggtattcatcaggcattttatgtgatttcattttctctcctctcttagcatatcaattatacttctttttttaaaaggtagtaatgtccctaatgtttgtagtatacatgtttaatctaagtctggcttcagataacgctataccacttacatgtagtgcaggtaccttataaggaagtactttcaattcctccttcctatccattataacattgctgtaatttatttcatttatccatttgctataattactcaatatattgttactattgttactttaaacatataattatagatcaattaagagtaaaaagatgaaatattatcatttaccttcatttatttcttctctgatgcttttcttttatgtaggtccaagtttttgacctatatcattttccttctctctgaataactttttttcaacattttttataatgtagatctcctttcaataaatttttatttgagaatatctttctttctctttcatgtttgaaggatagtttcattgggcatagaattctaggttagtgaggtttttcttttaatactttaaatattttactccattctagttttatttacacggttttctgagaagtccattgtaattcctatgtttgtttctctatagattaggtggatttcttgccccctttggcttctttcaaaattccctctttgtctttggttttaattttgattatgatttgctcagctttcgatattttcatatttattctactttgtgttctctgaacttctggatctattgtttggtgtttcttctttattttgggaaattcttagccattattacttcagatatttcttctgctccattctcactttgttatcttcatattctaaccatgcatatgttatacgttttgaaatttttcttgggtgtcctgggtgtttccctccattcttttttctttttgcatatcagtttgggaagtttttaactgatgtatcttcaaattcactgattctttccttgtccttgttaaggccatcaaaggccttctttgtttctgttggtctttttattattattatcattattattattattaggatttcttttagatacttttttagcattttcgtctctcgttacattgtccgtttgtgcatagtgtttactttttctattagaacacttattaatcatagttgcattaaattatctgataattctaacatttgtgttatatctgagttgggttctgattcttgctttctctctttggactgtgtttttcttgccttttagcatgccttttaatattttgttgaaacatggatatgatgtatctggtaataggaactgagacaaataggtctatatgtgacattttgtgttagaaattgaactgtgtttaatgtttgttatagttgtacatgccagaggcctcacattcttctattgtccttattttttcatccccactattgtctttggcgtccctaagatctcctccttagatagagtctatgtcttgctgctctttgagctgtaattcactaatattatactggggtcatgtcgatgtggttttaaggtatggggaaggaaaagcattctataatcttttgattatatctgtcttttagtgggactatgtccctgagctatgaccttcatagatgttcttaggcccctactcctttaggtgagacagaaggcttgcaggcactagagttgaagagatgtccttcccctgtgtgcaataggcttttgtaaagtctcttcctcttaaaaggtctttattatggagaactctgtgttatggaaaaacactgtaaaaaatattttacagtgtttacgctttccctccccctgccagagccaagaggggatcattcttgactctttggattcctggaggtaaaaccgatgaaagtgtgggcccccttccactaagactgttaccctcaggagttgctcgctttcctattagtccacactcagcccccaacacttcaaattaccactgaagtgtccctaccagtttatgactccagcagctgctcctccaagtaagatctcagctgtgactgtctgggttgtcctttctcttcagatttcagggtgatagtttgtcctgtaacctcagttctcttatggatccaacaaaaatcactgatttgcagtttcttagcttttttttttttttttggagtaaggatgggataaatgacttagacagtttttacatgttggagctataaccacaagtctctacatgtctttaatgtacttgctgactttccctactggaatgtaagcttatgaaagcaggggccatgtctgttttattcatagctacagcttcagtagccagaatagcacctgactcaaagtaagcgggccaataaatagttgctaatagactaattaatctcttggcagtcattgagcatattgttataccaggcactgtgcttagtgtggaaagacatcaggtgcctacattattacagtggtgtgggggcagggcatggtggacatacaactaaaataacaataaaccacagatcagagaatagggaagttttaaagcactgaggacacatacctcatctagcccaagcaagagggaggtagaggtaaagcattgccagagaagaaaaccatcacctgagttgagttgtaaacaatgagtagctgttagcctgtatagtggagagggacccagccaaggagacagcacagacctgtcaaagtccatgtcggacaacatgcaaagtgatttacttaacccacctcatgaacgtttagtagcccacgcaaggcaggcccctgttaactcacaggtcaggaaactgagcctcagacagtttaagtgactcgacaaaatgtcaccaatgctgagtgatggagcaagtcggcttgaggccaaggtccattttctccctgctacaaagatgactaagcacgactcagagtctggtggaggagcagaacacataaacagtctttgatgatacccatgctcttttgaatttgctctattgttgttcattttctttaagatttcagccctagaagtagcaagctgaaaatcagggctgctttgcaaatgcccacaaaccactgaggggagttttgtcaaagaaggcgggaaagaaaaataaatgtgggcttctgctctttaaacctcagcccagtgaggcagactttcccggaatacttcaggcctcttcaaaggcctattgtggaaagtgtccagatgtgcgtggaaaacctcactgggaagcttcccggtgaagaggccttttaagcatgaaccgagatgaaggaagctgacgccatgagtcctatcaggtggccttttttctgaaggagcccagattttcccctaaccttaagaaggttgtagggggttgggtgattagccagttcgtattcctttgattacaggaagcagtggggttagttgttttttgttgttgtctttcctttttttgctgaagtgagaagaggagatgggggtggggggcattctccatatgatttatctacctgtaagttgttagtgacagtctggtcattcctccagcataccttgtgagggccaggagggatttctggattggataaagttgaggcactgagtaagtcctgctagtttctatgatgatgcctctgagtgttctaagagtcagaatcccctggaatctggctctgatcccctgctccgaatccctgtttaagctctcttcccaatgccctgtttatcctaggtttgaggccccatcttcctcttgctagatacagttaagccagagagacccagatttaaatcctgctctctcattagctgtgtcatcttgcacagagtagcatcagcctcaccgagcctcagtttcctcatctgtaaaatggaggtaataccagtcccgtcatcatccagttgctgtgaggattaaatgaattgctgagttgccgcacacaaagcatctggtccagttcctggcacagagtgagggttcagtttattttcattccttttctctttaatccagttgtacaaagaggcagagctgtcccatttgaccagagaattttacttctgtagctctttaaattctctccccgccatgtacatatgggcttagctaagtattttgagatcacagtgtatttaggggaaagtccttttggctacagctaaaattaggcctctcttgtgctcctctgtttaccaccccccttcctattttaactaattagaggcattgacactaagaaacacttaagaaaagttggaagaacagctgggagttgttctagatacaagcagctgctccctgtcagcatgcaggcacagaaaaggatgatcctgaatggggaagtgcagggagggcacctcagagatgaagatgaggaatggcaaagtctgtctatgttgtggcaaactgagcagggtggagttcttatcactctgtcctctaccttctgctgagagaaaaggggggtcagagataccaaagcagatagaggaaaggggggcaagaaaggggaagggaaggaaggtattcaggagcttagctagttggttagttgattactttatgcagaccactgtcgcccccacctagaccactgcggtatctcctaactggtctcatgctgccggctgctttcctgctggaaccagagacgtcacaggaacatgcaattcttgcaccctgaaatccccgcgacgagcttccaccatggaatttagacagaattccaaaacccatcacatggcccccgagtacctggatgcaccttccccctgttccccgtaattgttactgctcagtcctgctggcttctgttcattcgctctgcttcaaaggactttctctcctggagccagattgcctgagtttaatccaggtttccctactcgctactactacttacaggcctctccatctcccttccagccttaaacacctactgagctcccctggaattccctgtccacgtcctacacactctcctcatggagtccccgggcctgtgcacccccaaataaaagtttctgtgtttccagatggccatggtgactgtgcataaagcctagcaaatgtgcatcaagccagaagacacgagacctttccaaagggctcatgtcttctggcctgatgcacatttttgtgtcccctgccccatctcctcctcactaccctcgggaaactgggtgatgtctctgtgggaagggctgagcctcaggctctgtattgattgtccagtgctgcatttaaacttcctgactggatattcagaacttatgctgttgttttgttttgttttgttttgtttttttgttttgttttgttttttaaagcaagcaccttcacatctcaggtgtaaatgccagatcttctaacacttacaaggacaaattcatttcttactaaatagtcaagcttaaaacccacatgactggctgatgtaagctttggccttgtctgtgaggaatttttgcaacattatttctcttgatttctttctttgttgctgctgttctcagaacaaggcaaggctgaggttctccttctcagttactccatgtccctgaattaagccctgtgagatctaaaaacaggagctctgtgcacacagccgtaaggacaaaccctcactctgcatccccctaagtgggccacatgcctaagcccagaaatctaagagttacttctaacaactttctctccctaacaccctcatctggtctgtcactgaagcatgttttctgcctcctgagcatctctcatatctgggtgataagagagccaccttgatgtcccctggcccttgctgacctcagcagagcctttgggtgacagtagctctggcttcccagggcccttggaaaggagactgtggggtccgcgtggtatggccctgcctgcctcttggttctgtttcacccacacttcccttcactcttatctgctccaacaacacagcctttctcattcctcaagtatcagttttcttttctttttctttttatttatttcagtagggttttggggaacaggtgttgtatggttacatgaataagttcttttctgagacagggtcttgctctggtgaccagactggagtgcagtggtaccataacagctcactgcagccttgacctcctgggctcacgtgatcctcccatctcacctcccaggtagctgggaccgcaggcgtgcaccgccacacccagctaattttttgtgtttttttgtagagacggggttttgccacattggccagactgatctagaactcctggctcaagcaatccacccaccttggcctcccagagttctgggattacaggcgtgagtcaagtgtcatttttcgtccttccgtatggccctctcctctgctagacacatgcttccccctccttcagccattaatacctgtgcatcccttgaatctcagctaagctatgacatacatgaagcatacatgcatatagacacagacatacataccattcaacctaacatgaggtgattgaggaatgccgagaccctcctctcccctctcagtgccctgaagcagcccctgggggaggggatggccctggtccctctgactctgacagggactgccctcccacagagagaggaaggcctcgggagctggttgtgggctcacctctgtggtactgctcttcctcctgcttctgagcagagaaggcctgggggccaaggtgcccaggggctgtggacaagatccttttatgctctgtccttgcctctaatgtgacagattattttgtaattacctggcagagataagtttggtttctgcaaataaactagcaaagattccaaggttattaaacacaaccttgcctcatctatctggtcatatccaaaaaccttaaaagaatttttgttcttctgaatttcactctccaaggcacaaagaccaggtgatggtggggcaggggtagagagagggatgggaagacttctcacagtgattcgagaacgttcacacacacatacgcacacaaaaaccttcactctccccctctccaaccccaccccactgactgcacacatgtcttggcccccttgagaatcccttttccatagacaagccctctgaggtaagaggtttaggcctccttcctgctttagttaacatcttgtctccacagaaccacatccaaccttccatttttctccaacctctttagctcatgaggaagatttacagcctgggagtcaggaggcccaagttctagtccttgctttgacaccaggtgatattgtggtcttctctgagtattgttggttcactcttatgagagcattctcagacctgtggcattttcaccattgaatccactgtgcacagaggtaaccaacatttgtgacacctgctgtttgcaaaacactgagctaagaattagtgattacttctcaacccaccatctctacaaggcagctatgactcctgttttatctatttatgaaggaagacagagcttagcaaaattaagaatgctgctcagacccacaaacaggtaagattagaggcaggtttcaaaacgaggtctctgtctccagagtttctgccatcacagtaagctgagtctcaactgtactatagaaaaataaatcaaaatgacattttaagtatcatctcttttatttatgcattatgcaggagatggaactcctttcttagatttttttcccccaaatatgctgtgctcaggagctgggaaaagggaaaacacacaccctgggaccttacaccctgatatggtttggctgtgtccccacccaaatctcattttgaattcccccatgttgtgggagagacccagtgggaggtaactgaatcatgggggcaggtctttcccatgctgttctcatgatagctgataactctcacaagatctgacagtattataagggggaatttccctgcacaagctctctctcttttttttgcctgctgccatccatgtaaggtgtgacttgctcctccttgccttctgccatgattgtgaggcctcccagccatatggaactgtgagtccaattaaacctctttcttttgtaaaatgcccagtttgggatatgtctttatcagcagcgtgaaaatagactaatatagtaaattggcaccgggagtggggcactgctgaaacgatacccaaaaatgtggaattgactttggaacttggtaacaggcagaggttggaacagtttggagggctcagaagataggaaaatgtgggaaaatttggaactccctagagacttgttgaatggctttgcccaaaatcctgatagtgatatgaacaataaagtccaagctgaagtggtctcagatagaaatgaggaacttgttgggaactggagcaaaggtgactcttgttacgtttcagcaaagagactagcggcattttgcccaagccctagatatttatggaactttgaacttgagagagatgatttagggtatctggcggaagaaatttctaagcagcaaagcattgaggaggtgacttgggtgctgttgacggcattcagtttcaaaaggaaaacggagcatgaaagtttgcaaaatttgcagcctgacaatgcaatagaaaagaaaacctcgttttctgaggaggaagtcaagccagctgcagaaatgtgtataagtaacaaggagccgaacgttaatccccaagacaatggggaaaatgtctccaggccatgtcagaggtcttcatggcagctcctcccatcacaggcctggaggcttaggaggaaaaagtggttttgtaggcagggcccagggtacccctgctgtgtgcagcctcaagacttggtgccctgaatcccagctgctccagccatggctgaaaggggccaacatagagctcaggccatggcttctaaaggcgcaagcctcaagccttggcagcttccacatgatgttgagctggcaagtgcacagaagtcaagaactggggtttaagaacctctacctagatttcagaggatgtatggaaatgcctggatgtccaggcagaagtttgctgcagggacagggtcctcttggagaacctctgctagggcagtgtggaagggaaatgtggggttggagtcccagcccagagtccctactggggcaccgtctagtggagctgtgagaagagggcactgacctccagaccccagaatggtagatccactgacagcttacaccatgtgcctgaaaaagctgtaaacactcaacaccagcccatgaaagcatctgggagggaggttgtaccctgcagatccaaagcggcagagctgcccaagaccatgggagcccacctcttgtatcagtgtgacctggatgtgagacatggagtcaaaggagatcattttgtagttttaagatttgactgcctcactggattttggactagcatggggcctgtagcccctttgttttggccaatttctcccatttggaatggctgtatttacccaatgcctgtacccccattgtatctgggaagtaactaacttgctttcgattttgcaggctcataggcagaagggacttacctttgtctcagaggtgacgctggactgtggacttttgagttaatgccaaaacgagttaagactttgagggacttttgggaaggcatgattagttttgaaatgtgaggacatgtgatttgggaggggccaggggcagaatgatatggtttgactgtgttcccacccacatctcaccttgaattcctccatgtcgtgggagggacccagtgggaagtaattgaatcatgggggcgagagcaaactgaggaccagagtggttataaaacttgtctgaattcataccatttacaaagtaaaagaagagtctagagcccaggtctcctgagtcctcagaatcaaccaagtcaaataagctcccctattcaaaaagaagaaccttcaagaatattaattttgtgcccatctaaaagcctcactgagctgtgctaaaggtaataggcattgaagaaaacgttctcacagaaactcccagctgcaaacacaaagaagcagctctccagggaacagggtaaggattgtctgaagagatctatgctggtgagattacaaaaatcataatatatgaataaatgaacatatggaaggaatcagcaaagccctctcattcttcccgtatgtaaactcggcctttgcctaaagtcattaagtaaacacagatgcagccaaaccaggcaccagatggcaaacaagaattggaataaaaggtaaagaaagcttttggtgtttactcaaagatggggaaaaaaaccatgatccaaaatgctgtggtttccccagaatggccacctggagtcaccagggcccaaaagtgaccaaataaaacaaaacaaaactagaataatcatgattgggaagttgtaggaaaaccgctgctatcttctgtgaatggaatcccatgtcagaagaaactggttattctgggaaatgaaataaatggttaaatcaaagtactaggaccagagagcaacaggaatgtggcaagaatccacttttgctgggcactcacatctgtccagagctttgtattcttggccttatataatcctcacaattacccattaggtattggccaaattttataaatgaggaaattccataaatgggttgagagagattaggccccaaggtcacaccacaggaatgccatcctagctgtggccagtgcttctttgtccattcccagcttcgtagctctgatttcagtaccagatacaggggaatccaggcacattctctctgcctttcctgcccaaaccactggacctaagtaagaaggtcacctggtcaggtactgccttgaagggagaccagaacagacatggagtggggaacagagcattcctgaaaacttaacttcacctttatttcacaaaagacacccttgcacatgcctcatccacctcttagcttgtacatttgccatgagcaccagtaatgaaggcagtccttgtgaatatttgcttttcagtatgcatgagtttatatattgggggtagaaaattccaataatgtttcagcttcaactaaaagctgtatcttgttctgtccttgcctctaacctgacagattattttttaattgcttggtagagataagtttggcttctgcaaataaactagcaaacatttcctgcccaggctaccaaacacagcctcacctcacctatctggccatatgtaaaaacgttcattcaaataagttttgttcttttgagttttactctcccaagcgcagaaactgggtagtgaggggtgcaggggtatggggagaatggtttcaaccaaaccattcattgcttgcaggtgggaaggtaaggtggaaaatgctttccagctaaacagacctgtctgataaccctaccactaactaaacttgctctcttgggcaggccacattatgctttgagttttagtttctttctctctaaaatgtacgtggaagggctgttttcagaatttttttttcactttcctcttacccatcttctctttttctacatggtcaatctccacgtggctgttttattttttccccattgttctttagcaaagcttaatccaggatgaattcagctttgtggacactataaatcaaagccatacaaccataaggcaggcttctaccactctatactaattgttaccagtctcttagccctggtttctggttgggtttggccaatgggcagccccagcaggaacctggagaataatgaagttgtttattcccccagcgctctccttgctgggttgacgcaggttagctacatccatctaccatccttctacaatggaccacagttcctgtgtgtggccctttccctacaattttgtgcatgatgggaacctctcctccctccctgtcctccttcaggctaagaggttgtaatggctccttactgttggtaatcattaggtacttgtttctttacctaaacctttttaaacaactcttcttgaagcttacttcagttacccaatgtgagtgtcaatctctttcctaataggaacctgaataaatatatcacttcagctcaatttcccattttctacaatgactattatcaaactttgccaatttccatccctgtctttcctctcatgttcagagagatgacctcctgtttattcttagccaccaactacctctaagagaaaagccattagaaagacaactgccattaaatctcccagctttcttagatccggtagtgagctggggctagctcagccctgctcgcaagagcatattgtgcacatctcttcccagcttcacatccattccatcacattcagagcttgaaactggccaagatggaagtatttacaacacagaaattggcaattgataaaattagggctttctattgattatttatcagtattatttatcaacacaccactgcttatatccagatacagtctttttctccttcacatttgttacgatgaaagagatggcccacttattatcagagactctttcatctcctactgcctctaacagcccacttaattcattatccattcactctatgtttagcttcttcaatactatctccttctcatcaacatttaaacatgctctagacctgtgctatccaacagtagccattagttaaacgtatttattgaacccgcgagatgtggctagtccaaattgcaatatgtaagatacacaccagatttcaaacattttgcatgaataaaagaatgtaaaatatctcataaataatttttgtattgattacttgaaatgatatttggggtataataggttaaataaaaacatattaaaattaaattcaccagttcacttacacttttttaagtgggtactagaaaatttaaaattacttgtgtaaatcatattatttctgttggacagtgctgctgtaaacctttcatcttaaaaataaaatccctggctgggcacagtggctcacacctgtaatcccagcactttgggaggtttggatctgtgtccctggctaaatctcatgttgaattgtaatccccagtgaggagggccctggtgggaggtgattggattttgggggtggagctcatgaatggtttagcaccatccccccattggtaccacatagtgagttctcaggagatctggttgtttaaaggtgtgtagtacctccctccacttcctcccgctccagccatgtaagacgtgcttgccttctgtcatgattgtaagtttcctgaggtcttctcagaagcagaggccactatgcttcctgtatagcctgcagaaccatgggccaattaaacctcttttcttcataaattacccagtctcaggtatttctttatagcagtgcgagaacaagctaaagcaggaagattgcttgaggccagaaattcaagaccaacctgggtaacatagtgagacactttctctaataataattttttaaaaattgccaggcgggcgaggcgcggtggctgacacactttgggaggccgaggcaggtggatcacaaggtcaggagatcaagaccgtcctggctaacatggtgaaaccccatctctactaaaaaaatacaaaaaaattagccaggcatcatggcaggcacctgtagtcccagctacttgggaggctgaggcaggagaatggcttgaacccggaaggcagagcttgcagtgagccaagatcgtagcactgcactccagcctgggtgacagagtgagactccatctcaaaaaaaaaaaaaaaaaaagccagtcaccgtggtgcatacatgtagtcccagctgctcaggaggctgaggccagagaatcagtttaacccagaagttcgagctgcagtgagctatgatcatgccactgcactccagcctcggtgacagagcaaaaccctgtctcaaaaagtaaagtaaaatcccttcttctgcctatcagctcccctagctgttgcctctcatggtcaaggatgctttaaaaggtatctatcctcactaccatgatttttctcaccaccacccctgcctccttaactaaggcagatcttccttccgctacagaaattccaccaaaatcatgctgcctcagtcattagtgctgacccaaggcattgctgagcccaaagggcttttcaacccctactcagctttagccttggcaacattttgcaaagtggagcactcccttcattgaaacacgcttccactgacaacatattttcttgatttccctcccgctgttctgaatgtttctgcacaaattccttttctagttttcctttctcctctccccaatattatatggtagtcttatacaggaatctgtccatctcatctacttctaaggattcatttactatttatatgccagcaggtttacacctatctatataacatcttcacttaaagggcttacagccatctcaatctaagcatattaaaatctgaacccaccatctccacctctgcctgaaaaattggcactgttcccatacgtggcactatcaataaatggcaccacgtgtccttactcactcctggcagaacctcaaggacattctgagcccactctgtctttctgctccacatcagtctctcatggtgtctttctaaattacatttcatgtctcttgaattcttccactttgctttaattctaccatcaccatccttttgtctcacctggactgctccaaagaacttttgaatggtttccttgcctccacttttaccattctttagtttattctctacaaaactaccagagtgatctttaacaaacatgaataagatcactcttgcttaaaactctccagtggcttctccttgactttggcataactcaaaaccttttaacatgatttacaggaccatccaaaatctgacccctgccttcatctatagcttcatctcctatatgctttcccttcattttatccagtcatcttggacttctttaggtcctttaaatgtatcatgttgtctttacttaaggccttcagatatgcatttccttcagtctggaaccttcctcatcaactttctttacccagccaactccttgtcaaccttcagctagttccataagtttccatagtagttttgtcttcctcttcctgtctcccatgatcaccgatgtttctccagcaggctttaaacttcatgaggtcagggatcagagctgtctggttgcctcctctatccatattgtgtagcacaatgccttgcacacaataagtactcaataagtatttggttgcacaataaaaatgacattatctggctcaaacttcccattttgagaaagaggaaactgggatccaaagaaaggaagcaacttattcaaaacaacagagcccaggctaagattaatacagggctggagcctcctaatttccagatcttttttttttttttccagcacatcatgtgcctatctataatatggtaaccagaaggaagcagactggattccctgtgtcttgtaaaagccggagcaagttcttatttgtaaacacagctgacatagttgttttctttgtttgttttaagtaaaaggactggaagtacaacccaaaaataaactttgtgtttccaaaccaagaagcttctacaacttttatcccctgcagcctcctttctgtccattgttcatcttccttcccttcattaaccacaggcatcagctgatattcaatgttgaatggtccctgcattctgtgttctttatcactcccctgcccaggcagcatgtcacatgcagcagcagattaggaagtgctgtctttaaatagtatcactcaagagaacattacaagatcctgtgtagcgctggggtggagattgatgtaataatttttagaataaaaataactcacatttttgaaactattagtttgtgactggcactaatttcagtggtttgtatgcattttcttttttaactttatgagtaattatttctattacttctattttacagatgagtaaactgagggacaaagaggttagttaaggcccaagccattctgttttgtttgagacagagtctccctctgtcatccaggctggagtgcagtggcacgatctcggctcactgcaacctccgccttctggattcaagcgattctcctgcctcagcctcccaagtagctgggattacaggcacctgccaccacacccagctaatttgtgtattttcagtagagacagggtttcaccatgttggccaggctggtctcgaacccctgaccttagatgatccacccgcctcagccttccaaagtgctgggattacaggcgtgagccactgcgcccggcccacccaagccattctgttagctagtgaaagagtcaaagttctaatctagccagtctagagcctgtgatcctaactgtctgacatcggacaatgaagaatgtgttgacctggcaggaaataccaaaaagtacaactgagggagatcctaaacttgctttatacagatatcctggatcctacccctgattcattcattaattcattaatccatttactcattcatttaattctttcaacatgtatttattacatttttgcattatttatatcaattttggggaatacagagaaagttaatggcttctaccctttgacatctcacagtccagtggggagacgtaagaaaacagacatttatcctactgtgtgctgaatgataagacagaggaaaatcagtgagctttgggaacatggaagagattataaacacataataaagagagtttaaaagggcactacagtgatttgctttggacctgcattccacacctgtcactctatctgtctgacctctgctctctctatgctcctggcttctagcccttctcttactttggtaccatccttagcctctcaactcctggcttcagattcgatgtctttgcttgtctttttcctctggaagttggtttggaatggattctggcttggctagagggtttctgtatcgtaaacagtctaaggccagctccaaagtctaggccagaatatctaggccccactaccaaaatggctctcgcttagaagaattggagatccaaaagcagggaacttgaaagagcatggagggatagatggatggatagattccttgcctcttagcttcgattattcacctgcctaaacccagagcagttggcctagtgactaaccaacatcccttgcagctcaatcattattcattatgttaatattatcacacattttgattctttgctgtcgatttggttgctgatctgctggccaaaggatcatcatgggaaggaattactattgaagcaggcagtgcaaatttcaaaagtgttcagaccctgcggcctttcatgatatttcactttcttgagttgcagtctcccattggcctgctccttccgaagcagattttgtcccttgtagccataagtgaagcatatcctggctaaatgtttctgtggactgaaggtagctattgaattgggcagttaagagaatattgcagattcttgtcggtaaatgacacaaaagatgatggactctaagctagctatggaagaaattagagccagacagggcacatgaattgaaagaaaatgaagtgatggagattctggaagttgctttaaagtggagaaggacatttgctaagaatgatagagtacatgagagaattggactgaagggcaatggaattcagaaagtggctgttggtatattgtaatattcataagtatagcagtctcaaggggggctgtgggagtattgaagtgaaatggagatgaaggtcccggaggtggaaacattttgaaaccgtctaacagtggaacattggatgggtcttatgagcagatgctgaagttgtccaggacaatgataaacctccaggtagatagggaggcttgtgatctaggagccttagcctcatttaacatagggacagaaacaagaggctgacagtgacagcagtgagatgcaggggagacatgtgtcattgtatctccatcattaggtggcataaacctcagaggaacaggcttttttgcctgcaactgcaggaatacttgtctggaaatgataatgaggaggcctgagaataatgactgttatcaccttccccaacccacctgaaacatacacacatggcaacacttacctttcaataaagtttctgggaaaataaagtttatttcagttgataggtacatagtaataataacaatatctgcacttttaagcatttagtccatccaataggcctataaaataggtattaaaacttccctttttttgagacagcatcttactgtgtcgcccaggctggagagcagtggcacaatcgaggttcacttcagcctcaacctcccagactcaagggatcctcctatctcagtcagccttctgagtagctgggcctacaaacacgtaccatcacacctggctaatttttattttatgtttttgttgagatagggtttccctatcttgcccaggctggtttcaaactcgtttcaagcgatcctcccacctcagcctcccaaagtgctgggattacaggtgtgaatcactgcatccagcctaaaatttccatttttaaaatgaggaaattgagactcaggatgttcatggcagaactagggtttggattatgatctaaatatcactgaagtctttgtttcacagcaaatgtttaaaagtataggttccaaagccatatgttttcttgtctttgaactgggaatacaaactaggtaacgtatttaataatatagtgctaggccatagtaagtactcaacaaatatcagttgccattataattattgttattgagttactattatttaattacagctcacggcagtactatataccttctcagcctcacatatcagcaagatcatatttttttccagtcaacaatagattattagatgagtgacagcttgcagttttggaacctatcatctgtctgatgcttttagcaagaagcttcctatttttactttgagaaatccataagaagtaagtcaaactcatgtagatgggatgaatacttgctccctattcatgtttggatccaactcttttgcagccaggccatatattaggaccccatctcagagtatcacaacagaggttgatggccttacctagtataaaaccactcccctgtgccgtatttgcccatgactgaatcggaatgaaactttcccttgctaggaaaacactgtgggtatattctctgtcggagtgtgctgagcaaaaccctaatagaatgtaccgtgaggaataaggagtaacttgtcaactgagagttaatcagaaaaccacatgtgcacaaaaccaacagattgcagagctggcaaagacttcagagataatttactccaaccccctcattctactgataaagaaagtgagtcccagggaggggaagggtcttgctcagggtcatacagctggcagtaattttgtttgtttcaataattaatatgaacagtcattctatacatcagtgaatccaccttcctgcctttgtaagcacaatataatgaccataattgaatttgtctttgacagtgaagaaagcaggcttttagggctttacagggccccaaagtcatcagaagaaaataaattgtcatgaactaaagctggagatctgcctgttgactgtgagcttcttaaggaatgggcctggtcttattcatgagctaaagcaagtttcaaatcctggcttagccctttactagcttaagcaagtacttaacctctctgagcctttatttcctcattgtaaatttaaataataagaccttcctcagagactgttagtgaggatcaagggaggcaagatctgtataccagtaccttgcgtaaaataggcattcaataaacttgcactttcaccttacatttaacaaatgtcctgctaaaagctagggatacttcaaagaaaggaaagccaacgactccactttcatggagcttagattcaggagggaggagagcagaggtgaggaccacagagaagcaggcagacaataaacaattaaaaatataatttcagatgatgatgtgctatcaagggttatgaggaaaagaaaatgagatgatgtcatagatgtttaggagagtgcactgcttctgctaagagtggccaagggcagtcttttcaatattatgtttgaagagaacctaaatcatatggaaaaagccagacagtcaaagatcctggagaagaccattcctgagagattcagaaaggccttaggcaggaggaaggttggcatgttcagccagcagcaagatggccagtgtgttcccagcatggccagcccagtaagcagggcatgagatgagactggagacatctgcataaactccatcctgaagttctagtccaccctatgacatttgagttttattcaaaaagcgatggaacactgttgcaaggacgtgttaaaaaataaatattggtctttgtccctagttcctggcacacagcttctaaaattcttggaatccctgctaaaagctagggatacttcaaagaaaggaaagccaaggacttcacttttatggagcttagattaagctccatgtgtatggtaatgagatgactgatggctgagaacccctccgtagcatcaggatgggggctggtcaccagaaagaccaaggcatgattagagggttgaactttcagcccctcccctgaccttccagaatgagaaaggggctagagattgagtcaatcaccgatggccaatgatttactcaattatacctaagtaatgaaaccttcataaaaacccctaaatgatggggtttagacagcttctggattggtgaacacagggaggtattgagaggatggcatgcctggaggaggcatggaagctcactgcaccactgcacctccctcccctcataccttgctctatgtatctcttccatttggctgttcctgaattttatcctttataataaactggtaatagtaagtcaaccgttgtcttgaactccataagccgattctagcaaattatcaagccttggggggtggagtttgtggaaacctccaatttgcggtcagttggtcagaaatacaggagacccaggacttgtgattggcatctgaagtgtgggcagtcttgctggactgagccctgaagctgtggggtctgacactaactaactggggtcagtgtcagaattgaatcaaatttaattataagtcatgcaattggtggcaggagagttggagaattggtgagtgtgaggaaaaaacccatacatttggtgtcaggagtgttgtaggtaaaaacagcccagagaggtaaaatcattcattgattcatttaacaaatccttatagattaactattctggccaggcacagttcttggtgtggtgcatgaatccaatacacacccctggccacatggagcttgcatgctaaagggataataaatatctaaagtttatgtagcatttactatatgctggcattgttgtgttttacctcaaataactcacgtgcttctcatagcagtcctatgaaaggcatatttttatccccattttctgatgaggcaacaggcatgaagaaattaagtaattattccgtgattatacagctagtaaatgtaaaaatccagtttcaaattctggcagtctgttatagtcagtctgtattttaatcactgccctttattttctctgcttctgaaaaatcacctagactggtcctgactgctataaggggaaccaaagtggaagtcaagagaccagttaggcagtagtggtcagagaatgggatactggaattttcaacaacactgagtagatattattattcccacttaataaatgggaaaactgagctttgattcacacatctgataagtagcagagcctggatccaaccccaagcccatttatctctaaaacccagtatctttctgctaatgcctccatttcctacagaattataaagcttccactcctcccctcctttatgaccaagagaccaatttgaggtatgttttagagtcaaaattagaggactgggcgtctaaaaatttttttttctcttggtaggcatttttataattgaaaataaaataaaatataaatatactgacatgcagttctgttttctcattttcttttgcaaactttaaattgagatatagtacacataaggtgaaatacaaagatattaatgtacagcttgatgaattttgatgaagtatacacccatatagtcaacactctaaagatatgtaaatgtgtgcacatagtgtacttaaaattataaatgaggtgccagttttcatatcatgagtaatgataaagacctctcccactctctttttctctcatcccttcctgcttctcaattgatatttttgtctccaattcatgggggttacacagaataccaggtgcaggtcaaaagatgactgtgtcaaaaggaaaagaaagcaaaataaataagagaacaactagccatttcttaatgcgtgttgaaggaaagtcacattgatatattttctgtttttctatggaggggtcacgtgcctcagcccacacattagcatgtgaacttgttgttccagtcaaatgagtcagagttcctcaggaaggcagattcctgtattttagagctatgtgtcagcatctgtaaaaaaaaaaaaggtacagtgtcctgtattgatgcatctcactgatacacacgtgctcgtctcactccaggtaatcacacctgctaataagcagcagaagtaggatttgaactccagcctagggcactcaagaatcaggctgttttcatgacagggagaatggtaccactgagtccgaatgtagggtttgcaatggcctggagtcagaagtgggcttgaattctggttttactacataatggctttatgaccttgggaaaattacttatattctctctattttcagttcctttattcacaaagtggtgatagatgatctgtgtcctaatgtccttttgagggttaaaaagatcatgtacttaaaataatcagcacagcacagagtacaaagcttaaaccagtaaaatggcaatggcagtggtagtcggcccctaagtcaacagacaccacagtgttttttaaccatatacccccatcagttaaaataaattttgagtatgcatcctcagtacatgaaaacctatttatgaaaaagcatgatgtgctatactgtgttcatagattatttactctataaaacaagtgaaatatagctgaaccaaagtatttccaatgtgtttacctgtcatgatggcttcatgctaatattagcaacatgtaaaagtacactatatgtctatggccaggtgtgtttttaataattttaaaatgatttttgatgatttttaaatgattttgtatgtgcctatgtatcgaaatctaaggcaatcttcttgataattttgattattttcccaatccttgtcttatttgactaggtcttcattgtttttaccttacaatatgaggagctagtactgagtaaatacatcaccattttcttgtttacttgaatctgaatggtgaactggtgataattatctccatcacgtgcaaatccattgactgaatcttttttagctgcttgtccattttgtgagggttagtttaaactagttaatacctattaatcactaacctggaacatgcaaacgacaacatgtagcaattctggaagctgaggacatataagggagtgccatagggccatccctggagttggagagctcccactctcctcacaagaacctcacacatcttatgtgactcatgactgactgatgtgtggccaaactgataaattgtctagtaacaatccatatattaaatgctggtaaagtgtaattaatttcttaagaccaaaaaaagtcatataaatggcacttccagtattttcttctggaatcttaatgagaattccctggagtttatggatgccacttaagaaacactgccatcactttttcctttggcaactctgcaaacactaaccaagcacctgtaagtgctaggactgtgctagacattaggcctacagtgatgtgatttctgccttctgggagttcatatatagcttgtttccaccacactaagttctgctatattctcccctatagatggtgactctggaattgcccagcttgcagtgccctgtagtaccttgggctagactactgacagtcttccccaaaaggcttaagcccattattccccttcctcagggtaggggagaaggtactagatcttctgctcccaaaattgccaacatcagtaagtctaccactcatggaatccacatcttttccaagggtactgaagaacccatggcttcctttaacctcatttccctggtaactcactccaacatggcctacagccctttggtagctcccaggccaggtcattacagtgagaattgggtgtttcccctggccacatgcaggcctggctgttgccagtgctgccacaagagaagtggtgagcagtgtgtgctgattagtatctcagcctcgacacaccagggaagggtcaaacccatgaatgcagtctttcatggccgtggtacagggcccctattttttcctccagaaacccttcacttgctttcagaagtgatgatcaaatgtgaactttcatggtttatttatagctctgccttatagagagaaagaaaagaagtgattaaaatgctattttacaaaatattttgtttttaaaaagctttcattgtgtgggcaaaaggaaaaagaaaagtcactgtattaattgtgctgtctagactctcaaacaaagagggtagcgtgctgcaaattaagattgtccggctcctgcctgctgacaaaaagtatgaatttggaggccaacttcaaataaaccctttggaacagaaatatattgtgggggtgactatatttagcatgtgtcagcatttccatactaaattcatattgttatgttgtggtaatttcagatttcctgcagccaagtgggatcatgagatttcagttttatgttaattatttggagaaattgaaaaactcagcagtgctgtttctgatgacagcactgattctcagggtattctccacgttgtgtcagggacccataatgagccctgcctttcaggaaaggggaaggtgagcccgagtcattttgactgtctttataagcataactttaaatatatatatatatatatatatatatatatatatatatatatatatggcattacatgttttccctacaaatacaaaattaatatatgccactgtagaaaatttagaaaacacaataagcaacttgacaagaaaaaaaaattgttacccatgctatccaacctgttaacattttaatatatattgatccgatctttattatgcatatataacttgtttttatatgcatatcttgtttttaacttgtttttaacaagttatatggagcaaacaaaaaattatgtagcacaaacatgattattgagatagaatacaaaattataactttattttctattctcattatccctttgcatttgtgcagtagagctagtttttccctgctctggttaaaaatcctggtggttccattacttttttagataaatataaagtcacttagataatataacctttatggtcctttaagttgtgagatgtagccaaaattcagaaattcaaatatcaaagaatatgtaaaggtaaaggtaagatgttttccagttcttccagctggagtctgccagaaacgagacatagccctaatcagattcttctttcttcctcattcactttctctccaacatattagcttttttcttgttcctctgaaatggttagaaagtataagggaagaaaagttagtggtgtaggaaatttcttatctgatcagtactgtcataatgggcttcatgctctcttagccttataggtgtttacagctagctctgattctcataaggcacatcatagatttttggggagaccccctgcctctgaaaacctctcgcctgaaatattgttgtcttggttaacacctgtctattctcatagattgctcactactcttctcttaattcctcaggaatcctttccttttttttttgttgtttgtttgttttggtctcttttttgtttggttttgttttgagatagagtcttgctctgtctcccaggctggagtgctggagtgcagtggtgcaatctcgattcactgcaacctctgcctcccaggttcaagcaattcttgtgcctcaccctccccgtgggaccacaggcacatgccaccatacttggctaattttgtatttttagtagagacggggtttcactatgttggccaggctggtcttgaattcctgccctcaagtgatccacccaccttggcctcccaaagtgccaggattaaaagcatgaaccactgctcccggcccaacctcatgcttctttatggtgactgctccacctcgttaggtggccatgttggacaggatctgagaacccctggcagctctctcatacatgggccacttggggtctatgggaaacctttgtcttttggatctggacagactctggcagtgctggttgatcccagggtaacctctacttcacttttacactgcagctgtcagccagcctgtctcttccagacaggagtcacatacaagccaccatgtgccacaacctcagggacatgcagcagattctctgctggtctgtgtcttcctgactcctgaagggagaggatctcttcatacttcaccctggaaggaggcctgatgtgcagtaaaccaacagctctttcctaaaaatccatctctgtctgaccttccacatcaatgaaaggtttaagagttgattaatgggtcctcaggcacccttcttgcacattcttcagggtggtctgtttccagttcactttggtatcttatatctgtcatctttagatctcagccaaaacttccattttaacattccgtcacgtgtattatccttaagttcattcattccgtagacattccctgagtgcatacgatatgccagatgccgagtttggcagtgaaaataattataacaattcctgctttaaggcgctcacagtctagttggggaggctgatctgttaacaaaaaaatatggtgccatgtcataaacgctatgatagacggaagcagaagttgctgttggagcacataactcaatataggtgggaggcaggcagcggggatgagtcagaaaaaaatctcagtagagctgatacctgagctaagtttaacatttaaatctgtactttctgagaaacagcataacctctttttaaaccattgaaatctctcttgctgatgtttgcttctcaatttatttttaaaacaagcaaaggtaatgtggagaaaggagggaagaattccctgatgtctgccgtttatgtgcacatctgttgcagtgggaaggaaaataacatttatggagtaccttctataatagaagtttcctggatcccacccatgagggcgatcctggaatgttgtctcaagtgtggggccaaagcacagccaggaggagcattccctgagggcagtttgaagattcagagctggcaatagaaggcaaggtcctccctaaagcacagcagagcacaactcaaggaagagacgaaaaggacaaaataagaatgagtggcacggttgatgatggggattgctgagaccatctcaacaataccccggcttgctctaagggaatcaggacttcgtctttgaaggaaactgttctggggtaagcagagctcttaacatacctctgctaagtggaatggcagcatgttcactaagatgtgtttgaccatttggccctccacaaaatgactccagacagcccttttagtcttcctctttctccatggtttctttgtcaataatttttcttcattaaaaaaaatctcctccctacttaaggctgccatttctttctgttgtcattgtgctggctactcttagcatctctgatctcccaatcagcacattcacatccattgagagctgggaagctagatgtctagttcagaatgcacatgctatccttgtggaagagtccatagagcaacctagcaggagtggaaattcgtgtaagctagcagatgaaagaaccatcaggttacctaacccttgaataactactgaaagaagtttatccgcttctagcgtagtatttatcacactctattttgatcacagtaaatgtcttttccactctatagtgagctctttgatgaaaggcccatgcaatcttcctctctgtattccatgtagattgagtgttatgcttggcacgtgaaagggaggcaatatgttttatgaatagtccaggtgtcgagacttagtagtaaacagacaagtccttgccctgtgtagcttacattccggttagggcaaggagtggagaaggcagacaacgaacacataaaccagtaaatatacaaagtggcagaaggaaattagtggcatgcaaatcagtcaatcagtcacagtaaggtggcaaagatggtcaggggaaacacttggaaatgttttgaagatacccaggggctctcatattctgtatggtattcagattttttttttttttttacattttttcctcccttactagtatgtgagtttctccaggataaagagtatgtcgtatgcaaatctgtatccctagcagagtgtgtggtacatagtaagtgattaataaatgtgtagaataagaagttgtacacatgtgatcccagaatgactgcatccttagcaataggaattcaatagccgttcctaagactgagcctatgctgtagagctttgtcgtgctgttgcttgcaatcttccctggccaggtctgttggactccaaagtttactttctcatggccttaacagccttaggagactgcttaaaaaaacctaacccttctgctcatatgggagccaaaacaatccatggttaatcttgatgctgcacctaccataccatgtctacccagatgctgtaacatgtcatctgcctgagtgccccattgtaaagaaaagaatgtcctgaagtcacattccagaactcaagtcacttagactcagcccggaggtctcagtatgtactcacaacttcagagattgctggaaaaagagctgaagttgaattggagaggtcttaaatattttatcctcaagtacaggtgcgaagtgagttccattccgtgattgctatctttagggaagtagacaatgtactcagcggctggttatgttccctgcttctgccctgtgtccagatagtgaggaggggaaataattcttcccacttacccctggaggcagtcacagaactgctttgccttttgggttgtttatgccccagaggcctcaatacacaagtatttattaagcccaggaggtgtggtcataattgaaactttaaatgttcactgtgttttattcctatttttgtgttttattcttattaccaaagaaaagtaagttgaaaaaaaagaggactaaccaaatatcttaaagggaagcaaattcaaattagaatgttttgcctgtgacaagcctcgctttggatttcgctttccaactcagctgtctatgttgttttccatttaataggaagcaatggcaaaaatgagcaaagttgggaaagttgtgttcccgagactacaggataaaaagtaagtgtgtattttttatatgtacagtgctaaggaagtgagcacatacacacacacatgcaactatagatctggaataaactcaggtggtcaactaatccagtcctttaatttgtggttaagaaaactaagttccagggaggtaatgtcaccttcacttacctaaggctgcagaactatgtagggccagagctgggggtgaatgtaagcttctgaactctcagaccaatgttctttttcccaggtaattggcagcaaatctgctcttctctgttctaaagtagggatctcttatatctccatcaaaggacccagtagaatctgctcattcttttactctttgtatcacttggcatcaaaggctaaaaaatgacattggtcagtattttaatcccaattcaacaaaatattagtttactgaattcctgctatattcaaggcattatgctgggctccaggcaggtgttacaggggaataaaacacaatttaatttaggcacataagattattttagaacaacgggataagttccacaattgaagtattgccaggtgacaaagttgcccaaggaagaaagagatgggagcctgtagagatgagagaatgcttttgggaggaggttatgtccaagctaactttaagctcttgtaagaaattggtagacaggccaaggcaagaaagaacattcatagtagaaggaataacatgtacagttataaaagtgggagcagcatagtacattcaggttactataaacaactcataatccagaaacacaaagtatgagatggggaatggcaggaagtgggactagggaaggatagaattgggtagggggaggtcagctcataaataccttggaggccatgctgaagacctccaacctcatcctataggcagaacagagatgctgaattctaagcagtggtgagatctggtcagatgcagatcagaaaaatccctcttaaaggatccagtacagggggctcagggtagaaatagagggtccagataaaaggctttttcaagaatccaggctagagatgtaaaagacctctattaatttgctggtagtgattttgaagatgaaggggctgttgtggaagtgcttttataattttagggaagtattcgaggttaagacctaaaagcaaattccacttaacatgatgaacaggcaaatgtgcagatcccactgaagcaggatcagtatttaacagaattggaaatgttcatggaaaagcaatccactttcttttcatttcctttaactccacatagagtcaggctgctaaccctccgaatataaacccttctctaaaggccagggtggaaggtacaggcattgcgtaggggagctccatgcaggaaggtggagagatctgagttcccactggcagtaggagctatgggctgctgtccctgtttctgttccctggaggcagctggagcatccctctttttgtgaaattagaaagattgtctttctccatctcttccctgaccctcccaagacttttcagggaagtttttaagttttttccgtaaaccccacgtgttcagagagtcctccgctgcttgctgggagctggcagctggcagctgttctctgcgaaggaggcggcacacacggtgctttagcaccatctgcaggcaacccagagatttgcaaggagacaggagaagccagtttccttctgagccaacctcatctcattgcctaatagatcacactgttaacgatgtgggacgacatttacttaggcctctgccacacagaagcagggactgagttgaggcacattttgaagagaggggattcagctgattttaaaattcacagtcacggagagtgtaatttagtgactatagtttaataataaatgtttaggatgaccccaaattgcattattatgttcagtccaaatttatatgtggctctggaagagtcacttaaatgtgctttgagaaatttggtgcattgaaagacactatcaacagagtaaaaaggcaactcacagaatgggagaaaacatttgcttatcatacatccagtaagggattgatatccagaatatataaatgtataaagaactcctaaaactcaacaacaacaaaaaagcaaaaacaacccaattcaaaagtgggcaaaggacttgaatgaatatttccccaaagaagatttataaatgaccagtaagcacgtgatagggtattcaacagcactattaggaaaatcaaaactaccgtgaggtaccacctcacacattaggatgctactattttaaaacagaaaacaacaaatgttggcaaggatgtggagaaattggaagctctgtgcatagttggtgagaatgtaacatagtatcgctgctgcagaaaacactatggccattcttcaagaaattaagaatagaattaacatgtgattcaggaattgtatttctgagtatatacccaaaagaactgaaagtagggtatggaagagatatttctacattcatgttcacagcaacattattcatgatagcgaaaatcatgagagcaacctaagtgttcattagtagatgaacatataaatgaagaatgatatgtgcatacaatggagtattattcagccttagaaagaagcaatttctgacatgccacacatcagtgaaccttgaggatattattctaagtgaaataagataaccacaaaaagacaaatactgcatgattccacctatgtaaagaataaggccagtgcacaaagttgtggcaaagttgtcagtattaacattgtaaatcaagtgtgtgtgaaggggtgctcaccttagctcccttctagatattttgagattctaaagtcaagaaatctatctcatgtagtgaaagaattccttaccgttatattgtcacagagcatcattagtaggagcaaattgttcctaaaataattctacaactaataaatttggatgctcatagagtaggtcttagtagtacctacatatagctatattgatgatattaaaatattaattatctaaaatttagtaactagcatttatatcacttattatgagtcaggtactgttctaaatgcttttcatttatttccacatttaatctacaacagctctgctgaagtagatcccataattatccccatttacagatggagaaatttaggcagaaatagtttaagtaacatatccaaagtcacacagctaatgttaggccacattaagattccaacccaggctttggagttcgccttttaaccctgtgcttggccccgtcacaactcctacgttaccagaatgcttacagtctaataaatattgggtaggggactcctactaacatagctatgtgtgacaagtagaagtccctgtgtgtatccaaggttactcttacaacctctctctgccaatgcacaactttgcaccaaaatttcatcatgaggactccttttcagagcaccccagaattgagcaagacatgctaaactggcttcttcaccccctcaccccatgtcagcttcccaaccaagaggagtaaggacaaagttgcaaggctgcaagtataatttgtctcggttcctattattcctttcaggattatgatgccagagcagcttcagctgttctgctgtctgattcatggccaataccagttctaacaggtctaacccaaagagtcagccagataggacagggagagcaacggccactgtgagatgtctggaaggcgagcacagctctagaaaaggcattagctacatttccatggggttttgctcctggataaagcaggtcacaagggaaacctagatgtggaatctgcaaaagggcaattaaaatgttcagtctttgtccttggtcaggctgtgattttaggccagtcatcaaacctggggctagttatataggaaatacttattgaagctggcaatgtgaaagagtctccattaagtccggcctttttgtatatacagtagaagctttgaagtcagacagacatgagtttgaattccagctctgccagtttttatctatactactttgtatatgcctctcatttaggaatttttttttttttttttttgatggagtctggctctttcacccaggctggagcgaagtggtgcaactcaaccacttcacagtgaacgggggacggttcactgcaacctccgccccccgggttcaagcaattctcctgcctcagcctcctgagtagctgggattacaggcgtccaccaccatgtctggctaatttttgtatttttaagagatggggtttaaatgttcttatttctaaattggagataataaaacttcatccaggtcacatataataggtctgaaacatgctaattcattgcccaggatgctgtaagcattcagaatctaggtgtcagcatcaccaccacacatatatttccattcttctaaatgtacagggaagccctgtggcagttttgtcttgagatcattcaacatatttatatttctcccacagatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgaggtattgtttcatcatttctgtattgtctttcaataaagaaaacaaacatgtgcaaccagaa

SEQ ID NO: 340 - DNA, 465778 bp, Homo sapiens; identical to SEQ ID NO: 339

SEQ ID NO: 341 - DNA, 452654 bp, Homo sapiens
gaaattttgcatgatcgcatggagaatggattttgttgctttatctgatattgtcctcagctcctcctgaatttgccgagatcttacagcagtcagtaaggttggtgagttctttcgttgttttaatttgagtgactttctgggaaaaactgtggatttcggccaatatgctgatgataatagcattgctttgaaggtcttgttctgtagaaaatcatttcatagttaattatgtcagcaaatcaacagcaacctcttgaagaagaaagcagtgaggggagaaactgtgtatatgtttaaattattcagaactcaaagagaggtcaggaattcacatttcaaaaggaggagtctatgtaagaacaaatcattaaatttgcatatcttttccccattatgggcctagttttgtaattggcatattagggattaaaatgaaataaccctgcatttagaattaggaaatgactccccctgtcccccgactatctccctttctgtctccagggtcctggcacaggagtaagaaactatcacatttaaatgtctgcatttagagaactcagggtgtccgttgggtttgtagaagatggactgactctgttgattcacttgtcgggtggaccctttctccatcgtccttctctcctcagtgtgtgttcctatttaaatggagccccctgcttgggagggagactgctccaaagaggagcatggtgcttcagccacaagccacatagaaggcttgctcataatgctgctagaactctgcagaggaagaaagttttttagggtctttttattttaagagatatttgactattttatatattaataatcctctcctccttcacaacccagtaattccccttattactacattacaatacattgtgctcatacaaggaaggtagggagcagagcattttcagttaatatctaatgtttcccacagtaggatttatcgtgacatcaggtagtctgtattaactggatcatggagaaggcatttctaatgatcatctgaaaaggcttcacaggattaacagatttgaaacttcattctctgtgtgcccaggacacaggcagcttggttagtgtggaaagccaagtcatttcagggatggtagaaagagttcagctctggctgataacaaacctgaaattttttttttttttaaagattcttttttttcaatattttactgtaagttccaggatacatgtgtagaacctgcaggtttgttacataggtatacgtgtgccatggtgatttactgcacctattgactggtcctctaagttccctcccctcgtccccccaccccacaacaggccctagtgtgtgttgttcccttccctgtgtccatgtgatctcattgttcagctcccacttatgagtgagaacatgcggtgtttggttttctgttcctgtgttagtttgctgaggttgttggcttccagcttcattcatatccctgtgaaggacatgatctcattcctttttatggctgtgtagtattctatggtatatatgtaccacattttctttatccagtctatcattgataagtatttgggttggttctatgactttgctattgtaaacagtgctgcaataaacatatgtgtgcatgtgtctttacagtagagtgatttatattcctttgggtatatacccagtaatgggattgctgggtcaagtggtatttctggttctagatccttgaggaatcgccatactgccttctactcttccacaatggttgaactaatttgcattcccactaacagtgtaaaagcattcctgtttctacatagccttgccagcatctattgtttcttgactttttaataatcgccattctgactggcatgagatagtatctcgttttggttttgatttgcatttctctaatgatcagtgatgttgagctttttaaaatatatttgttggctgcgtaaatggtcttcttttgagaagtgtctgcttatatcctttgcccactttttgatggggttgtttctttttgtcttgcaaatttgtttaagttccttgtaaattctggatattagttctttgtcagatgggtagattgcaaaaattttctcccgttctgtaagttgcctgttcactctgctgatagtttcttttgctctgcagaaactctttagtttaattagttcccatctgtcaattttggcatttttttgcaattgcttctggcaaacctgaactttaatatggctttgtccctctaagggctttgtgactatcaacaggatattgactctttcaacatttcagtttcctcatgtagatgggagaaacaacatatactttggtaggtgttataaatgtggattctcctctccttttctctgtaaagggaatggcttggtaggtcaacagaagaaggcattataaacaagtaaatgtgctttattggaacacaagggttgaacagaacccttgggagggtgtaagcagggttttatggaagatggtatgggagatctgaagtttaatttctttaaggggatgtttgttggtggagtttggggatgtcatttgatgagtcagattttttcatccatgatatctttaggacctgttctgtgcatttggcttcagccaagtttgggttttatgtttcccttgtgactgctgttggacattacctgtgtggctcttggaaggttatggtttttggccaccattcaagatggttcaccatccaaaactggctcagtttggattcttgtggctgccacattgtgaggcacacatggggatttggtaggttctgtcttttctgccttttggaatccaactttaaatttaaaaggatagccaacttttctactgtctttctgatttaataccatgtccctcttccaatcatctgttagtctttacaaatgggctcagtaaagagcataaggatccccaaaaccctgaaaaatactgagtttctgacctagttggtcagaactgttggaacagtaatgagagcagtaaactggtacctccattaactgctgacttgttgctgtgtcctcacatggtagaaggggcaagagtcttccttgggcctcttttatgaggatactaatcccgttcatgaggactcctttttcatgacctcatcatctcccaaaggtcccactttttaataccatcaccttaggggttaggtttcaacacatacatttttggaggacacaagcattcagaccataacattagactgtcagtttgttaaaattagagataatgtatttttcagccccttattcctagcatcctggcatagtgaaagcacttaatatttgtttgtttactggaaatcaagctgttagatatggcgagaatgcctaggtatagataacacatattaaaagatgtgggtgtcagcaattgcaaaaatgtgaaaacaacctaaatgcccatcaatcaataagtgggtaaagaaactgtgatatatgtatcacacacacacacacgcacgcacacacacacacacatgatggaatactactcagccataaaaaggaatgaattaatggcattctcagcaacctggatgggactggagactattattctaagtgaagtaactcaggaatggaaaaccaaacattgtatgttctcactcataagtgggagctaagctatgaggatgcaaaggcataagaatgacacaatggacattggggactcagtgggaaagagcgggaagggagtgagggatataagactgcaaacaaagttcattgtatactgcttgggtgatgggtatatccagatctcacatatcaccactcaagaacttactcatgtaaccgaacaccacctgttccccaaaaacctacggaaattttttttttctttttttttttgagacagaatctcgctttgttgtgttgcccaggctagagtgcggtagcgcaatctcgctcactgcaagctctgcctcccaggttcacgccattctcctgtctcagcctcccgagtagctgggactatcggtgcctgccaccacactcggctaattttttgtatttttagtagagacggggtttcaccgtgttagccaggatggtctcgatctcctgaccttgtgatccgcccgtcttggcctcccaaagtgctgggattacaggcgtgagccaccgcacctggcctaataaaaaaatttttttaaaagatgtgggtttcaagaggtgattcagtgttggaggtgaaggttgatttgaggcccacactttgagtaagaaggctgtagagtgtctttggtgatgctatactgttacacccaaattttccttctgtgcctcccagtgccattgattctttctggttataaaggaattgcccttttaaagggctctctgtgctcattatttcctttaatcttcacaacaatcccttggagtagttgtatagaattcatgagtctcatacctgtgaagagagacatcagtgaagagacttaccccaagtgagtcagtggtagacacagatgggacaagcatctggtttcctattctgaatagaatatggtgaccctgatattgatttattttttagtgttgtggagaagaattgtcttcatttctcccaaatgcagtgactatttgttagtccattcttcagctccttattgagtacctactgcataccaaatttatttgtgtgtgtatgcactggggatacagaggtggataagatagacgcagcttatgtcttcagttgtcaagacacagtcctgcattgcttagcaggatgacttctgcactccgtcttggagcttcttttgagaacttctgggctcagagactatgtgtgtgatgttgttttctcatgttctatggtgtctgggatcttcagagcctgttagccagctggctccaggaacctatgtgtcatgggttccacaggtgaacttcttggtactggggctcttgaggtctctccagttggtgacaggaaacattccaggtgtgagtggctgaccctcagagtagagaaagggttttgttggtttgtgttttgtttctttggatttacctctgggtttctgagaactgacattttcataatctgttccttctctgcattatgttaatagacttttctggggcaggaagaatttagtggatgtcatttgttagccaaggtatatgtctgcttttttttttccttctcccctcctcccatcaatcaaaggatttcttagtttcttatctgtgaatcactcaggcttccacttaactgccagttcagtttcctccttgcccatcctcccttctcttttctcctctccttcccccacttctttcccccatttcccttttttccctctccccaccacacttccctttcctttccccctcttttccttttcctcagattcttttgaatttttcttgatctgcaacaagccaggtcctttgttaggcattagtgttagacatcagtgatgcataaaagattgttctgctcttccaggagctagataagggcctggttccacttctcagtattcagggaatggattccctgcttactcccttccttcctttggatgccacaaaatgagcacttgactgaaaatatgcttatacgcgtttttacagactacgccaagccacaggtatgtctagatgaaaaatgtgttgtgccattgctacagactctaaaagtttggggaaccatggaagtgtttgggtttcttttgagccagtcttggcaaccttaaaacttttagaactgtctccccttggagggaaaggcgaaaaagaactgaagaggaggccttaagaaattttcatgtttagaggtaaagttttggttagcaagctggtcttttcttcctatttattgttggtagagcccatagagaaacaactattattgccaaatcagctctttccttctcatttcaaatttttccaccatcttagagcatgtaaaaattgttgaaagtggtattcagtcatttctattaagactgaggtgggcaagcttaactcattgttcatcttttttcttcccaatcttagcaaatccctgattgcagtataactaactaaataaattgcacaggacttgtgtacatcaactcccagcaaagtccaaagatcaaagttgaaagaggatactgaattccttcccagatttctgggacactgcttctgtgcactgtcaccaaataaatcctggaggagtggcgccttaagaaatagggtaagctcatccgcttctgggagattgtcatcataggcagcaatcttaatgctctgagatgcttcagagggaaagaaggggaaaagtataaaagaacaatccccacattatcggtttttagctcagtatttgtagcttgtacccccttcttaggattgctaaaacccgtttgcaaaggacagccctctatttccaggtccccttttccttttttcacactgcatttgagcagtttgcacatttgttgaagaatcagccacaaagtctgtggtttcctgtggcacatttctaacaatatttatacaggctattatttaatgaactgtataaatatttatacagaacagtcttttgatcataaataggggctaaaagtcagtccagtccatgctgaggacttggacaggaggctgtttctgtgctttgaaatgtcttgtagactgagaagttaggtatgtcccaggacttgtacgcagcacagcttgaatttctgttatttttctttctcttggccgtccacagtccgtgccctcatttctttccgcctgaccaccctccccatatccctaacagctgttttctttttagagtatttatctttgcctaagaagaatgaaatgaaaccccagttccgactctcaccattcataatgcggtctttggagtcacactgacttagcctcaaaccccagcccctgtgcttctgtaccatgcaactttaaacagcttcctgtctgagaacctcactttccttagctgggaaatggggctcatactgcctacctcacagggttgctataaggattaaatgaaatcatggagtcacatggtgatctgcagctcagagctcaatagatatttcttgctgcatttgttgttcttattgaagaagtaatcaaagggtttggctttcagttttagctggatgttgtggaaggagccctaaacttgccgcaagagactgtggttcaaatcctgatgccatttgctgtttgtggcactttgggcaaattactccacccttctgaggtataataaagtggtgataggtttaccaaactgattgggtttctgtgaatgagattaacattgtgtgggaataagtgacacgatgatgatccttatccttgtttactttacaaactagaaaaaggaataatgctttccactttacagttactttactttttgaggccaaggggtactggttgcataagattaggagtctaggacgcagcagatcatattcatgacccaggaacaaagggcatagagggggaagagcaggggacctatgatgcagaaagtcctttgctggagctcacaggtcgaatttcagggaagctgcccaagggcttgaacatccctgctttcaggttccaggtatggaaataatcacagagatcagttaaaactataataatgggaaaagtggtgaacctgaaatatgcaagtaggatctatttcatagaaaaacatgaactgggtgatgtgtgtgaatgacgctgggatggtttgactctttgctgcatggtgccctggtaataagttatagaaatccatattttgctagaagcaggccacctggtgttgtggaagggtcagtctctgaagatgaacagcctgggttctgagtcagccaaccttaggcacagcaggcagaggcccccagcagagtccttgacaaatgggcatttagtaaatagaggaatagcaggaggcagtggagcatcctgagaaaggttagggctgatggaaccggagggaatggattactgtcaattgtattactgcctagtaatatggcatactggagcaagttactttacctatctaggacttattttcctcatcagtaaaatgggagtgatcatagttattgtcttcaagaattgtggtcaggcattgtaatcaagctgcttagcagaatatcagatatgtggtaaacatggtacctttttttatttccccagtgatgaattttaaagacatccattcactgagttacaaggacttactgagctcctgctgtatgccaggcactgggcttacagctgtgacacaggcggcagctggaattaactgtaatcataccgctccattctccatgtgaagggtgggctcctgccagaaaccagaactggagcaagcccagggctaactgtagagtggaaatctgcctctttgggttttactggaaaggaatcagaatgtgggtagggtggtaagatgatgtattttatcatattactctcttcatcagagagggagtcaaaagtgaggaacccaagcctgagcacgtgggccagccccatggggaatctgtcttgtcatcggggctggctggagtagagacaagtctggatgctggctggccaggtctgtgtaagccagggtattgaatagatttttcatttcctatttatttctttgtttcttcctaagcgtttatagtagtcttgcaaaagtcttgccaagggcaaagagttgttagcatgctaggatcagtgttaaggagcagcaccccgggggcctttgcagtagagacagtgggaagcccagagaggggattccaagtaaagtaagcagctgtgagaggttggtagagggaaggtagagtggctagcttcaatcttcttcctgtttgcagctaataaaattgaggaaactcagcgaaggcattgcccctattttgtcaatcagtgtatcctcagcaggcttcctggtgttactgtcttctgcatttcttctgagtctcagatgtcactgattgcaagatgcaccattatttattattaccatgaagtaagaaaggaaatgataccaattaattgtaacataccattgattgtaaggttctcactggttttagagaagctaaatatggaaaaatgagtgccgtagaatgaataaaatgtggttgtaaaatgaataaaacaggcatggacctgttcatccttgtttctgttaattcattgattcagttgttcattcagtaaacatttactgaaaacctattatgtgccagacactgtgcaaggagcttgggatacagaaatcaataagttcatttttttcagattcagttaggaagacagacatggaaagaaaaataaaattgtgattccagagtggtaagttttaaaagaaagcagggagaagataccatgttggcatcctttgtatgtatgcaaggggagaaagggaaggaagccttttccaaggagaattgatggctgacctgggtcttaaaatataattcagtggtcaccaggcagacaaggaaaggagagaattaggaagggatgagcaaaggattggggcagcctttagcagctgggggcaattgagagcttatgaggagtttgaggatgtctgtagcctggagtgagaatgagcaggactgtattaggcggggctggatggcaggcagagggagcctgtggagggtgtgagatcccgtgctgaggccctggggtatatcacagctcaaagctggtggttttcagttgtcctgagagagggcctagcagagggactgctggggggaagggctggagggtggggcaagggcgatctttgcttcagagcagctctgtttttatctgttttgttttcttcaaataatggcttgaagaaaaggtatcactgttgaatgaatgaaggaatgaatgatttgaaaactggtgctaatggtcatatggaggtccccaaggggaatgtaagcaagggagagaagttgaggttacacaccagtggaggtctgatgaagctcctatgaacggagcaaatgttacttctgcagcttctccattttatttttcacctgctcatgagccacagagccaaaagggggacaattctgttgggaaatcattgtgattaagacagaagcaattacttttaatgaagtttttattgttttatttgttttttactggagtaaatatctaggaagcagtaactgaacatctgctggttgattttctttcagaatctccatgtttgacttggctagggaaacattttctttctgaagttgaaggatgcagaaggttgcccaggttgaaattagactctgggtggtaaaactgccttgagctcacctggagagttgtagggcatccacctgctcagttgtgttgggggcttgttcttattctttcaaagccaatctggaaaataaaagcctctatgagattccatgtcatgtgggctaatctgaccaaagggacttagagcagccatgaaggccaaggaattcctgaatgttctctggtcagatttccttgtaactcacaaggggtctgtaaggaaaacagattgtctaactaattgctgatcttgtctcctcggggttccttcccaattcccagtcacttcatgacaaagctgcaatatatttgcctcttctccaaacctatacagaaagcttttaagaaacaaaggaaagagcatgaaacttgggattgcacaaatatgggactttaggtccaggctgcccctgaatgaagctgattaaattccttaacttctcatagacttgcttcttaatcagtgtagtgtgtatcattataataatgtacatttactgtttgaatttatgagtagacctagctagcattaagcaaaaagttacttatctcttggaatctcaccttgaccacctgtaaaacagagatgtaaatagcctcaccttctagagtcatagtgaggagtaaaggggacataagcacttttcacagtgcttgcgtgtaagaggtacttagtaggtaattgttgaatgaatgactgactaggaggacaaggttccttttcagtaccttggcttctgttcttgttgattgaaattcactgagaagaaactcatctccattgcctccagattctaagttctcctaccaccctgtacttgcccttacagcactcatcacaactttgcctaaataattatgtatttaaatcctgactctctctcaagagtggaaatgccatgtctgaggccatatctgtgctgttcacccaccatgtagctcaatgtttattagtatactgttatcactaaaaatgtttgttggatgaataaataacaaatggctaccggttaggtagcggtacctcttttatttctacttttgagatgttttgtgactgtctttgcagatccacttggtcttcatatggtttttacacttgcttactataggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaaggtatgggcaaaactggtgttctctccttgttcatattcctacctgctgagtgtcgtgtgtcaatctggtgccgtaaacaatgttggggtaactttagatgcagaggtaagcaagacataggccttgcccttcaggagctcacagtctactggcagagactgataaacagctaatatatggtaagagctgggatcaaagtaactatagctggagctggggaaagagctaaccggagggggctcagggaagacaggacagcttgaggtgtgaccacatgtggaagaattcactgatcaccttattaacatttaccacgcctttaatgtgtgccaaaggctgtgtaaaatgtgttaacttgcactgtgtagttgcatcttcacatgaccctataaaggtaatactgtcactacccctattttattgagggagaaatgtaggcacagaaaagttaggtaacttactcaagttcacacagtaagtagcagaggcaggactagaacaaagcagtctgactccagaggtgcgctcttttttttttttttttttaattaaaaaaagttcaatgggtttttggggaacaggtggtgtttggttacgtaagttctttagtggtgatttctgagattttggtgcactcatcacccaagcagtgtacactgtacccaatgtgtagtcttttattcctcaccaccccccagcgctttcctccgagttcccaaagtccaattgtatcattcctatacctttgcctccgaggtgcactcttaaccattggactctgctgccttccaagtggacaaatgaggatgagaggaactgcattttgggcagagggaatagcatatgcaaaggcatggtggcacgaaaacatggtgtgttctgataaagcaaaggagtcagattagagtgtctcccatatatgccaggcatatgttcaccctgagtggccttggattggatgcagcctgctggcttgggaaggaaagcaatgcttcacaattcttgtttgtttttaaagtttcacttgactgtttgattttatgtcttggtgatcagtaatgacagaggtccttttgtctttttttccatggggaaaaataaagtcctggattccttcttttccctgttcctagtttagttccttaaatattcatgaggtgcttggtaatttgcagatggacaattcaccattctgtccctattgatcagtctgtttaaactttaatgaattctgggctgctgttagtgcccccggagaagaaggcagagagaggagggagtgggtaggcagtaccagagcattatacaggaataaaagagggatgcatcttctcttttgcccatttaattttcctctcctctcccctcctttcagcccccaatctggtaagaatcttctactctttgcacttgggccttctttcttcttttaacatacagccttgcttgccgttaaggaaattatcaagaagaaaatataatcccctgatgaaaagctactttaaaaaaggtctactctaagtacagctggtttaatggtagatttttaatcatctcccagtggtggccaacttatcatctgtttgagccctgttagctgcataagtaccatggacatctgtcgatagcaatgctattgcactatagcaaacctaaatgaagcccttgggtcttaggcgattctcctcagatggagtatggatatgtgggcatgtgccagaagccacaggataagcatgttacatctatatggaacatcattgctggtgtgaggcttagggagggaagcatttttatgttagagagataataacaccataggaatgagagaggtaggtgacctgttatagagcacagattctgcagccagactgcctagattgacatcccacttacaacgtttattaggttgtgatcttggacaagttacctaatgtttcttgcttcagtttccttatctgtaaaatggaaatgacattagtacctacttccataggattgttgtgaggattaaatgaattaatgcacataggatgtcataacattgcctagaaatgtgtatgggttgtttcctatggtggtgctgatggtgacagaaaatgagcagattatagaagatagtgaatttctaagacaaaatactgaaaagtcaaagtctacggcgggggaggcgcttcttgggaatattcattcactctcctggttagggttcttactgtgtaacactttgagaaacactggtctagggcaaagggtggcatcagatatgtcctggtctgtcttttcttcctcatggactccaggaagttgagagcttcagagcagttgttctaattccttttccctaagtcattcacattgcctgagatgactttcctcttagttaaagcaacagtaaggataatgtggtgtcaatgatgatgacaaagacagctaacagttcttgggcacactggtccaggtactatactgaagagcttttacccatcacttcattttatccttataataactacttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaataactactttttaaggtagttttgattgttctctctgttttgaagatagaaaaacaatgagctttgaagaggttcagtaagcagcctaaggtctcctgaataagaagaaggggacgctgtccctgccactgctactgctctcatgctctgtcccttgtctctctccagccatatctccctccacatgaccctacctggaactgataagaagtagcctgaaatttttagattttctacacatggggcatcatgaggttacccaggattacgagtgcctttacctggttgcctgctcatctgggaagtgtgtgccccctcagcaggggttatatctagtttatctgtatttctctagaattctttgcttgtagtgtgttcaattaatgtttgttgagtacataaatgaatgatatatctctgttgtttacattgtctggaatactcttctcttaacttcctcacctgcccaactcccaccttataaagtaagcttaggcggggcgtgttggctcacgcctgtaatcccagcactttgggaggccaaggcgggcggatcacgaggtcaggagattgagaccatcctggttaacatggtgaaaccctgtctctactaaaaatacaaaaaaaaaattaaccaggtgtggtggcgggcgcctgtagtcccagctacttgggaggctgaggcaggagaatggcgtgaacctgggaggcggagcttgcagtgagccgagattgcgccattgcactccagcctgggagacagagtgggactccgtgtccaacaacagcaacaacaacaacaacaacaaaaacagtaagcttaaacattcctgtctcctgagtgtcttccttggtgacttctgacagtctatgcccttttttaccaacctcagcagaaagagagggtgagaagcccctctctactgtccagagcccaccatcttcacccagatcactttctactccttatctttgcattttacttgttggcttgtttacccccttttaaactatgagctgagctcttagagagattcatctttatgtctccagtatctaacacattgcctggcacaaattaggtgctcaattaatggctgttgaatgaatgttacttagagctaaaaacaaagagacaaaatccaatctagcattccttatcttgtttcagtgtcactgtggggcaggaaggacaactattcttcctatttgaaatatgaggaaattgaggctctggaactaacaagtattggagacaagaccagaaccctggtgagatggctccaaatcttcctctctgtcttcctccctacattccctaaatttggcaggttttattgggctggtaagccgcacacctaagaggttttatggaaactcacaagtcatagaggttatatgcagtccacgattttaaaggttcctttatggagccacaaatcttaatcattccaaaaaggtgagaacatttcaaattagtgcatgattcatactaaacttctcttaggaagaaggagaagataagctggaggaatcatttagccaacaggtgtttgttgagtatcattctttcatttagtctgcaaacatttattgagcacttaactatgtgctatgctctttgctaagcattggagcatatagaggagacgtatacaagaagtctgctgcttttaaagatgaaacagcttaattgtatgagaaaaataaacaacacatatgaagccagtaaagtaccattttgttctgtcttggtgctatctatatgagtagtggttgtggggagggggacagaagaaagagtagccacatgtcgggttgagcaataatgttaaccttatattcatagaaccattatagtttacagtgcatcttcattttcatttgattgctattgcagggtgaagtagggaagaagttgttattcccatttacatttgaaaaactgagggccagagagttaagtgattttcctaaggtcacccaggtggtatgtgataaggcagaactcagatgggtcaaacctatgcattctctctatctctagcaccatatacctttatattttgcatggaatattattccaagaacctaactgatgtcttgatattcatttttcttttctctattcttgcatttgaagtgttttttttttcctctagtgctaactgatcatgtcactcttttgctacagcccttcaacatctatcactctactacaggcataatgataaattcagttccagaacaccataatgaggtgaatattgcaacaaagctcacatgaatttttgagtttctcagtgcatatgaaagttatgtttacattatattgcagtctattaaatgtgtaatagcattagtctaaaaaaagtatataacttaatttttaaaaattgccaaaaaatgtgttaatgatcatcgaagcctgcagtgagttgtagtctttttcctggtggagggttttaccttgatgttgatagctgcttactaattagggtggtggttgctgaaggttaggtggctgtggtaatttttttaagtaaggcaattttttaagtaaggtttgctgcactgattgactctttctttcacaaaagatttctctgtagcatgcaatgttgtttgatagcatcttatccatggcaggacttctttcaaaactggagttagttctttcagaccttagccttatcagttaagtttatgtactattctaaattgtttgttgtcatttcaacattgttcatatcatctttatcagaagtagattccatctcaagaaatcatttcctttgttcatccataagaagcagcccctcatcggttcatattctatcatgagattacagcaattcaatttcatcttcagggtccacttctaattctagttcgtttggtatttccactacctctgcagtaacttcctccacttaagtcttgagccactcaaagtcattcatgagggttggaattaacctcttccaaattcctgttaatgttgatattttgacctcccatgaatcatgaatgttcttaatggcatctagagtggtaaatcctttccagaatgttttcaatttactttatctagatcaattagaggaatcactatctatggcagctatatccttacaaaatgtaattcttaaataataatacttgaaagctgaaatttctctttgatccatgggctgcagaatggatgttgtgttagcaggtatgagaacaacattcatctccttgtacatcttcatcagaactctttggtgactcggtgcattgtcaatgaggagtaacactttgaaaggaatctcttttctttgagcagtaagtctcaacagcagggttaaaatattcagtaaaccatgctgtaaatagatgtgctgtcatccaggctttgttgttccatttctagagcacaggcagagtagatttagcataattcttaagggccctaggatttttggaatagtaaatgagcattggcttcaacttaagtcaccagctgcatttgcccctaacaagagagccagcttgtcctttgaagctttgaggccaggcattggctttttgtctctagctgtgaaagtcctagatggtatcttcttccaatataaggctgttttgcctaccttaaaaatatgttgtttagtgtagacaccttcattgattgtcttacccaaatcatctgtataacttgctggagtttctacatcagcacttgctgcttcaccttgtgtttttatattatggaaatggcttgtttacttaaacctcctgaaccaacttctggtagcttcaaacttttcattctgtagcttcctcacctgtctcagcctttacagaattgaagagttaggactgtgctctggattaagctttgacttaaagaatgttgtggctggtttgatcttctatctagaccactcaaattttctccatatcagcaataagactgtttcactttcttattcaggtgttcactggagtagcgcttttagttttccttacgaactttcttttgcattcacagcttgactatttggtgcaagaggcctatctttttgccagtcttggctttccctatgcctacttgactaagcttaatcatttctagctttacatttaaagtgagagactatgactccttctttcacttgaacatttggagaccattgtagggttattaattggcctaatttcaaagttgtgtctcgggggtagggatccctaaggagagggagagagatgaggaatagctagtctgtggagcagtgagaacacacaccacatttatctattaagtttgcccgtcttatatgggtgcagtttgtggtgccccaaaacaaatgcaatagtaacatcaaatattatcatagcagatataatattaatgaaagtttgaaatattattaagaattaccagaatgtgacacagacatgaggtgacatgagctattggaaaaatgacactgatagacttgctctttgcagagctgctacacaccttcaatttgtaaaaaacacaatctgcaagatgcggtaaagcaaagcacaatgataccagatatgcctgaggcatacctcaaactgcggttttagttccagaccactgccacaaagcaaatatctcaataaagcaagtcacatgaattttttgattccccagcatacataaatgttttgtttgtgctgtaccgtagtctattaagtgtgcaatagcactgtatctaaaaaaaaggtaccttaattaaaaaatactttattgctaaaaatgctaatgaagtgagcacatgctgttggaaaaatggcagcaatggacttgcttactgcagggttgccacagacgttcaatttgtaaaaaatgtaatatctgcaaagtgcaataaagtgaagcacgataaaatgaggtatgcctgtatttgggtagaactcaatccttaacatggccttcagggccctacatggcctgtctcgacttgcattcctggctcatctcatgatgcttctcctggctctctgcattccagccacaccttccttctgtcatgtcctcaaacatgcaatgctccctttagcgtaagaattgttacccagattctttcttctggctgcatatccttcctaccttccaccagcatatctaactcctgttcatccttagacctaagctatccaatccaatagttgctgaacccacaatgccatttaaatttatagtaattacaattaaatataattaaacattcacttcctcttttgctccagccaaatttcaagtgctcaatagccacatggtggctattatactgaacagcacagatatagcacattttcattattgtagaaagttccattggatagtgctgccccaaaccttaattcaaaagttagttcttcaaggaaggagcattttctctaccaataccacctccaactaagtcttatttcacttattaaatgttttcacagtgccttgtacgtctctttcatagaactccatgtggttcgtgaatcattcattttttgttatcaaataataaaatcattctataaatcaagaataaaataccataaaatgaaacaaaataataagatatttcactttttggattaatgtatgtcttccctactagattttatgtttcaggagggcaggagctatgttttgcttacccagagcctgggttatattagacccaggaagtgtaaaaaaaatgaagggtcaaaagaaattgagagcactttgggaggcccaggtgggcagatcatgaggtcaggagtttgagacccgcctggtcaacatggcaaaaccttgtttttactaaaaatacaaaaattagctgggcgtggtggtgtgcgcctgtaatcccaactactgaggaggctgaggcaggagaatcacttgaacccgggaggcggaggttgcaataagccgagatcgcagcactgccctccagcctgggcgacaaagcaagactccatctcaaaaaaaaaaaaaagaaaagaaaagaaatggagacctccctacttctacccactggagaaaacttgagaaaggatgtagggcaaaaagtgactcttgaactcttaagagaagacaattggaactggaggaatagaatggtcagaagcgctgagatgggaacatcaaggatcgaatcctagctgtaataggtggtttctaataggaagaaggaaagggaggctagaattgacgatacaggggtaggtgagacagctggctcagaccaatggggagctcctctagaatcatcctgagtttgagattgaccagtcttgcaacagattcagaatggctggcagagaagaaactaaatttaaggatgtcaggaggcagacatcctgatgagtttcagaggctgagatttttttttttttaaactataaactttgggaagactgggaccacgtctctcttgaccaggatatgttctctgtgtctggcacatataggtgcttaatatttttaataataaatggctagattagactattggcagaggaataaataggagggctgagactgagaggctttaggaaggcaggcgtaactggacttggcaacaatggagaggaaggaggtagaggctatttgagtttcagttcttggcagaatgttggggtcactgatataaatgagagtatttggcctttatttcatcatcttatcatcaaatggcaataccatacctaagctgggatgctacgtaggtaaaggattaggactgggtttatttacttcactggtcactagagtagcttttacaaaattgactgccttcaagggccttccaggtaatgcacgccccaacacaagctgtatttgtcttcttgctgttccccctcccaggacctctgcgctcgctgttcccctgcctggaacactcttcccccagatttccatgaggtccactcctcatgtctttcaggtgtatcctcaaatttcacttgcatcttgcataggaaccacctcctccttgcattcctaatccccctgagtaatcacttgctagtatactatatctacactatgtaatttatttgatttattgggtattgtctatccctactaaaatgtaatctccaaaagagcaaggattaaaaaaaaaagtttttctctccattgtttttccaatacctagaagagaaaattctgcacagcctgaccctagaaggggcttgattattttcgctaaggacttatggctaagtgagtgattgaactgtgtaaccaacaggtagtgatggagcctgagggaactggtgattgcataactcctcgcacgcccccaaagctgacaaaggcattcaaatcaagatttaaaagaatacagtacctgccactcagaactctactgcaagctggattatgtctatgaagccccaggctttgacccttgctctaaatagagctaaggataaaaccaggtatgcatctgaccctccagttctcagtttggagggtttctaagaaacaccatctccccacccaatatggcagatcttgctgatttaaaacacatgcagaattgaaccatttcccacaataagaagaaagtgatacacaatcccttccccaaatatttgtttgctgccccatagctacgagttgacagttgttagacatggaacaggttaccaaatgaggttgcagaaatctctttctctggaaattctttagaagagcaatgtgctttctctctagctagggaaattctcttgattccaagctgttacaatgagattactgggctgctttcttcttccattaataagaatataaaaaagaattcttaggtcaccaggtcaagccccagaggccttctgggtagtgtgactctgacagtcatctttctgggatggtttagatggtgtggggtgaggggttgggaatggcgatgttcctcagctgtggatgagcatgatcataaggcatttccttgtaaggctggggaaatagtagtggctacctagctagatcaggtttaaatgcatgccacagttactcttccagtttcttgtgagaggtctctgtttgaaagatagagacgctgagtctttgtgactgaaggccatgattgtaatattgagcactctgtaggtctgttgaggggattcataacatacattgaagaaaatattttccttgctcctactaggttactcccgccatgattcttagaaagatttgagtctatccaattttttctattcctactctttttgcttgtcatttttatatgtgcttacgtgacacagagagcaagcatgctgtgctttgtacataaaaacattccatgaacacaataaggcattgagtgcatttcctatcctattttctataaaggtttactggtttcaaagtaatttcagactccactgatcccattcaaagcctttgattcttacttgggaggtatctctcactcaggaaactgaggctcagaaagttgatggagttagtgcaggattacctgacctagaagtggtggagttggcaccagaaggaagttctttggacaccacatcctgtgtttgtttctactcccaaactgccttgtggtatggagtttgagtcatctatattttctcacccaagtcctcttttgactaactgcagacctgtgtgagatgggcttacccaagtcagacatgcactttctgggcacagaagccaattgggccacatagcaagtagaagttagggctgggtgattgattgattggtatcccacatggaaagatttgaagcaactaatttgctctaatataaactgctacttactgtgcactgatgccagatgttgagctcatcacaccttattttgctgaattctcatatcattgggagatgcaggtttaggtaatagttttgtactgccaaggaagctgcttatctgacttcacaaagttatataactcggaaatagtagaaccagatttcagactcaggtcttctgcccccaaagtcgctgatttaactactatccagtgatttccaagccaagttgtaaggacattccaggcagaaatagccatacctgtaaatgctatagaaacatgaaccagcaaagcaagagaggagttgcaatggctagaattgtgtaacttgccttcagccacgtagccatggtggcagagctaggatttgaattcaagtctttgtgactcattgtcatgaggccatactgcctgtcaggaaatgggtttggtcctcacactgtaagtctagatagatcagtgtggtgaaggcatctgggtattcacttggtactgtgggtcaaggtactaccagcagtcacagatgggtcagcagcaagtgttctctagatcacatgtcctttccacaggatgagtctcttgggcaacaggaaattatctgatgacagaggtgagcagtatggtataatggaaagaaaatagacactgagtttgaattctggctctgcaatctactggctgtgtgacaagtgcaagttccttaacctctctgtgcctgctgttcaccctttccctcgccaatcatccacttcttttattttgttttattttttttgagatggagtctcattctgtcgcccaggctggagtacagttgcatggtcttgggtcactgcaacctttgcctcctgggttgaagcagttctcctgcctcagcctccctagtatttgggactacaggcacatggcaccacacctggctagtttttgtattttttagtagagatggggtttcatcgtgttggccaggctggtctcaaactcctgacctcaagtgatcttcccgtcttggcctcccaaagtgttgggattacaggcgtgagccattgcacccggcccccacttgtttttcatgaaaaactaatattaaatgtttcttttggagggctttgtaaggattaaataatatgtatgtcaaacatatggcacatagtagatgttcaatatatggcaatgctttattaatatgacttgaaaaaaattactgcttttcttttttggacatttctcataattatgtgaagctcttgtttgaggaacatgttaaatagtaagaaatggaattctaaattataaatctggtatttccaaacaggaaaaaaataattatatattttaaggtgaatttcactaaatgaggatggacatttttgagttgacttttatgggatttaaaaggttgtagtcatgttttaagttaatagaaactggtcgctcatgctttttctataaaggaaaccatagaaacaaaaataaaaaatagaattaatcgataaatctattattctacaactttaaaaattatacaaacaagtgtaaaatctatatcctcctcctgcagttccaccctcaggagcaaccactattaacaatttgttgcatattcttttttttaaaaccttactaatatatcatggatgtctttccattttatctttcatagctcaactcgttttaaaagtatttaacagcttgatgtatgatttatatatcataaaatccagccattgtaaatgtataatgctgttattttgtaaatttatacagtggtgcaatcatcacctactccagttttagaacacttattactccaaaagtttccttacacctgtttgcagtcaaccccaagccccagtcagaggcgctttctgtctttataggtgttctttttagaaattttatataaatagaatcacatagcgtgctttcttttatatctggctcttttcacttagcataatgtttttaaggatcatccatgttgttacatatatcagtagttcctttttcttgctgagtagtattctgttatatggatatacaatactttatttaacagttggttaaactatgatggatatttggttggttttcagcttgggaatatcaataatgctgctatgaatattcacatacaattctttgtgttgatgtatgtttttattttattttatttggtttgttaatattttgtattgaagttgccgggttgtgtggtaagatgtggctgtattttacatttccatcagcaatgtataagggcatcactttctccacaattctctaacacttggtattgtcagtctttgtgataatattctagtaagtgtgcagtagtatcttattgtgattttaatttgcatttccttagtgactaatgatttgagcactttttcatgtgtacattggccatttgtatattttctttgcagaagtgtccacatcttttgccaatgttatcattgggttgtttttcctcttattatttgagttttaaaatatattttatatgcaagtatattatcagatgtgttgtttgcaaatattttcttccagtctgtagcttgtcttttcgttttctaattgtttcttttgaagaaaaagatttttaaattttgatgaagtcaaaattttttcttttgtgggtcttgcttgctttttataaaatcttcatctaatgcaaggttgcaacaatgttctcctgttttcttctacacattttatatttttagtcttacatttagggatgtgatatgttttgagttaagttttgtgtatggtgtgaggtaagagtctaagttcttttttgcatatagtcatatagttctagcatcactgtcaaatagtctgtcctttcccccattaaattatataggcacatttaccaaagccaattgccataaatgggtttacttcttatatctctgttctattgatttataaatttatccttataccaataccacataaacttaggaatgctagttttatagtaagttttgaagtcagatagcatatattttccaagttctttctattcaattttgtcagtttctacaaataagtagataaataaataaataaaacctgctagttttttttttttttcactttaagttttgggatacatgtgcagaaagtgcaggtttgttacataggtatacatgtgccatggtggtttgttgcacccatcaacccatcatctaggttttaagccccacatgcattaggtatttgtccaatgctctccctccccttgccccgcaccccctgacaggccccagtgtgtgatgttgccctccctgtgtccatgtgttctcattgttcaactcccacttatgagtgagaacatgcggtgttagaaaacctgctaggattttaatggagttgtggagaatctgtaggttaatttgaagagattaccatctgaacaatgttgaattttccattttacgagtgtgacatatttctccaatttttagctcttcatagcaatgtttggtagttgtcagagtataggtcttgaacttcttgtgatatgttaattcctgaatgtatttgtcaggtttctccagagggacaaggccagtaggaaatatatatgtatatgtacatgtatgtatatgtatatattcatatatatatatttatatgtatatagtcatatatatatatatatatatgaaagaaagtttgttagggagaattggatcacatgattaaaaatgtgaagttccacaataggtcatccgtaagctagggaatgccagtagtgtggctcagttcaagtccaaaagccttgaaaccagggaagccgacaatgcagtcctgaataagtctgagggtgaaggcctgagagccccaggcaggctgctagtgcaagacctagagtccaaaggaagatgaacctggagtctgatgtctaagggcaggaggagaaaaggtgcctcactgcaaaagggagagagggaggaaggtaagcaatctgagtatcccccttgttccacctgctttgttctaatcacacccattactgattagatggtgcccactcacatcaagggtggctcttcctctcccagtccactgactccacatgtcaatctcctctggaaacaccctcacagacacacccagaaacagtgcttcactaaccagctaggcatccctcaatccagtccagttgatatctaatattgagcatcacactgagtatttcactttttgatgctattgtgaatgggattattttcttaattttattttttatcttttagttgctattaagtagaaatccagttgatatttatatgttagtcttgcatcctctcatcttactaaaattgcttattagttctagtaatttttttagcttgtagattctttaggattttctgcatatgagatcatgtcatctgcaaagaaagacactttaacttcttttctaatctgtatgcttttaatttacttttctcactttattgcaatggctagaagctcaagtataaggttgaatagaagtggtaaaagtgaacatccttgcttcatttctgatgggggaaagcattcatgttaccattaagtatgatgttagctgtaggtttttgtagatgctccttatcaggttgtagaagttctcttctatgtctggtttattgaatgttatatttggagggtaggggttcttttttctgcatctgttgagatgatcatttggtgtttgtactttgttctgttaatgtgcgtattccattaattaatttatggatattaaaccactcttgcattcctgggatgactccacatagtcatggtatataaaggaaagttttacatgctggaagatttcgtttgttaatattttgttaaggatttttactatgttcatgataaatattagtctgtagtgtccttttcttatgtatttgcttgactttggtatcagggtaatactggctatgtaatatttgttggaaagtgttcccttcttcactgtattttagacaagtttgtgtagcattggtaccatctcttccttaaatgtttgataaaatttcccagtgaagcatttggacctgtagtttttttattttttgtgggaatgttttaagcacaaatttgatttttcaaaaaaaaagtgcttctcaatttttcacatggctttggccaatttccataaccccaaaatggtggtttttgatagttttgtccagtttattagttttattttgctaagaggattttttgacttcacaccgccacacccagcagttgcctctctacctctttttaaaaaaaatctgtatagtatttcattttacaaacatgccataatttatttaataaaaatagttttttcacttttaaaatatagtctgagcagtgctgaagctaaccttcttctatatataactttacttacttttgctaataagatacgtgcatttttaattttaataaatgtcaaattattctccaaagtttgttgtcattaattatattgttagaataatctccaagaaggtccacttctgcatatattgccactaccatatacaggttaagcaaccctactctgaaactaaaatgcaccataattcaaaactttttgagtggcattgtgacgccacacatggatgtctaagatagtaacatttttgttttctgatgattcagtgtacataaactttgtttcatgcacaaaatcattaaaaatattgtataaaattaccttcaggctatgtgtgtaaggtatatatgaaacatatatgaattttgtgtttagacttgggtttcatcctcaagatatctcattatgttatatacaaatattccaaaatctgaaaaattctgaaatctgaaatgcttttgatcacaagcatttcaggtaagtaataacagcctgtagtattaatcttttatatttttgccaatatgaaaagcaaacagtttgatatctttttgtttgtacttatctaattggaggtgggaatcttctcatatgctctttgaccatttctttttattttatgaggtgactttttattcctttgcttaatttccaattatttttaattattattattatttttttttgagatggagtttcgctcttgttgcccaggctggagtacaatggcgtgatctcggctcactgtaacctccgtctcccaggttcaagcaattctcctgcctcagcctcctgagtagctgggattacaggcacacaccaccatgcctggctaattttcgtatttttagtagagacagggtttcactgtgttggccaggctggtcttgaactcctgaccttgtgatctacccacttcggcctcccaaagtgctgggattacaggtgtgagctgccatgcctggccttaatttccagttagtttggttctttttttcttatttataggatcttttgggattatagtgatactaaatttttatctgttttatgttgtaaagatttttttctattctgtcattccttccttctagttgtaactgttttcaatctttaaagaccctggtgttgtaatttatgtttttatttgtttttaaaacagaaagttgtacaagggattgatttaaaccaaattcgaggacttgggtttgatgccacgtgttctctggttgttttggataagcagtttcacccattaccagtcaaccaggaaggtaagaccatgtctcttccttttcccagtggtgggatacttggctgattaatccaatgggcccaggtggaacaggagggcaggcgtctcttgctgctgatagtaaaatttagaggtagagtgaagtgacacagatcatgttgcagaagtcaagagcttggagagcagttggtatgagtggggtggtgttgacgctggattagggggactaggctttctaaaactcaggagccacagtgcagagcttggtaaaggaaggatatgagattgttagctaggagtgattaaccttgaaacacacaggtggttttgatgttttctgagaagagagtgtcagtgcttgcagtttctttgtatacgatattcctattccgtgcttatctgagtggatgagccaagtcctttgaaaggaaatggaacatggtagacagggccatgtgacagatagaaggtagaagcagatggcctctctattttcagtagccagaccaaaagacattcacattaaatggtgttgtcctaatagacacttgtgagtacagaaatgagctgtttgaaatgtaaagtgctacttgggtccaccatcagagatttttcacagcagataaggttgtcccttttggggaattttagccaataacgtttgtactggggttacaaacccgaaagtctattaatatattaatgtaataattaatacattagtcagatgggtaatgtaaatgagtaataggccaggtttgagaaaaaccactgcacctgtgtgaagataaatttcaactgatatttaaccttgtaatgagcagatgacattagggagcagtggaggctgcattgcactggaaattgcatgctccatctgaagggaagggccagctctaggcattgtcagtcagctgttgccaagatagccattgcaaacatatttggggctagattctgttagagaacccttgattctgcacactgttgcagcagcatctttcttaactgttggctatgaggtagtagggtacattgatacacagtggaattagagttaggcggggactctgattgtagctctgctgttgctgagctgtgacaccttgggcaagccacttaactctgtgtttctcagttttcttctctgaaagaatttgaatgaatcagtagctttgctgtgagaatttagtgagagactgatacttaaaatgctcagaaaagtttcttccatcagatgatgaattttttaagttaagagaatattccggtcactactgtggacctaatgtatgaaatagtgattattataattataaggactataaatgatcatctatttgcatcccttttcactataagtgatcactataaataatcataatcactatgtgctgaaaatggatgcaaatagatgaatgattagagcacagtggtaatgatgaccattttctgcacagacacacacacttttttccctcttcttgcgacatttattaacacctcctgtgttccaagccctgtcttagcaaatgctggggcttcaaagataaatcaggacggttctttttcttggtggctgttcattggctcagttggcactgttctggcccaggacagggcagccttgttctgagccatttcagaaagcagagaccaaacctgggtagagcaaacctcagctctgcagcagcaagcattcactaattacaagatgtggccagccacagacctggccgttttgggaggctgtcagtatatcttttatgggctttatttaagtaaaggtcaggtgattgtttgggatgccatagatcagatgtctcttactgttgatagtgagatttagaggcagagtgtggaggctagaaatcaccgtcccagaagttaaaagcctggagagcaattggcacgagtggggtggtgttgggggcagagttagagggaacttggttccataaagcacaagagccatgttagagagcctgattttgggtggaactttagatactaagagtcctgtttcaaggattttgtatcatctgatctgctaaaatacatgtttacttatttatttttattctggctgtgcattagtatcaactggagatctttttaaaaattgccaattcatgagccctaccctcaggatttgtattcacttgacttgaggtggagctagggtgtcaactttttaaaaaagttttctcagtaagtctagtatgtagagaatcactggggacagattaacggagaattaaaatattaggaacagaacacttgaagtggaagaagacagttccttgttaaatttgcttaaatatgtaccctctttggatgctatttttctttcattgtaggtagaatggcttcctgttaacaaatcctctattaaaaaggtaactaggttatcactctaattataagtgttgaaataactttattccacctaaaaggttaaagtgtacccattcatcaaatgcatccagctgcaggtgccctcatcagtttcttgcctttcaacagattgtattaaggttagatcttttatctgaaatgaattatcctgtgcaagaaaatgaaattagaattataaaggtggtttgaaggttctttagagactcctacctgcatggcagcgaccaactcttgattggctaatgggagtaattgtgaggagcagagagtggggtcaggaagattccagataaccctaatcatgcagataacctaaaaccaaacccataagaccagcaaaagtattgccgtctttagatgttaaccaaaaaattataaacgaataaattaagtacaatagtttaagaaaattcagcattagtctatgataaaatagtctcatttgcctttccttgtttgactcttcttccttaaagatcagaacaacccctgggctggacagcagcacagttgctgaatgcttcctacccctgccactgaccaaactcagagccttaccctgattgtgtcatctcagccataggagctcttgggagggagaggaacaaagggtgataattggggctgggagagggagttatgacctagtctcctctgtgcaacagatacctaatgtttagatttttttgctgattcataatattttttcccctcaagtatgcctgcaacacattctgtgaacataaacatgtattttagcaaggtattaattaagtgaatatatggatgaataatctacccttaggtaaagtgaggtagctcaaatgtaactttacctccaattctcttaaacgacaacatttttgtgggtctgtgttctgtttcccatgctgccttattgtatagaacctctttctcactctttcctcacctgcctagccattggctagtcatttgaagaattaaataaacactttcctgccttttgaaagctttctgtgcagctccaggctcagctaactagagcctgctctttgctcctcctccacattcccatgtctggtactcttgttctggcagtcaacacacagtatagactctttctcctgcagacatatgttgcttaagggcagaactgtggcacattcttcttgatatcctagcatccaacactgtgcttggcatgtagtagatgctcaataaaagattaaatgaactttcagttttccataagagctgaaaaaaattaacttctcagtttttatctaaaacgaaaattattaattctaatacagtaatgattctgtacaattttcattgtattgttctgactgcattttgagagcatctttatgtagaggcagtagtagctgattggtctgtctttactataggcagaagtttagcaacaggtatttttaccttaaagtagctgtagatttgttctgtacagtacttaagaaacaatactgatattgtccccttcaacactcacccacccacacatacacccacatcctgattcattgatggttgtggaataggagctggacatcagtatttttaaaagttatcaaggcgacgctaatgtgcaactaggtttgagaactagagctttgagcacttctgttagatagaggaacaattctgtttacaaaaaattctttgacattcctgtggaaggtcccatgtactctgtattattttcaaagtattagtataatggtttgtggagcttttgtgggaggtgatatctttccagttaggcaactgagcccctgccttgttatgcccatgaccttatttaggtatcttcttacattggctttttttgttgtttttttttttggttttaattttaaacattcttttcaaagatgtggaagggtaaagaaagcaacatcttcctattcgcctaccactgaggataaacatgaaattttgccatatttgcctcagctccttttattttaaaaaaagatatttgtaacttcagcttttcacctcctgcaggtaaccattctgctgtagttgctgttcttaaacacattgtttttgtgcttttactacatatgtgtatacccacaacaacaaacagtatacaatccttcctctgtatctgaggggtacttgttccaggacctccttaagaccataacccacagatactcaagtccctgatgtaaaatggcatcgtatttgcgtataacctatgtacgtcttcccatgtacttcagataatctctaggttacttataatacctaatgttaggtaaatacttgttatactatattgtttagggaataatggcaagtaaaaaagtctgtacacattcagtacagatgcaaccatccatttaaaaaaatatattttcaatccacggttggttgaatccacagatgcagaactcacagacatggagggctgactctgtgttttaaagtatctcagctggtgtccttgttcatgttactatgtctaactctagtttattcatttaagaattgatttatctgttctctatgcagatctagttccaaaatacactttgtgcatttcccagctgtgagacattgggtacgtcttcactttcaagagtctgtcattgaaaaacaggggttaaaaacctgtatcagagggttgttttgaggattaaatgtgatgatatgtgtaaaatgtttagcacagggcttgggagacaaacacacattacaaacatttactattagcaagatatgtagtgctgcggttactttgccattaaataaaataatgtgtgaaaatataatacctggtttggtaactgctgggtttcttttctctttgccctaataatctctcgggtatattaattgctgttctgcaacttttgccatcagaggcatcagagggctgttaaaggatttctggcttgcccattggtacaggatgaattaacagaggctggggagagagataaggagttactgtgtggactacagggtggtaaggcaggatatgaggggcagtgctccttttccagctggttttaaattctcctccttatgattttctcctcctgagggcctactttctgagaagtacttgccatatcctttatgtgcattatcttttgtttaaaaacttcctgaattatacatcttcatctgtaactgtatcttcatctgtaactagcattccctgttagatctgcctaattccaaaacccatgagcttcccacgccagcaaacaagccaaccaaatgaggaaaaaaaaaaacacctacataaactaattttaattaaagtgaccagaaaaagtgggaatataagcagttaaatgccattgtttagctattagatgtattataccgtcaaagtatttatccatatttaaaggagacagatcttagaaagtattgtcttagtcttatttcatagacacctttcctgaatgtatgcccagaaaagtttttctagaacagaagggataagaaaggaagggaagaatttgagagagaatacttgataatataattaattggtagatgttttctgcttttaatgtagacatttattctaaggtcatggtcagagaacacatgactggacgggaaattccaggcctggggacagtgctttcctcagccttgctggtgtcctttcattttgcacactcttgatacataaaattatagaaagtacatagcattttgatcttgggaatccataattgttcccttgaattagaaggaagagaatgtgtgtccatctgcatctccctctcgtttctgctaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagaggtgagtgcatagggtctaagagaagataccaacaatagtagaggattcctgttactgtggacctgtaggtaccaggcaccctgctaaaatcggttatgtttgatttttcccagcaactaggaggaaggttgatcccattttattgattacagtgtagttaaatcacacctgtttttatgtgcctaactcatactaggcactgtgacaagtattgtacacattatctctttgaaggccaacgaccctatgaagtgtttgtgtgtggtgtttattttagggtgtctgttttgtagacaagaaaacgaatgttcatagagataaaacaactcactcaaagtgacaaagtaaatatgtgacagaaccagaatttgaacctaagactggctgactccaaaatcatttttttttaattttaaaatgtttcttttgtagagacttggtctcactattttggccaggctgatttcgaactcctggccttatgtgatcctgcaaaagtgatatgattataggtgtgaaccactgtgcccggccatccaaaatcaattctttttttttttttttttttttaagtatcaatttctcttttaatcttagacgtcgtggtggaaggaaaaatcagttagcaaagaagcaatctcagaaaaagtgtatctttttgatgcctttatgccttttttttcctctttttttttcggttattctttattattatactttaagttttagggtacatgtgcacaacgtgcaggttagttacatatgtatacgtgtgccatgttggtgtgctgcacccattaactcgtcatttaacattaggtatatcttctaatgctatccctcccccctccccccaccccacaacaggccccggtgtgtgatgttccccttcctgtgtccatgtgttctcattgttctattcccacctatgagtgagaacatgtggtgtttggttttttgtccttgtgatagtttgctgagaatgatggtttccagcttcatgcatgtccctacaaaggacgtgtgaactcatcattttttatggctgcatattattccatggtgtatatgtgccacattttcttaatccagtctatcattgttggacatttgggttggttccaagtctttgctgttgtgaatagtgccacaataaacatacatgtgcatgtgtctttatagtagcatggtactggtaccaaaacagatatatagaccagtggaacagaacagagccctcagaaataatgccacatatctacaactatctgatctttgacaaacctgagaaaaacaagaaatggggaaaggattccctatttaataaatggtgctgggaaaactggctagccatatggagaaaactgaaactggatcccttccttacaccttatacaaaaattaattcaagatggattaaagacttaaatgttagacctaaaaccataaaaaccctagaagaaaacctaggcagtaccattcaggacataggtatgggcaaggacttcatgtctaaaacaccaaaagcaatggcaacaaaagccaaaattgacaaatgggatctcattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaccccatcaacaactgggcaaaggatgtgaacaaaatcaattcttttaatacccagtattctattggagttcagagaggttaattaccgttccaatgagaaagcagccgaggtgggatttaagtccatatcttctgaccagagctttgctgttctgtacacttttagccccaacttattaatatttggccttgttgacatcttaggctttccctttctcatcccacctgcactcgagtttctcatccttaaatgatatggcaatctctggtcaaagcacttgcaggtggctcccatttccagatgttaggacttctttctgaagtgtggagaatggtgatgtcagcttaatggttcccattagagatggatgtgtgagaaagttcaagtcctttgggaatctcaaggacttgaaaacctctaggtggtctggagaagtagagaatccatctaatgagcatgacctgctgtgattcatttactggctctgagatttcaggtgggctgagtcttctattactcagattgtaaatggagatggggagagcttaggttgctgagagggtgcctaaggattgccatcacggggcaggagagtggtaggaaagaagggcttcagcaatcaaagcaggcttggctttttagctattttatatattgagctgttttgtaagttttaatctacataaaggcttctgtggttgctaagagtttgaaaacagagtttcttaggagtcaggagttttcaagaatctaattctgactctactgtcaacaattgtatgctttggtcaaagcacttcttatttcaggcctcactttcttcatgtataaagtgggagagttgtattaaccagtttgaaaacctgactcgggtatatactgaaacacaaaattggaatatagaactgttctgcgctgcccggtaccctgctttgagttgtataagcattagttgattttaatcctaatggtctgtgcctggtagatagcacaggaaactgatcctaaggaggttttcccaaacaggtgatagagccagaatttaaatccatgtctgctgggctccaaatctcagcttattccatcatgtcatgcagtagtaaaatccctctgtgaagcatggctcttggcgtaggaccaggaatgatggcagtggtcttcttcaatttggcctaaacttgttgctatatcaacaagtttggattggatatatcaccttttttggcaacacagaaagaaaagttatactgagttaagcaaagaggattgggcggagggtcattggttcagtgtcagggccttctagagcacttgccatgtggccagctccagcctatatcccaggagatctaaatgcatatctggcacgaacctctcaggattcttaccatctcgcacttgagataaaactgcactaaataaatcccataggaaatagttaaagtctagattacatggcagtgtttgtgaccctctgagaacatcttatattaatttattttaaaaaatcaattttctttcagaattttctgagtaagcctctagtgtggggtgtgttttggtaagcatgtacaggaattcttgctgagaattcctttggctttaacatgattgcaaaatcaaaattaaagagatttctaaagtcagttttagcatcttcttaaagcctgaccaggagggctatagtgcttctcagacttcaatgtgtaaatgaatcacctggagatcttaggttctgattcagtagctttgggatagggactgaaaatttgagattttgtatttctaactcaagttcacgggtgatgctaatattagtggcctgggaacttgtgaaaccacttttaattccaaaagctctgctcccctaccctgaaaagcatccacttttggggaatcagggaatggtacctttgtttttaatgctatgatgggagacacaggaaagtttgatagcttcagtagagctgctcaagtgcccgttcagtataaaagcatgagattctgtgttctaagttcatcaagctgtcatgtgtttactccttcttcattctttaattcttggaagtctgtactgagctcaactatgaaccagcaactgtgataggcactggggaactggggacaataaggactcaaccttaccattgagcagcacacagtccactagggatagtggtaggggagcataaggaatggggtggatgcaggagtgacatgaaaacagagccatcaaatgtactatgcactgtgatatagcaatatacaaagtgctttgggaaaaaggatttgcttcccagaggcaatagtttgacaggagcctcaagatatgagtagaggttttgcctagcagagaagataggaaagacattctgaagagagactgtggttcatctgtgttatggtaggtgagtcccagggcatgagctggggtgcttcagcaagcatagcaggagatgaggccaggtaaatagtctgagttcggcttattaagggcttatttggtgatagggattggttgatggttgttaagcaagggaggggctggcttaggtaactggcagacatgtggagattggattagggtgagaaaatgtgtgtgggggagtaagaactagagttttctcattcccctgatgatagcactctgatggctttgcattgctctgttagataaattccagaaactgaaacatggactagaaaatggtgcatgatgtcatttttacctcttcctctctcgtcactgtttgtcttttacatcctagctcactatatcccatctacaggaatccacttagagttttttgttacatgagtcttggctagaggttggcagactatggcacccaggccaaatctggcctactgcctgttattggatggcttgagaaaatgtaaatggttttacattttcaagtggttaagaaagaatcaaaaggatgatattttgtgacttatgaaaataatatgaaattaaaattttagtggccgtaagtaaagtttgattggaacacagccacactcatccatttatgtgttgtttatgtctgttttcacactacagtgacagctgagtagttgagacagagactatgtcgcctacagggcagaatatatatgtaccatctggaccaacagatgaaaagtttgccgacccctggtcttgacaatgctgagtctttcacctacagtgttcttccctctactcactgctggttcttcctcatcatttaggtttcagttttatttttgctctcttgaaaagcctttcctgatcctcaaatacatcagagtctcttgttattacactcttaattttacttcattatatctttcgtaaattgtaatgctacgtcaatttttgtggtgatttatataatgcttgctccaaccattgtaatctgcaggaggatagagatcatatccacctcgttctttgctatgtcttggtccttaaccaaatggctggtgcacagtaggtgctcagtacatattttctgaataatttgaatgactcaataactcaataaggggctgttacagtactccatgggagaactaatgagacctgaatgaggcactgtgagatggcaggagatgggtcctagaaatttttagaggataatatcaatagaacattgacactgattggctgtgaggagtgagtcagatggaggagccagagctgaccactcacttcgttattgctgtcatttatcttctccttgtccttagcctagagtcagatgtcagaggaagttgggcagaatttggggttttatctgtcttgagatgttctaggaccaccatagctcttgaacaaagtcacctggatcctagtcctgcaaatatggaatttaatcatgtccttttcatttaaagtttatgtgtttcaggttgacatttgtctccttaataagaattgtcagatgaaaggaaaaatgccatttgaatttttcataacccccagcagtctggcttttccatttggtctcaatgattctgactctcatcttaatgaaggccaaatgtaaattaagttctgtcaggcttgagcagctggggtctcctatctttataaacatgaaacattgtagggttaacaaggtgcagactgaggaaggtcaagagagttgctgagctgatgtggatcctgacagctcaatgttaatgggaggtaattaacgtggcttgtaggggctacatggagatcttccaagctgtcttttaactcatttcctcttttgccattgtcagcagagcagaaagctaatcattttatagtttgagatttttcttgcttattccaaagttctggaaccaactgtctggaatgtcacaggattttgttgatggattcaggaaatatacctgctgcttctctctcccctgtctgtgcccctgtgcttctgtcctcctgataacatactgggaaaatgaggaaatgattctccaattggtagattctttggggggaacctgggggtttggatggctagagaggtggtttgataacttcctgctagctgtggaagctgtcacttgagtgctttgcagtaggaactgctgaaaagaaaaccctgctgcaggtcagggaagcttggttcttctagttctttctgtaacttgagaggctggacgaagctaatttttaaaaccttatttggccttattttgtcactcttgttgatgacataataacaccttttctctatcttaaaccttagtctaatcttgaaacttcatgaaagatagacaatataagtttctttccttgaaatgccatcatttaaatagatggcagtatggtggaaactagtctttcttagttagttactgtctaattactattcaactgtgttcatcaggtcttaatagtagcactaatacaagatattgaggaactttgggagatataacacaaatctatacagaaaagtacaggatttggagccaaacttgcatttaaatttttctgtaccacttaccaattgtgggatcttggacaagctaaaatcaacttctctgagtctcagtgtgctgagctataaaatgaggacaatagtatcagtcttgtagagttatgagttagtgaggtatttgtaaagtggcttatatagtagatactcaaatggtactttattttcattatcattgtgtttaaaagtgcttgtttctactgatgggcatttcagtaacatcctatcactaactgagataattttaaagactaaaatatcctatttcatggggctggccataatgagtgatatgttttttcctgttttattaaggaaaattctagaaaccatcatcaaagtttctagagacaatcatagaaaatagagaatagaagagcacagaacatattttcagtcattcatttatttgaatcacccacatcctatgtgtaataccaattccaaaggcagccaacttcgagctgtaaagctgattaacttacttgagtaccttctacttgtttcccttgacatttaccagtgccgccagtctcagaatgtttttacttcacaagagttattttatttaatctttacagcagtctgtgggacagatattatctctttttatattaccagatgaggaaactgaagctcaaaaaagttaaataacttactcgtggtctcatactatgtaagcaaacccatgtcaagagccacaccattagctctgttccctcatctgctaccttatgggaacctgtgcactttcagtgtgggaatccagaagtggtctctgccaccaagaaattacagtctagttaaagaataaagatacagagcaaccaagcagtaagagcagaacaagaaaatagatgaaaataagagctaaagcgtatgtagtgcttgttaatacatctggtacttttctaagcattttacccatgataattcatttatttctcacagctaccctataattattgtatttttcttttcttttcttttttttgagagggtcttgctctgtcacccaggttggagtacagtagcacagtcttggctcattggaacctttgcctcccaggcttgagcggctctcccaccccagcctcctgagtaactgggactacaggcacacaccaccatgcccagataatttgtgtatttttttgtagagatgaggttttaccatgttgcccaggctggtctcaaactcctgagttcaagtgatccacccacctcggcctcccagagtgctgggattacaggtgtgagccactgtgcccagcctaattattgtcttttacagatgaggaaacaggcacagagactttaagcaacttgcccaaggtcactcagctaataagtggcaaggctgggatttgaactttggcatttcacatccagagtacgggcttatcaccattttgctctactgcctctttcagcgtttgctttgcaggctttgcataaactagtttagggaagaaatttgtgggtgatggcttcgggaggatctgaggctgtgaacaatggtcagtagcttcattgtttcatttaagaaatactgagtgtctcctgtgtgagaggcactttgctgggcgctggagatgccaaggtgaatgagtgggataagggccctggggtaggcttctgggaacttagagtctagtgtagagaggcagaaaatagacacacacaaagtaattttgttttctggaaaatgctacgaaggaaaaacacagatgaacagatttggcatagcgagtgtgggcctctcttgggagtttttgtttgacctgaatgatgagataggaaggaggagcaacagattcactgtgggggaggaaagcacctcatgagatcagcaaaggaggtcagctgggccaggagggtatgagcaaggcacagaggcgtaggagggggtttggcgaagtgggcaaaggctgctgcatgcagccttgaggccaggggcaggagtttgagttttattccaagatcagtgggaaatggttgatgggctttaaacatgggtgtgacacagtatgttttatgaccttaaaaaaatcattctggcatatgtgctaggtagatagtaaatatttgtatagcaacaacaaacttcatactgttttttttttattattatactttaagttttagggtacatgtgcacaacgtgcaggtttgttacatactgtaatgttaaagggaagaaaagttagaagactaatgaacagtcttataaatacatttgtttaaagaaactatcagtatggaaaaaaagactggccatatacacacaagaaaacattaatactggtacactgttcatggttggaagagtttgctactgttttagcacaatgctcatgcttttattacttagtaattttccattcaaagcttgtagtcatagctaacctttctggttgacaacacttcattattgagcaagggattttttttttttctttttgggcttattttcctaaaaagcaacatgctagggacttcacaggcagaattttatctctgccctttagtgacacagtgtaacagcatgctgttttactgtatctgtgtggcagtatgaggaaaccaagactcagaggacttaagtagcatccccaaagctacacaatagtaggttgtagagcccagattctcacctagtccagtctgcctccagctcctgggatctaactattgcctctcactgcctgcttttaaagggcactcatttcttcccacttgccagggctacaggctggcagaccactggctgaatctggtccccaatcaggtttagtttgacctaccatgtgcttggaaaaaaaaaataaacaattttaaattagtttccaatatttaaaaattgagaaattttatctgaaaattcagattatttattttcctgaataaataatgaaagaacttggcaatacagggtccacacttccatgcagaagggaacggctggagctgaataggggctgccttctttagaaggggtcggcattcttcattttgcagcagtcctcacccagcctgctacactcatttcctttttcagccctacccctctgagcacttgaatttgagacttaggctgtgggaatttgttcaaggaatctgtcattacttttcctctagcaagcgcttagagaaatggaaaggcattccagatggcgaatttcttggtccagggctctcatgattccatgcctgtattctctcacacctctgggtctttgctcaggtttttccttctgcctggcaaacttatagtaatttcttccttcaccaggaaaacttataataatagttcaaaacccagccttcactgcctccaggaagccttccttgacttagggtcctacactctgtcccctgtggcattctatgcttatctctaccctagaatttattgcattacattgtgctgtatttatctcagtgtccctagcctccagagcaatgtttaaattctaacattaataacttattatatattttgatgggtggatgaatgagcggatgaacttattaaatcatctcatgccatttttgatggctaggtgcatttgtccaatcatttcattccaaactaaaggttcactgtatgcccaacataagttaattttctcttcctcattgtggaaaatgagatttgagcattactgttcctttccatcctagagccaccccttggctgcagtcctgttaccggagtcacagcttattttgtatgcaaagtgaaggctctagactgagacagtaactcctctgggcctctccactgtgtctttggactcctgtgatggataccactttaagttgctcccttcaccccccaggagaatccaagactcatcttctcaatcagaaagactttctttagaatgtttataccagggccctgtatattggaccagattcctcccagcctttgaggaatgaagacagtattgtcagctgctgttagggcatgtgttgtggattttctctccagggtgggtactggacttgtaactaaatacacagaatgttgaggctgatggcttgccttcatctacctggacagtgaatcctttccttattatcctgtatttgcatatttgatttataccaaatatgtgttgcattcttttagttttatagtccagcaaagtaatttttaaaaggcagacaaaagaaaaaaagttgttggccagataccttgtaacatttaataaatgtcagctattattataatactttaaaaaattttactttatggctatggcagactttcataaatatttcctttatatgatctatgacatgaccttgtgggataaatattactacttctcacattttacagatgaatacaagcctcaaagaaatgaaatgacttctctacaggtatcaaatcttggtgaaggtcctttgggcttaaactggagccaaatgaagtcccttggatcttaatgaaggtccttttggctttaaattctggtatatgtgtgtgtgtgtgttattctgctgtaccatgtttcttcctcatttgggttggtggattttcagctccataaaagcagggaccaaatctatcttttcataccttactgttttatatccccagagccaaacacagtgtttggcattgaaaaaatactcaataaacatttactaaatgaattcatgtcccctggccagccaggagctagccatgtgactgtagtgctgaagaccacatgcctggcttacctgttgccagtcttcctgacggctgtgcagggatgttggccacctctaggagtcattagtgtaaccagagaggtacgaggaaggattgtgaagttaggcttgctttatgtacacatggtatgattctgtgtcgatcaaaaattgaacaaaattcttttctcatagtggctaaaatggaagtcacacttactggaggaaaatacgatctttatagaaacaacactgaaaaggacaatgcatttaatgtgtgttgtgatacagtaactcatagcgtgtaaactgtcaacttggaaatctagaggctcagggtcaatggatgtccactgatgcaaggaaggtggcaggctagaagtccaaaaaggtgcaaaatggtattcttttggaggagtaagtaaatctcatttctctgaacacctgggctgttttactttcttttttcctattatccaaagtgaccataattgttctgttattgtagggatatattcatttaatcagtgaaagaaacttttgtctggtaactactaggtacaaagtactgtgcttggtgatggggaggaaaggaggaagccaagctcaccctttatctcaaggaattcccatatctagtaccaagagcgagaggctgtgaaagccattacccgccctgccacccccccgccatgttttattatcaaaatttcaaacatataaaaaagttgaaaaacttttacagtgaatactcagagccatcacctagagcctgccatggacatttactgtccttgctttatgacttatgttgtttccatctgtctgttcctctactcagcttacatttttggaataagttgggagattgttacacttgggaaggcagtttgaaatattaaaagttgtttacatttctgaaatattaaataagttttagttaagatattgactttgttttattgctatctacatacatggccaacacctgtactagactttattaaatatccactgtgtgctttcaaatcttctatcccatttattcttatgaaaatcctgtgaggtagatgttatcacttgctttgcagatgaagaaattgaggatggagggagttaagtagattgccacttatcaactttattacctctggcaacgttggaatgcaaacccaggtttctgactctaagaaatgaatttgaaaaattattgtaaaggttagctggtcaaacaccagcctttatcacacaggtacccctgtctacagataagacatcattggagcttacctaagtaaagcaaagcaagcaattagaaaatgagagctctcttattttgctgattaattattcattattttcttaataatgactttatttttctatcatttttagtattattacttcactttgattagagaaagcaacttctgatggtttaagttaaaaatcccagataacacatttgtttggcataaatttttaaggtaaatatgaactctagaataaaacgttatcaaagttattaaaagtttagctgttcaaagttagactcaaaatgaaagaatcatacttgagactgggtgagatctgtttcccaccactatgcaaactctgacccagggcctcttttgtttgtattccagcacattatagttacctctccaagagctgactttgtcctcttctttgcattcccctgaggtatttgtagtgagaaagaatgactaaatgatggaatgagttcattacctcttctgaacccaggggtcttggaagtgctgacacagctaagacctccctggaggcttgtctgttcatccagaatggccactctggattcctataaaggctcctgtctctctgaatcctccctgtatggagaggctatggattagataaacttcagagtgtttagtaataaaaacaagcttgatctcaactctgtggccctgtcaatacccatacctgcaccctcttgaaaagctacatcagtgtagcttctaggcttgtaatctgaatgatcagtgtcttttggctcaaaaatgcaaagtgaaggaatattcagaggaaattagagagctgcctaagtggctctatcctacctggcctccgtttctcattatggctttgctaaagggtctgaaccgtggcatggacgtacattttttctcagtaacgccacatgtgtagagtattgatgcttacccaagcaaagcaaaacaagcaattaggaaatacagtctctctctcattttaccgattaattattcataattttattgataataagaactttatttttctatcattgttattattattattattattattattatttcaccactgattagtgaaaattattggtcctggactatcaccagtccctgttctggcatttgggaacaactggtgcgtgtaagccctgaaactctccttcgtgctggcattctgtgaacctgagagagatgagaagagaaccagggactagagtgaagcctactgcagttgtcttggcatgaggctgtgtggcttggctttggctgggagtcacagacaagcccacggacctgagaaagagagtgaatcactgtacaagtatttatcgagcacctcccatgtcctgggaagcagtagctggagagtggtgaaggagtactgagttttggggttcaagtggccagggctttcccccaggctttttacctattatctgcattatctgggcaattcagttcacttatgggccttagttttctgtctaaaaaattgtgttgatatactattatgtatcagaaggtatttgataaattgcagaatgctggtggtattgatagattttcagatgatagtgacagaaaaagttgattgttggaaagaaaattagtgaggtctatttttcatatacttacctttagaggcaggtaagaaatctaagagtgaagggaaatggaattcacattgtttgaagggtaggaaattttaaaaatagtgctttttaatcgtccggaagacttggggagagggtattattcctgtttgagtgggtgggaacagtctgagagacacttacctcatgcagctactgagtgggtagagctggggcccagctcagatctaactccagcctgtgctgtttctacagcagctcagaaaccaaagttcaggggagcagaggagctggagacagtgaatccatcctgaggcccccctgagtaaatgcttccagggcaattccacttgcactattattaataccttacagggtgtccttcacaaatttctcagaatgatggctgtaaaaatgggtgtgtgttttagaaataaaaatattgtggtgctaacaagttcctgccggagttgttcaaggacgttcattcattcagcaaatatttattgaaaatttgttttgttccagacactttgttaaatattgggaatatagcagtaaggaaaacagagtcactattcccaggatgctcatattctagaaaggagataagagataaagtcacagtacagcattagtgcagtgggaacttgggttactctagaaatacagcccagttaggatcgaggggctcggggaggtaatatgtaggttgtgggccagtggatgaattggaattgggtaataagcagttgaggtgaggcagtttgtaaaagctagtctggtggcagtctgaggaaatgagacctccgtggggctgcaaatgcagtatagtgagagcttagactgcaagaagctctgtgaatccgtcaaaagttcctttaagtcccttttatatattccatgctattaattacaggattctttgcaggggtgaagggggacctcatgggatggagccagttcaccctagccacaatcagagaaaggtcagaagctatttgtgacatttttcccgactcttctatctcaaagacctggacctgagaactccggagaagatgagctttgagcactcacgtcctcactgggcagacagagcagctctcctcatttcagttgtctcaagactagacagtgtgcctgagaataaagcagtgaattaaccccacttgtccaagagggtgggactgaatactagacagggccctttccgcctctcttgggtggtggggggtggcgtgtgactcagaggcagtgacatcagccatgacttcattcatccacaggaaagacagtgtgcagaccgcgaacacggctgatttctgccctcccttctcgatgctttgtcttgctggggacattgtcatggtcctgctgttatttcccacacattttattcacgtctcatgtttaagctgttctttttcttcaccccattctttttggtctctttgttcatcttttgcttttgtctttattttcttctttctcctatttaatttttcttgtttcattttctttcctgtacttcttctcttttgtctccattttccattctttccatttgctctgtcctttctcttccctctgtgtcagaaatgtatacaggaacacatcctcctgcctcctatttcttctctcctctgggcttcccactaggttattgctgtcctaacattcctaaaactgtgttcacaaaacactctccacacaaggactgatggtggctcccattcttttctgactcaagtatctaatacaagtccagatttacctcttactgcatctcaacacaggtctctcagactgagcttctcatagttccttctccatggccatggatgctgctgatgcttctgcctgcacttttactcaggccattgcctcagtgtggactgacctccatcccatcttcctcagtctttgccttccctctagacacatatctgacattgcctcctaagtaacccccttacttacctccttcccacagcactgtctccttcatgatcatacagaatccatagtttataaattatgtattttagaacttgaattattctgtactatttatacattcttcctgcatgtttcatatgcatagattctttgttccacctagccagtaactaacctgaggataggaagtatattcctgcctttcatcttctatgagcatacctagcacatagttggccacaaaccaggactgacagaccatttttttgcaaagtcaagaaatattttacttgaaaaatagttatttgatgctaattctggggagatagatgaatgaattatagttctttcctaaaaaaagagctaagggtctagtagaagagacagacccacacgtaatttgagaagaacaaggattgtggaggaaactaatgtttactaggagtgtacaagaatgggcacatgaacatgtataatctcactgaattgaattcggctaacaatcctatgagttaaatgttgctaccaatgaacaaagtgagactcatagacattaggtgactactagtcagaaataacaccactaataagtaggagaaccaacatttggactaaggtttgtccgactctaaagcccctactctttcctgaagagggaaggatgtagtgaaagtgacattctaagtaataataagaacaatcgtaggtaaaaagtgcttactatgtgccaggtgctgtaaacagattacctatatttgttcatttgatcccccatcaaccctatggcataggcactattattgtcctcagtaatttttataggatgaggaaattgagatgaagagtagttgagtagattgctcaaggccacatagctacagagtactagagccaggatattcactcttgcattctggctctggagaagaggcagcagaatgtagtgaggccctctacatagagtagcatattgcatgatcagaactgctgttggaccagtctgtttggagaatcagggactgtggagatgctgacaggtgaaggtgttgagaggtgaggctaaagaggcagccaggaatcatcacaaaggaccagtgccctcctcaaggacccgtgacaaaacatgcaattttcctagaaatattttctgtgaggttggaccgttagggatccatcataaggaagagtttaagttgtggtcttattctactacttgagttgtgaaggaacttttgagttgtggcctttgtccatgcccagcgggaaatcacagtggaactctgcaacagtggtgtaaatgaacaagtaaggatgcacatacccaaatagactccaaagaaatgccagttgaaacagtaaagtacgcctgtcctttacgggttggagatgattaagtttgggttgaaggacatttgggaagaaagaagaagggacatctgtgtgagccagcttggaacagatgccaggttatcctcaggtgtcccagagcgctcaacatttgatggagcactctccccactgcagcccccctctccattggtacttggcagcaattcagtggtgctgcactgacctgggagtccaagccaggaagtgaatgaatccattttccaattaaaatgaaacttctccaaaggacctgctaaccctgagagaagaaatttatcttcctggcagtctggcttgcctagaatatgtctctgctcctgaaacagactgagaaaagccattagcttgaatgaaaaaagagaaactgggacagttcttattcacaacctcattcatttatccattcattccttttatttctgcagactttaatttggcttccacatgtctgctcattcattcatttattcattcattagctaacatgactcatcatctatagatcagacaaactgctgtgtcctaggagtagagatatttaataaaaaacatagctcttgcctttgaggagctttcagtctagtgagagagacagacaaatgaacagatgatgggaaatgcagtgatagggatattcatagagtactataggggcatagcataagagcatctgactcagcatagggatgtcatgggtgatttcatggagtaggaaacaccagagttgagtcctaaatgtgtacacacatagacatatacatgctattgcttctgtttctctgaagaactctaatacagggtgatgaggtgggcacctcttcatgaattaattgggagttgaaattagaatggtggttgaatgtaaggaatgagagaagaggtagaagatgactcctttggtagaggtagaagatgactcctttggtaactggatcaactggcactggaaatcaaggaggaggaacacacttgggggaagatagcagattctgtcttggacgtgttgagttggaggtacagtgggacatccaggagacatgtctcagaggagagtttgaattggagtttcagatttggcacgttattcagcgtgtagttggttggaatcacaggagtgattgatatttctcagagagcatgggaacagtgaaaagaacatttggatgaggtaagatccctggggagcagctaaagaaaagagcagctaaagaaaaggagcccatgaaggagacagaaaagcactgatgagaagggcgtgagaaggtcccggagagtgagaggttgaggaagacttcctcatttctcccctggtcccagtctttgactttctttcatgtctgctccaagacctgttcaccctttccaaagccttctcttcctattaggactgtctccctctctcccatagatggtaccacccacaaggcatggcttgatccaggtcactgtggcatctctctcatctcctccagtaagaaatgcacttctgcattatattatgttttagagaggcagatgactgaactcaaacattgggctgggcattagcgatgcaaaatttggtctgactttccatttacccgttgtgtgggacctggggatagtcttggtcccttcctgggctttaggttcataatctgcaagcatagttttctgactccttgccttgcctgccttgaagaattatacaggtcagatgagatcatgcatgtcaaagtgctttgaaaactgtgaaactctgtagcagaagagtgaatcttgttgacttatcaggcactttatattatttcatttaattctcacagcatccttgggggaagatgctaggaatgtggctttgaggaaactggggcttaaagaaattaatttacctaaagctacacagctgttaagtggtgaggacggcaatcaaaatcaggtatgccagactccagagttcttagaccccatctacttcagccttgttttcctaatacgtacagtggtgtcacactcctgggtaaagtcagctttgctgagtatgatgagttttcattaaaatgatagcatattttatggttgggaaatcaactctagtgtggattataagtttttcttttcgtacaagaagagcaaagcccttcagggggaggaaagtaggggaaagggatgcatataaatccagtttttgaaaattaaataaactatacagtggaattatttcattttacaaataaattctatgatgttaccgttaaacaagtcctcatctaatgggggtaatgcgtcttgtctattcaggtttttgtttcttgggtctttctcggcagtgacataaatatttattccacttgatgtttaggcctctgcttgcatctctccccggaagcctttagaaaagcctttagaaaagcctccccaggtcccaaaccctttccccgctctgagccctgtctgtgattactcattagaggcagatatatggccacacacaaaatattacaataatgttatgaggctgactcatcaaaccttggtatcaggcttattacgttattgtcatatatcatcttattaattatctcttcctttgtgtacatctttctctcgaaaggacctggctttagattttcttatatctcccaaaactctgcattttttttttcatgagttagacttggctcttgcccttcagaagtttgtcatttcaaggtagatttaggtatatcaatgaataattagggtacagcatgggatggagaggttcacagaaaaggtgacatctgagctggatttgaatcaagggcagaggtttgataaagggagaagatgggaaagtcaattcaagtagagataccagctgtaacagaggactggaaatatgaaagtgtaatgcatttgggaaagtaaaagaggtgagaaccaaatggagggtgttaggagatgagcccagaaagtcatcatcataatgatcacagccaagttggagccaggttaagagtcctgagagccagactacagagttaaaatgggattctaggccatgaggagatgtcgcaccatctttaataaaggaatggaatgggaagctttatgtttttagaaagatgcctctagtagtgcagacctctcagcttatctgcctatctgacttgaaatatttctgatgttctgtctctgtgcatgggagtttgaaacacacaattattttattcattctgagaagtttctggctgaggtttatgacctactccatgcttccagcgtcatatttcttttaagaatgacattgaagattacgtctcttcctgaaactcttttctctctgggctattggcctgtgccctaatttggagtcttgaacatagagtgaggataaggtctagctctttcttgggtagttgtgctggaaaacaacagcatgagtacttggaatgtacaggcagtactatttattgagtggggaattagggagctgttccctcccttttgtttactgctcacagcagataacccagatagaatccctttgcaattacacagtagattacttggataatcctttgtaactggtcatgcctatcttctcatgttgcccctcgaccctggtgtcactgcagtagctgcctcatttccctcacgagttccctaggtgtctagaagcagcagaaacctcacagcttccctggagtgggagggaaagggtgaaagctacttctctctgtcctgaggctggcagggcggctgcagccttgaatcttggacatactgccctacctccgccctctgcttagacccacagctgtgtgagctttgagtagtagcctcctcccaacaaatgctgtggtttgatgaagtaataattttttcttttttttaaaaaaagctgttctctttggttgctttaagctgagggattgcttaactcaaaggattgttgttggaatgcagaaggcttttgtgccaagtcatataacccaaatcacttttctttttttcttgaaaagactagtttttgttagttgcctggtaactggaggatagaaagacttaactcattcagcacagagagctcctagtttgaactctattaggccatcacctaatgagatacatctgaaattggtgtgtgtcgagggcctgctccttgcactctctaatccgtgcaacattgtgcatgggagatgataagtacataggagttacatgagctgtccaggattgaaattgtacggaaatgtgcttagaagggcttttgtttgtcttttcttctgtaaagagtggcaatagcttccattatgacatttccaaaaggcccaaaatcacacctctgattggactgggaggttcagggtggtaactgtggcatagtggaaggaaagaacatttactttagagctggaagccctgtgactttgggctaagcccttgtggtctgacccccagttccttaatgtgtgagtattgtgtattacctacacgcctctgcatcactctgtagattaaatgagaacactgttgtaaactgtggaggacttagaggacgatcactgtgtcctaatgcaggcccagtggttacaagtagagaattaattcagtaagattgaggcctttggctgggattgtatgggccagagaggaggagggacagagagatttttctgcagaactagactaaaaatccatctatgggggtaatgtgctgttggccaatatggcatttgatgacaaagcacttgtgaatcaggtagcctaatataaaaaactgcatgtggctgggcatggtggctcacgcctgtaataccagcactttgggaggccgaagtgggtggatcacaaggtcaggagttcacgaccagcctggccaacatagtgaagccctgtctcggggaggagccaagatggctgaacaggaacagctccggtctacagctcccagtgtgagcaacgcagaagacgggtgatttctgcatttccatctgaggtactaggttcatctcactagggagtgccagacagtgggcgcaggtcagtgggtgcagcgcactgtgcgcaagccgaagcagggcgaggcattgcctcactcggaaagcgcaaggggtcagggagttccctttcctagtcaaagaaaggggtgacagacggcacctggaaaatcgggtcactcccacccgatactgcgcttttccgacgggcttaaaaaacggcgcaccaggagattatatcctgcacatggctcggagggtcgtacgcccacggagtctcgctgattgctagcacagcagtctgagatcaaactgcaaggcggcagcgaggctgggggaggagcgcccgccattgcccaggcttgcttaggtaaacagagcagcctggaagctcaactgggtggagcccaccacagctcaaggaggcctgcctgcctctgtaggctccacctctgggggcagggcacagacaaacaaaaagacagcagtaacctctgcagacttaaatgtccctctctgacagctttgaagagagcagtggttctcccagcacgcagctggagatctgagaaggggcagactgcctcctcaagtgggtccctgacccctgacccccgagcagcctaactgggaggcaccccccagtaggggcagactgacacctcacacggccggatactcctctgagacaaaactcccagaagaatgatcagacagcagcattcacggttcacgaaaaacgactgttctgcagacaccgctgctgatacccaggcaaacagggtctggagtggacgtctagcaaactccaacagacctgcagctgagggtcctgtctgttagaaggaaaactaacaaacagaaaggacatccacaccaaaaacccatctgtatatcaccatcatcaaagaccaaaagtagataaaaccacaaagatggggaaaaaacagagcagaaaaactggaaactctaaaaagcagagcccctctcctcctccaaaggatcgcagttcctcaccagcaatggaacaaagctggatggagaatgactttgacgagttgagagaagaaggcttcagaagatgaaactactccgagctactggaggaaattcaaaccaaaggcaaagaagttaaaaactttgaaaaaaatctagatgaatgtataactagaataaccaatacagagaagtgcttaaaggagctgatggagctgaaagccaaggctcgagaaccacgtgaagaatgcagaagcctcaggagacgatgcgatcacctggaagaaagcgatggaagatgaaatgaatgaaatgaagcgagaagggaagtttagagaaaaaagaataaaaagaaacaaacaaagcctccaagaaatatgggactatgtggaaagaccaaatctacgtctgattggtgtacctgaaagtgacggggagaatggaaccaaactgaaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcaggttacccacaaagggaagcccatcagactaacagcggatctcttggcagaaactctacaagccagaagagagtgggggccaatattcaacattcttaaagaaaagaattttcaacccagaatttcatatccagccaaattaagcttcataagtgaaggagaaataaaatactttacagacaagcaaatgctgagagattttgtcaccaccaggtcggacctaaaatagctcctgaaggaagcactaaacatggaaaggcacaactggtaccagccactgcaaaatcatggcaaaatgtaaagaccatcgagactaggaagaaactgcatcaactaacgagcaaaatcaccagctaacatcataatgacaggatcaaattcacacataacaatattaactttaaatgtaaatggactaagtgctccaattaaaagacacagactggcaagttggataaagagtcaagacccatcagtgtgttgtattcaggaaacccatctcacatgcagagacacacataggctcaaaataacaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaggaagagctaactctcctaaatatatatgcacccaatacaggaacacccagattcataaagcaagtccttagagaactacaaagagacttagactcccacacattaataatgggagactttaacaccccactgtcaacattagacagatcaacgagacagaaagtcaacaaggatacccaggaattgaactcagctctgcaacaagcagacctaatagacatccacagaactctccaccccaaatcaacagaatatacattttttttcagcaccgcaccacacctattccaaaattgaccacatggttggaagtaaggctctcctcagcaaatgtaaaagaacagaaattataacaaactgtctctcagaccacagtgcaatcaaactagaactcaggattaagaaactcactcaaaactgctcaactacatggaaactgaacaacctgctcctgaatgactactgggtacataacgaaatgaaggcagaaataaagatgttctttgaaaccaatgagaacacagacacaacataccagaatctctgggacacgttcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcgagaaataactaagatcagagcagaactgaaggcgataaatcgagacacaaaaaacccttcaaaaagttaatgaatccaggagctggttttttgaaaggatcaacaaaattgatagaccgttagcaagactaataaagaaaaaaagaagaatcaaatagacgcaattaaaaatgataaagggaatatcaccaccgatcccacagaaatacaaactaccatcagagaatactacaaacacctctacgcaaataaactagaaaatctagaagaaatggataaattacttgacacatacactctcccaagactaaaccaggaagaagttgaatctctgaatagactaataacaggctctgaaattgtggcaataattaatagcttaccaaccaaaaagagtccaggaccagatggattcacagccgaattctaccagaggtacaaggaggagctggtaccattccttctgaaactattccaatcaatagaaaaagagggaatcctccctaactcattttatgaggccagtatcatcctgataccaaagcctggcagagacacaattaaaaaagagaattttagaccaatatccttgatgaacattgatgcaaaaatcctcaataaaatactggcaaactgaatccagcaccacatcaaaaagcttatccaccatgatcaagtggccgtcatccctgggatgtaaggctggtccaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacatatctcaaaataataagagctatctatgacaaacccacagctaatatcacactgaatgggcaaaaactggaagcattccatttgaaaactggcacaagacagggatgccctctctcaccactcccattcaacatagtgttggaagttctggccagggcaattaggcaggagaaggaaagaatgggtattcaattaggaaaagaggaagtcaaattgtccctgtttgcagacgacatgattgtgtatctagaaaaccccattgtctcagcccaaaatccccttaagctgataagcaacttcagcaaagtctcaggatacaaaatcaatgtacaaaaatcacaagcattcttatacaccaataacagacaaacagccaaatcatgagtgaactcccattcacaattgcttcaaagagaataaaatacctaggaatccagcttacaagggacatgaaggacctcttcaaggagaactacaaaccactgctcaaggaaattaaagaggatataaacaaatggaagaacattccatgctcatggataggaagaatcaatatcgtgaaaatggccatactgcccaaggtaatttatagattcagtgccatccccatcaagctaccaatgactttcttcacagaattggaaaaaactactttaaagttcatatggaaccaaaaaagagcccgcatccccaagtcaatcctaagccaaaagaacaaagctggaggcatcacgctacctgacttcaaactatactacaagtctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccaggagaaagctgaaactggatcccttccttacaccctatacaaaaattaattcaagatggattaaagacttaaacgttagacctaaaaccataaaaaccctagaagaaacccaggcaataccattcaggacataggcatgggcaaggacttcatgtctaaaacaccaaaagcaatggcaacaaaagccagaattgacaaatgggatctcattaaactaaagagcttctgcacagcaaaagaaactaccatcagagtgaacaggcaacccacaaaatggcagaaaattttcacaacctactcatctgacaaagggctaatatccagaatctacaatgaactcaaacaaatttacaagaaaaaaacaagcaaccccatcaaaaagtgggtgcaggacatgaacagacacttctcaaaagaagacatttatgcagccagaaaccacatgaaaaaatgctcaccatcactggccatcagagaaatgcaaatcaaaaccacaatgagatatcatctcacaccagttagaatggtgatctttaaaaagtcaggaaacaacaggtgctggagaggatgtggagaaataggaacacttttacactgttgttgggactgtaaactagttgaaccattgtggaagtcagtgtggcgattcctcagggatctagaactagaaataccatttgacccagccatcccattactgggtatatacccaaaggactataaatcatgctgctataaagacacatgcacacgtatgtttattgcggcactgttcacaataggaaagacttggaaccaacccaaatgtccaacaatgatagactggattaagaaaatgtggcacatatacaccatggaatactatgcagccataaaaatgttgagttcacatcatgtcctttgtaggggcatggatgaaattggaaatcatcattctcagtaaactatcgcaagaacaaaaaaccaaacaccgcatattctcactcataggtgggaattgaacaatgggaacacatggtcacaggaaggggaacatcacactctggggactgttgtggggtggggggaggggggaggggggagggatagcattgtgagatatacctaatgctagatgacgagttagtgggtgcagcgcaccagcatgtcacatgtatacacaggtaactaacctgcacattgtgcacatgtaccctaaaacttaaagtataataataataaaaaaaaatccacctagttttcatcaaaaaaaaaaaaaatggcagggtgtggtggcatgcacctgtgttcccagctactcgggaggctgaggcaggagaatctcttgaacccggggtgcagaggttgcagtgagctgagatcgcaccactacactccagcctggcgatagagtgagactccatctcaaaaaagaaaaaaaaaaaaaaaaaagaaacaaacaaaaaaaaactgcatgggatcctcacagatgcctgctggcatctcaaggtaagggatcaggcttctggagacatttcctctcattcagtccttattcctctttgctggcctatctccagacttttcttttgtagagaaagcagggaatattgctatcttcccttctgagaccatgtgcatacttaagagtacctcagacttcccacaacatgttatttctagttgctcatcccacaaatatttgttgaattactagacaaactgctcagcttcatcttccagttcctgttatgtgaggagtacttcagaggttatagagggcttccacatgtgttatctccttagagaggagaggttggactgggatctccagctttgattggtgacggttagtgtggtctcaaaaagaaagaacgcagggactccttgctcctcctattcccagtgtctctttttggcaaaaggcttgagttctttgtgacattctacttgggttctgttgtcccacagtggctggctgtgtggctacaggctaaaagctgtcgttatataatgtctttaatgaccacacacaagatctaaagtagtttttttttttttttttttttgcctgaatttaagaagattgttgtgctttggcttgaagcactggttgttgctgcggtggtttggcggttcatatctggtcactggcctttgatttctggaacctttagaaagaggctgccttttctcctctccctgaccactgattgctgaaaccacaagacatatggaaatagatttcagggactagccaaaagccattctggtagtttgattcacatcgtctcaaaggctaccattttctgactgtggcttgttagatcctatacagagatactactagttcttagctgtgttaggaatatttagtatctttaagttttgcttgatttaacattaacatcttagaatgggcgttcaaagagaagtttagggcaggtccctttctagacacaagctttcacctagatgtttaggaagttaaaacaacaacagtaacagagaatcagcttgatactttgccttttagatctgaactcttttgatattgttttgatagggccagcacttgggatagtaccgtttatctgctgtaaatagatgttggtgtttatatagtagtgttagggaagcactatgtaggaggaactcacagaattctgataaaggccagttgtatataaaatagatataataatacccaggacttttgtgttgctctaaggagataacacatgtggaagccctttataaactgaagcacccctcacataagaggaattggaaggtgaagctgagcagtttgtctagtaattcaacaaatatttattgagttcctactgtgtgttaccctgcggcaggtactgaaatatgcctcttttggaacttctgcattgttgcctttaggttcccagagatactcctatgcttataattccttttatagctttttggagagggagtaatagaaaccaggacatggaaagttatctggatggtaggaaacctttcttgctagttcctctgtcttctttactattctgtttttgaaattctacctcttcaggtgtttgacagaaaatggccacttcatgcttttcaagtttatctcacctccagttccattcataggcagaagtgaaatggttccatttgggtcctgattctaagttcttgggagaagaaatctggttggtacaactaggtcacatgcctaaacctggtccaaccaagtgcttgtagtaaggggatgagagttaagtagtttctgcttggcagctgagggtcctctcagttggggtggagaagaggagacaatcatccaatgtcatggtgaacatgactgacaagatccttgacctcacagagcttatagtcagtctgtcaggaaagaaagacttttgtattagtctggtcttacactgctaataaaaacatacccgagactgggtaatttataaaggaaagagatttaattgactcacagttcagcatggctggggaggcctcaggaaacttacaatcatggtggaaggagaagcaaacacatccttctgtatttggtggcaggagagagaagtgcagagtgaaagcaggggaagccccttataaaaccatgagatcttgtgagaactcactcgctatcatgagaacagcatggaggtaaccactcccatgattcaattacctcctacagggtacctcctatgacacttggggattatgggaactacgattcaagatgagatttgagtgaagacacagccaaaccatatcaacattacacaaatgattgtgggggtggtatgggttgtatgacaactagacctaaactaacaatatgacttaccggctttgatttccaggagatcctggaaaccccctcaaggaatggtggtgtgtagggttaaccaaatgaggaaggggatgatgttgatcctgggagggcacagggtggtgggtgaggaatgaatgttttaggcagaagtggcaaagtaaagaaaatgcccagcagtaagaaaaagcctggccattttgcaatacagagaaccaaatctttaaaatgtacaatggcttgcttatgtggccattctctttgacttagactggaagttctttgagggcagggactatcatcttttttctattgcctttgtaaccagttggcatgtggagaattttatatggcaggggacatttagtttcattgggcagtttctgagtacagcttctttccagcttatatctgctctgaaatcttatatgtccatcaccattcactgggaaaatggattgcataccttacagactgtgcttttgatatggtttggctgtgtccccacccaaatttcatcttcaattgtagctcccataattctctcatgttgtgggagggacctggtgggagataattgaatcatgagggcagttttccccatgctgttctcgtggtagtgagtaagtctcacaagatctgatggttttataagaggttttccctttctctgggctctcatttctctctgtggtctgctgccacgattgtgaggcctccccagccacgcgaaactgtgagtccattaaacctatttttctttaaaattacccagtctcgggtatgtctttatcagcagtgtgaaaatggactaacacagctttctatccttccaggttggcaaagagggttttaagggaaattacgatcatttttggaaggatcaagcattgtcagtttttctttcctgtataagtactgcttttatattattcctacccccaccaagctcctgaacagatgtttcaatgggcattgttggctatgcttttgttttgaaaaatttgaaacattattgaaagaggagatggtagaaaaaccccctaattgattctaatatatatttaatttggcagaacttgagagagatttgctgggataaggcgggacatttctttgatctcccggacttcttatcgtggaaggcaacaggtgtcacagcacggtatgttaattacaagttggattgtgtttgcgttcttccattcttggatgtctgtctatatattgctttcttaactctctttgactggatatacttttggtacatctgcatgtgattttgcatacatgaaacatcttgaatctatcttcgacctccactgcacatgcccaaacactgttgttcctaagagccctggaatgtgagtatccaaggtgaagaccattcattaaaattggtcatatttgaaggagatatgaaaaatccagagtgaaatgtggatttttccaaaggcactttttacatgatgaataaaaggaaaaaataaacacacacacacacacacacacacacacacagagtcacgcattccttaaggacagggatacattcagagaatgtgttgttaggcaatttcattattgttgcaaacatcatagagtatactttcacaaatctagatagtgtattctactacatacctaggctgtatggtatagcctattgctgcttggctacaaacctgtagagcatgttactgtactgaatactgtaggccattgtgcacagtggtacttatttgtatatctaaacatagaaaagatatcataaaaatacaatgtaaaagataaaaagtagtatactcatatagggcacttacaatgaatgaaacttgcaggactagaagtttctctgggtgagtcagtgagtgagtggtgattgaatgcagaggcctaggatattactgtacacttctatagactttataaacactgtacctgtaagctacactaaatttattttaaaaatttgtttaataattatcctttgcttactgtaacattttttacttcataaacttttaaactttttgacttttttgtaataacacttatcttaaaacacaaacacattatacagctgtacaaaaatattttctttgtattcttattcaatatgcttttttctttttttttcattatactttaagttctagggtacatgtgcacaacctgcaggtttgttaattatgtatacatgtgccatgttggtgtgctgcacccattaactcgtcatttacatgaggtatatctcctaatgctatcccccgcctccccaccccacaacaggccccagtgtgtgatgttccccttcctgtgtccatgtgttctcattgttcaattcccacctatgagtgagaacatgcagtgtctggttttttgtccttgcgatagattgctgagaatgatggtttccagcttcatccgtgtccctccaaaggacatgaactcatcctttcttatggctgcatagtattccatggtgtatatgtgccacattttcttaatccagtctatcattcatggacatttgggttgattccaagtctttgctattgtgaatagtgccacaataaacatacatgtgcatgtgtctttatagcagcatgatttataatcctttgggtatatacccagtaatggaatggctgggtcaaatggtatttctagttctagatccctgaggaatcgccacactgacttccacaatggttgaactagtttacagtcccaccaacagtgtaaaagtgttcccatttctccacatcctctccggcacctgttgtttcctgactttttaaagatcgccatcctaactggtgtgagatgatatctcattgtggttttgatttgcatttctctgatggccagtgatgatgagcattttttcatgtgtcttctggctgcataaatgtcttcttttgagaagtgtctgttcatatcctttgccccctttttgatggggttgtgtttttcttgtaaatttgtttgagttctttgtagattctggatattagtcctttgtcagatgagtagattgcaaaaattttctcccattctgtaagttgcctgttcactctgatggtagtttcttttgctgtccagaagctctttagtttaatgagatcccatttgtcaattttggcttttgttgccattgcttttggtgttttagacatgaagtccttgcccatgcctatgtcctgaatggtattgcctggctttcttctagggtttttatggttttagttctaacatgtaagtctttaatccatcttgaattaatttttgtatagggtgtaaggaaggaatccagtttcagctttctccatatggctagccagttttcccagcaccatttattaaatagggaatcctttccccatttcttgtttttctcaggtttgtcaaagatcagatggttgtagatatgtggcattatttctgagggctctgttcttttccattggtctatatctctgttttggtaccagtaccatgctgttttggttactgtagccttgtaatatagtttgaagtcaggtaacgtgatgcctccagctttgttcttttggcttaggattgtcttggcaatgtgggctcgttttcggttccatgtgaactttaaagtagtttttttccaattctgtgaagaaagtcattggtagcttgatggggatggcattgaatctataaattaccttgggcggtatggccattttcacaatattgattcaataagcttttttctattaacttttttttcactttttaaacttttctgttaaaagctgagatacaaacatacacattatccaaggcctacacagggtcaggatcatcaagatgtcactaggtgataggaatttttcagctccattaatatcttatgggaccactgtcatatatgcagtctgttattgactggaatgtcattgtgtgatgtataactcgtgtgtgtgtgtgtgtgtgtgtgtgtgtgtgtgtgtgtgtgtatattttggcctctaatattaactaggagatacatttttcaaggaagctgattcagctggatggatgtgttatgtacttgtttgctttttatgtaaatgtacctcagttatcccatactgtagaagtatatatgttgaagtcaacaactatttttcagtaagttatgaatgttaaaaatagagcatatgctacacaatagagacttgtataaaatactcattgagtgtgaaattgtggctactataattaacagagtgagtgtatgtgtggggttacatagacaggttggacatgaaatctttaagtatgacgagcctcttgtcatgatgacctcagatttaaggagatgcctaaggtcaaggcaggtcttctcatcttgaaaaagatttagaatctgggttgaacaaacctgtgaagaagggaatcatttcccagaggatagataaacctctagtaattagggaggcaggtattgtatcttaaaatcagcttattcagagaggggtcagatcttaccctctttccttcttgtttgaattcaagggaagcgggaaatagcagtaccatttctcctatctcattcttttttgtagtgagttgatagggtgtgataattcagcagcgggggcttccagcagggagacagcagagaacatttcagaagcatgtcattcttaatgtcagcaaccccgaacctccttgcggtgaaacaatcattagccaaaggtcctggggcagagagatgcatatgcttgtgaaaatggcctctgcaaacctcaggtacatgccatctctggcaggaggtccctggaggagtgttctcaactttaccctggaaggtgtaattagtcaccattatggttatcatcagtggggagggcagtgtgtaggtgaggatatcatcttgggcattcctcttttggtgtgatgttaattgttcaaagttatttctgagagaatctttctctaggttttttcatcattgtacatccgtgaaagaaatgttttgatcattttggccaaatggtcttgtttgttagtcaagcagtgctagttgtcatgtgtatgggcaataccccattggcctgcaaatccagaggactcaaagctggaacaagagatggaggagaacgtggctttccttctctttttctttgacattttactcagcactttgactgcctccctgattctttctgatggctctgggtattctgtgtcccatttcctggtttccggtgccatattcaggcaccaaggagagggctttttgaagttagctgtggctcagataaagtgtggtggcatgcatacacacggtggactaacaatatgacttaccggctttgattttgccacactagttgtgtgaccttgggcaagtctcttcccttctttgattgtcactctttttgtctatagcatggagattgttatacctattttgcaaagttcttgtgagaatcctattaaagcaatttttccaaattagttggagtataggaattacctgaatgatttgttcaaaacatgtatccccaggtcttctagttttcagcctaatgaatcagaatctccatgggagatgtgggaatttgtatgttaacaagtgcctaggtagtatatgatcaggtaactttggacaacactgcctaacagaatatacatgaaggtaggatgtgacactgagtgagagattggaagtgttttaaaggcctaatgaattttttgaatttaaaagttgtaaacaaaaaataaaattctaaggccccccgccatctgaatggaccccttctcttggccaaaggcattccaaatttaacctgaaaaaccagttcaggccatgatgggaagggtgtgggtaagacattcccccttatacagtcctcccttttggaattcaggacaagccaaccaatactaacatcaacaaaccttaagtctcataagaaatgtttacagtctattctctctgaagcctgctaagtggaggcttcatctgcatattaaaaccttggtctccacaactccttatcctaacccagacattcttttctattgataataacactttcaaccaattgtcaatcagaaaatttttaaatctacctacgatctggaagcccctgctttgagttttctcacccatccggatcaaatcagtattaaccttacatgtattgattgatgtctcgtgtctccctaaaatgtatagaagcaagctgtgccccgaccaccttgagcacttgccatcaggacctcttgaggctgtgtcacgggtgcgtccttaaccttgggaaaataaactttctaaattgattgagatttgtctcagatacttttgggttcacaaagtggagggcgtcttgttaacttatcagaacatgcttgggggcttctagccttgcctttgacaatctcaaaccttgaggaagcagaaagtttaatgctcagaaatgatttattggctgtctaatcatccctgccatttttattggctgtgacactcatgactcattctattttcattagtataaattaatcatcccgttcccccacccaccccgtacttgtgagcaccttcagagacctcccttcccatttccctctcttccagagagcaaagcctgtggaccttgggtaccaggttcctcttgcaaaggtggttgccctttcccttggcccacttacagcttgcatctgtgtttctctctcttatttactcaatatttctgccttctctatttctacttgcatatcaaggtgaaacaaggaacccctctgagcttccttgattgtagatggaaataatgacaacacctgctccatggggttattgtagagaaagcttctaacacaatgctgagaaagctttttaaaggtattagcgatttcatttagttccctttctctatcagttttggcaatgagtctttacattaagcatagaggaaagagggaaatccttgtggtcagactgatctggtttcagtgtctccatcatgtgcagtctgtaagaacctggagcaaattatttacctccctgagccttatttcctcatccataagccctctcagggctattaaaacagttctctgggtaaaacctctgtttttacacaataaagggttcttttaataaaaaaaatccacattgtctgttctcttttctagagtaaggaagatgagggtctgaatttgaatatgccaattccaaaaaaactttgggtaataaaacaccaacttggcatcctctgggccaaggagagattgaaatttggtgtttatttggctcttacatgtgattattttgggaggctttggggaaaatgattgccaaaaaggctagagggtcttttttaaaaatacgttttagtagagtcaagactaacaagtgatcgaatttcaccctgtcttaaagctttcaaacttgtttttggcaatgacagtgtgtaagaacacctcctcccctttctctcttccttctccattttcctctcctctctttcaggttttgtttttgtttttttacccattctccccttttattgttctcatcctccgaaatatggcagctacttttctttatctgggtcactgagaaaatcaccatttggcccatgattagtttgtaattcagctccattctttttcttatattaatgaaaataattattgctatttttgttaataataataatggtaattatcacttattgagtgcctttcctttatctgtgctaggcatatttagcaaatgttaactctgttagtcctcatgaccatccttacagcaggtggtgtcattaccgctttgcaattcaagaactgaagcagaatgctttagtaatttgccacattcttgctattaagtgggttactgtctacaattttgatgacatgagaaatgggaagtcaaacatttgaatagtaggaattttttagtagtcagaaaaatatatgtataaattctccctctaaagagatttgaggtgactaataataataatataagaaaaagtcgtacaaaatagaaaaaaatcagaatggagtgaaaataatgataagataactgagctgaagctaagagctttagagaacctttagagaattcataattactaataactttgtttccaagcttcctagtggccaaagcaaagacagagcttaatcaagattaactgagtgaacagataaaaactttactgctgttcaagggaagtagaactttttctaacattgggagtctgagagaaattaatcctagatgatcaagggtagacaatataaattatttaaaagtatgtgctattaaatttagttataattttgaacaaaattttaattttaaaatagttttaggattatagaaaaattgtgaagacgctacagaattcccatatacttgatgtccagtttctcccattaatatattattatgatacatttgtcataattaatggactgatattgatatattatcattaataaaattccatactttattccgatttttttagtttttacctaatggcctttttaccatgttacatttagtcacgccttctcaggctcttcttggctgtgatagtttctgcgtctttctttctttttgatacccttgacagttttgaagtgtattggtcatgtatattgttggatgtccctccattgaaatttgtctgatgttttctcatggtgagacttgggtagtttgtttttcggaggaagaccatagagataaaatacctttctcaacctatcaagcgaacacactcttatcacaacttaacactattgatgttcaacttgatcacctggctgagatattgtcaggtttctccactctaaattactcttccaccccccaccccccaccatattgtactttttggaaggaagtcactatgcacagcccacacataaggagtggggagtagttatgcttcattttcttgagactgtagtatctacatatattactttgaattattctttatgggagatttgtcttgtctcagttcaccttttttatggctttgaactaaaataaattatttacaaggcttcttatgtacaaacaagagacactgtaagtaagtttggtttactggttaaatgttagaatttctgagacatttctgtggcatatgcgaaaacggttgaatttctataattttaggtttattatttcttatatttctttatattaaatttacatattctacttactcattttacttttcctctcccctccattataatgtataattctgtatgggttattagtaaatattctaccttttcctttaaagagatgaattcatggcttttagaaactgaagtctctttaaaataattattacgtttctgatgtgtgtggttctctgtgttttgggtttataagggatattattgtattgttattcatcttgtgggtttttaccagtctgtcaggagatgattatgttgggttattgatctgtagtcattttctaaatacaattcataggatctcaaatacaaaaccattatttagactcttattctactgatttttcttttgttaaaaaattggaaatatgctttgtacaacttatttttttacttaatatgttgtatttttcatattaatgtataaaaatatttttgacatctgtatagtatcctatcctatgtcagtatcaattttgtcaagggtttgggcttgaaatgggatcttattttaatttgcatttttgattattgaatgcaattaatttttcttatatttatcaaccacttatttatgtatgtcattgtcaattactaattatgacaattagtgttatatatttcaatgatgtttatgtcaattgctaatatttgtattgggagttcagtgttttcttcaattttggtgagaatttaaaaaaaaatttttttgcagtataatttccagaaaaatttaaacctacagaaaacttgagagaatggcatattgaacacccttataccttttacctacgttaatcagttgctaacattttattacttttgtgctctttagtgcacaccttacctacctctgacacacagacctgtaattattttgctgaaccatttgtaaataaattgcagacctcacagtattctccacctgatcagccaatactaacaacattttcctttataaccacaacatcattatcacacttaaggcaattaaaattaatcctcatactcccttacaggtatccctgctgttaaggattcagagggccactcactctttcttgctattggagttctgactgatagagactacattaaaacatattagctaaatgaggagtgaaaagttgtcttattatctcagaaaatactctttagcctctagtgtatagaacttctaatatactagatggataatacagctcagaagtgcagttaaaccccgtctgcatgttcaggtatgtgtacatacataggagttggggcaggaaggaagacccgatttgccaaccctatctcaagtctagcagcttagcaatatgaatccagacctgcttgggtatgattaccacatggcagtgggaagccatgctggtcacacttgggcataggaggtgaaagtgtgagctcattattatcaccttttctttaacacagtgacccttaaaatgtggcttaatctattccagtctcttaatgattacatgaatttcccttaccgtcttggagaaaattgagtaagaggatggggtgcaaagtcaactctgtgtctctggtgcttctctgagtggagagaggaggtcgggtggaagtctcattctccccagagagcagaggcagcagcaggagaagaagggagaaacttgcaccttaatacgtgcctgcctgtggtgactacagtccacatcccttccttggtacttggcctcttcatctcctgtctcattagtatatctgagataagagttgatttttttagaaaacatctttagatgtatatagtatacataattacatataattcacatactatatgattcactaatttaaagtatactattcaatgatttttgcagattacattacttatttttattaattttaataatacatatagcataaaatttgccattttaattatttttaggtatataattcagtgtcatgaattacattcctcatggtgtgcagtcattaccactatctatttctaaaacttatttatcaccccaaacggaagctgctactattaaataataactccccatttccctctttacctatcccctcttttttttagacagggtcttgctctgtcgcccaggccggagtgcagtgtcgtaattttggctcactgcaacctctgcctccagggttcaagcgattctcctgccttagcctactgagtagctgggactacaggtgtgtgccaccacacctgactaatttttgtatttttagtagagacagggtttcaccatattggttaggcaggtcttgaactcctgaccttgtgatccgcccacggctgagtgaacagataaaaactttactatttttatccctccctctcccctcttaaactctaatctactttatgtctgctatgaatttgcctattccagataccccatttaagtagacttatatagtatttatccttttgcgtctggcatatttcacttaacataatgttttcaaggtgtgtctatgctggagcatgtgtcagcctttcttttttatgactgaataatcacatcctattgtgtgcatatactacattttgcttgtccattcatcttgtccaaatggacctgttggtggacatttgcatcgtttctaccttttggctattgtcaatgatgctgtggcgaacattggtatataagtatctttgggtctctgcttttagttctttttggtgtatatctaaggagtgaaattactggttccatagggtcattctaagtttagcttggtgaggaaccaccagatgtttccactatggctgctccattttacattcccaccagaaatatatgaaagttctaattcctccacatcctccccagctcttatttccctctcctttaaaaaaattatacccattgtagtagatataaagtagtctcttattgtggtttaagaattgattttttaaaatactagaaatctgtgggatgaaagtaaaattgattgaatttatatcatcctagaagtaactttttttggcaaggataccccagggagtgtcataaaattaaaaattaaaggtgtctgagagtaaggggagaagcacagttacttctgatgtgcttgatgctaaagctccttgatttgcattgttttatggttgtgttgaaggatgatttctcagaacagtggtatttaaagcagctcttctaagttctaggaaggattcagtcatcctctctcaccagcttattttttagtatatttaatagtgctgagaaataaccagtaaatattagatattctttacccttatttttgagaaagaagagtgttttcactctctacagaagaaatatccttatctcttcactaatgatagtagaaataataggcatttcaaaataacagttacttaaacacataagggctcattctttcctgtgaataaatatagatatatggagtcttgggctactgtgatttccccataaagtcatcaaggacactagcttttttgatgttttttagtcctgagttctattttcaagatcacctcatggtccaagatggcggttgaagtttccattatcaagtccacagtccatgtagcaggaagaaggaagtgggtgtggtgcatacaaaggatgtgcctcacattggagtgagccttctttaaacaatcttcttagaagatctacgtcatacttgtgcttgtatattattgaccagcagctaggtttataatcaaactgaggtgaaggggaatcggggcagtgtaggcttttatctgggtgtcttcctatccaaatattggggttttcttactaaataaaaagggagaattgatatggggtgggtaaaaagacactcaaaatcataatttctcagcaatttacattgaccagtatcacagacaccaatttatagtccaatgatagtcacaaggtaaagggagaaggtggtgatcatgagggagatagtatataatctgagcaatgtaactcacaagtttcattattcattaatacattcattcattcacttattccttacatatatattagtaaagcatctgtgaggcattctctccctaatccagtaattgataggtacacatgtatttgactattcaaacccgtataagagccaaataatccttagttcaaagttttgctctgccacttttaagataaatccgaactcagttaaatagcttgtggatggggtgaggaagagggaccatttagaaacctagtaaacctgtggttcgatgacctttttctccacctcctccctggcttgggatttgattttggctacctgtggagagagtcatccactgaggggtctcagagacattgtgggggtgaagaaatgggtaggtgcccaggagatttcaggccagcccaacctgagttcagaggcttaaagtccagggagggcgagagaggatgaagcatgctgggtcagtcgggctggaggcagtgggggagtcggagggagtaggaggaagtaggaggtgctaacatcatgagaagcatgagttaaggcacaggttctcagggactgtgccttgcacttgtactcacttgttacatcactgactgtccctctctgctacattgaggcaaagtctgaggaaggttgaggttgcttctttctcttttcattagtaaagcaaatctggatagaaaagggtgagaagccccatctttgtcctttggaggaaagggtaaaactgtgtgacctcgacgattatgatgtgcactcttcactgagaaccactagtctgaatctgttccatttctataaagctttttccccagttctctgctgtgtacgtctagatgtggattttatgtggctgaaagatgatctctagcatgactgtcattttccaactgagcagcagtatagcttttcctttactgaacaattttctctgagaccttgaatcacttttggaatttaatttcatttgctttttcaatatgataaagtagaactctctctgaatttgattcctcacttacaaatagatatgatactatattctctgttgaaaatgttttggaactgtgaagatgctagagagttagatctcgtgtttcagggaacagaactgaaactcagaagggtttcattctgagggtgaagccagtgtgtggaataagagttaaattttaaggggtacattcctggatcatgccttgttcaggagtctttttcctgacccaagaaggcctccctcaggatacagtgggcatctcagtctttgtgaactcttaaattcatttcttacccagggtggctaactctgtcagtggactattttgtgaacttcatactttcggaatatgttatacttatgtgattcttggtagtctcaagaaccttggtagaggttcaaatcagtcaatctggttaaaggtatcagtattcagtcttggaatcaagtggcactagagctcttaaggcttggcggttttcaggacctacatcacaagatacagaagtggtgtggcttggagctcgtaagactcgtgtctggtccaaccaggtaacttggggcccctggcacccatatcagacttttctcatctgcaaaatgtgctgcttggagtgggtgatttatttagtacttcccaggcccaaagttctgagtctgtaagatgtagtggggttgaccagcatctccttttggattctcctttaaaactcattcctttgaaaggagattgctaaagtcaaaccttagaatccaaccctttgggctatgatttaatgttaaaatgctgtaccctttcctttcctcctttttctcctttactacttctattttgtttctttttcgaaaaaatataccttcttttaaaatttttcttcatttttccttcttctctgtaaattatcaagggcctttgaagagaattcttacatgttattaagaaattgcagtcagggagccctctgttcccagatcatttagaagattgcttttccttttgttaaatacaaaaaattgtcaacctgtattgttaaaatgtgccaaaaactgcattcaccaataaaaaatgtcagctctcattattgcccagatattattcttttcaaaagcggagcactcttgccaggctttctaaacaatcttcagctcattcatcttcctggttttgttacattttgaacctctctgggtctatataaggtggcagcctgtcttttaaaaattaatggattccaaatgccattcaaacctatttccgcccttaacctcctcctcttctccccaaccctgcctgttaggagtcttatgttctgtataaatattgagctggagatagtttctaaagaggtgtttggacctttaattaacattgacagcctgtctgcttaggattttgctctgctgtctccatggaaaagtcaggtaggtcagtatgtgggggagggacctctgcagtggatgtgttcctggcggctggccctagagacactgcactctgagccaaccgtgaagtcattttgaatttaaggagtcttgctaatccaaggcaatgtgtcttaatttgacaaagtaaaggctgcccgataagcaagcctcactacaagttctgtgaaacagggggtgtttgtaagtttagattgtgctagagaaatgtggtgatgtggaagaacgggctcattttctcctgtttactccctttcccaccccatccccctcctctctcccttctctcttacttactttggcccaaatcagccctgcagtctggcctctgcagtggcttgatgtgaaatttgagaaacatatgtagttttctatttcaggaaaatgatctcagggattgaatgtgtttttttgttggctgttaagctctgatcttgcccagtgtggttttttgatgatgggaaagaggcttcgaagtgctttttatcagaatttcatgtaataaaacttaaggtttggtttctttattttggcccccaaccccctcccaggctcaggacacaatgtcgtctattctgtcagaagtgggaagaagtacacattgttcatattacaatcacttctttgctgcttgcacacacatatataagaatggccactgtgtctatccttcacaaaagctattttaaatgtagttcagtggaggaccaaaggtctgcgtagtgtctcttacaaaggaaaagggatctgttgggggaaaagtctgcctttgttttgccttggaagggccagtatttttctttgttctagaggtgagtgccaataatgggcctagtgccctatcaagcaaacttcattaatccagccctgcaaagggtacactgatcagataaaagggacctacatcctcaaagctcaaggtatttgtttttaaacttttttcttactgtaaataaatatcactattgtacttaatctcatattcataattgtattccttttcttaaagagcctttacataaaagcttcaggccctacaaaatccgagagcatccttcatggaggaaggatagtagactcgagggtgagtggttgaactttggctctggtgtaaaatgcccaccctgggacttattgtgtgaccttgagcacgttacataccatttctgcacttcattgtcttatttatatttcatgggcttgttgcgggattgaacaggttcaagtgtataaagctcatagtacaacctgctaaggactcaacattagctattcctgctgctgtttttattatttgttgctggcgtataagacctaggcaaatggagctaaatactattgtctaccattaaaatattcaccttctggagggaatagtgcaagggtaacttcagatttgcattgaaaaacccatggactatcactttacatatttatttccttaccatcttcaacccttatccagacagctccaaatgcacattattcagaaaattggtgatattttcacagcactgagactaagctcatctcctgctggtccttatcactcaccagcctttcagccacatcagacatctcctcaatctctgggcaaaccaggccttttcatgtcttcttgactttgcacgtactgtttcctccccgcagagtatcatttgcccttttttctgcttgtcaactgctattcacccttcgagacccaacttaaatattatttgtgaattttgggcagttacacagactcttttgggcagttacacactactgtttcatttttcctatagttcttcaagaacttctctcattgtagtgtaattatttcttgacatacatttttcttctaacagcctaggaggtctttggatgaagatactacagtctattcacttttataaccccggtacagagtgcatgacacgtgttaggtgttgagaaatctgagaaatcgactgggaagagttttttttcataccattatattttaaaagctgcaatagtttgttccagaaaagttatatttttcccttggtgtatattctaatttaaaaggtgtttttaatgcctgattgatctccaatctgtaatgactttgtagcattttctttgtttccctgcattcagccttctgatttaagcagataatgcttggaaacacctgtttaagttgtatcttctttgctagttgtaacttcatgagtacagggaccatatatgttctgttcacagctctatccccaagtcctaatacagtggttggcagttctagaggtagaagaaattataataataatagtgcttgtattttatgcttaacagagcacttaacatgctggccactattgtgagtattttagatacattaaccccttcagtcctcccaatattcttatgttatatgtattataattatcatctgttttctacagataaagaaacagactcaaaagaggctaaggaacttgccggtggtcacacaatgattggcagagttgggattttaacctgggcagtctggctccagaattcaggctgtttgccataatggttccttgcctctgattagtactaattagcttagtacttgtttgttaactaattattaaaggaatccaacagagacctatttctctaatgtaaagagttcattcattaggcaaataatcaccctaagccagttgttctggaagtatggccttcagaccagcagcatgagcagcgtcacttggaaatacattggaaatgcaaattctgtggcctcactcccaccctactcaatcagaaactcttgggagtgggaccaaataatttgtgttttaaaaaaatcctccagaagaatctgatggatgctaaagtttgagaaccactggccaagactcagccattttctctggaattttacccctgatttttgcttttcttaagaagtcataattttgggtgtctcacttttgcatactcctgatttttgtgacattaatgtggggactaagctctaacctcagtgaatgtttttgctaaagtttctgagaaattttgaaggtttcaggtgtgtctgtagcttgacagtgtttgtttcttttgatttttttttcctgtgatagcttttaggatcaggaaatttaaaaaatatagtacctcctccattcagccctgctgtctcagactcccctaactggtgagtgaagaaggagcccagaggtgcagggataacagagaaaggggaagtagcagaatcagtgagtggggaatcaaagtttgatgttatcgcacttcctagaagtggcctcaggtcctttggactgttggtttacaaatggtagaaaaaagggacactggacttcaaactggacttggaatcccagttcagtctctctatctatgtgattctaggaaagtaatttttctgagcaacagttccctcatctttaaaatggggataatattactaatgttttaatgatgtgagaatttatggagatgcatgatgagcactcaattcatgcttgttgtatctatactgaaggaagctgtaagagatagagttagtcactagcatatttaccagtgagtgttctaagaaatggattatagattttgcagagcaacaaggaatccacagcattccacaatggctggtattccaaggatcgaaattctgggaggttcagttgcagagaaaactaggcaccagtttgaatgcattatgtcttgagtctgctttttttttttttttaaaagaaaggtatctaaaagtgatttaacaatgtcaggatttagacttaagtttttttctgttaaagaggccattgctgaaagtcaagacccaaggactgtacaaatattgatgcaactgtcagagatacatggtatttgaccttctattaataaagacaaattattgcatttctgtgatatttgagtctgcaggaacttcccttaattccactggtattccattccacggctaccagggctgctgggacaagggacgtggcgttgtgtttctgatttacgaggtggaatattagtctgatttactaaactgaaagagcaggttcagataacaaacaacatagtgaaacttcctgaataacagccacagaaacaactcatgtatttggtggtatcacaacaagtttggctagatttatccacagactagaatacaaaccatggaggaaagaaagcaggtaagcacaagtaaatagagggcaaggcagatactagtggactatactggatgtaggaagactttgaggaaggcttttttttgcagacatctgcagggtgtaggcagtgaagtgtttgttgtgactatttgccagcaccatcccacttcacaggtgggtgggtggttccttttcaccaagattttaatggcaggttgtgccccataaaagggcggggcagtataccctgtattagtttaaaaaaggtctcagcttacacgggacagcatttttactttttacccttgcctttgctcattcacagggagtacttcggaatcagcccatctaagcctcagacttcaaagggagctcattcctatttgacaacagtcatatccattttgccaactctttgacctttgaaatagcatctactcagtcaggtctgacctgtcaactgtctgtaaaaacccatccagatcaagaacttgatattttcaagaacacatctaaaggatgggggcccttctaattttgtttctccaggacttgttttgggagaagccagctgcttcttctggtcttaatgggatgggattatagatgggttgagtctgtgaggcctcaacttacatgatgatcctgtgtccttttattataggttgcacatgttttagccactcatggcagcatttttctccagctacagtcaattttgtctaattattgttgatcatgattttactgtaaaaaaaaatttttttttttgagacatggtttcactcagtcagtctggattgtgcagtggcacagtctcagtgcactgcaacctctgcttcccaggctcaatcgattttcctgcctcagtctcctgagtagctgggactacaggtgcacgccaccacgcctggctaatttttgtatttttagtagagatggtgtttcaccatattggccaggctggtcttgaactcctaacctcaaatgatccacctgcctcagccttccaaagttctggtattacaggcatgagccaccatgcccaggttgtaaaagtatttttaaaaagtgttttcagaggccatttgccatgggaaaatgggatatgttgaccttcctgtttacctccatttgtgggcttttggttgtgagcatcagttcatatccagttttggggaccactcttgggtatactttaaataattcagatgttgaaatttttcagaatgagaaaatctagagagaagtccagtttgattatactagaacctcatttgctgattaaattgtaaaattcctaattgcaacttggtcatgtctttgcaaaatagtaataataatattaacttctatttatatagtgactgtcttctcaaagaactcaaaacagtgtccttttctgtatccctgctattcccaaaacatgtttgtggcaatgtatgtggcttcaaaatgtggatgtatcattatgaaatataaatgcatgtggtgatggtatttattagaatcatatgttattggaagtacctaacattgggtgtaaaggaagcctggtcaagtttccaatagagatttacaattgggcctctttgtatctcagtttcttcatctgtatagtgggcataatagttcctattttatagagttattgtgatgattgtgttaatacatttaaagcattgacacagtaatgctgggatagtcctcaaatgctattgtttgcatcggttttagaatcagtctaataaatatgagtttaaatacccctttgtcccttgcttgttgtgtcgtcttgggcaataacagtaacagtcaacacagatgctatttattgaataatacttatatgtcaggcattatattaggcccaggatataagtgattatttatcacttattcctttaactttcttaaataggtatgattatactcattttatagatgagttaggtaaggtttagagaagttaagaaactttcccatagtaacagagttagattactggcaaagcggactctctgaattcttgtttttggttacctacttaggttcccctgaaccacagtttcatcatttgtaatagggatgacaatagctctttgtaaggattaaatattgtacataaagtatctagcacttactgtgcattcttgacatgatatacaatgatattatcctctccaattagagctttccatataatataatttttttctttgtgttccttatgccatgcatatatctttagagattaaaagacacttcttaagaatggattcttgcatttctgagaacttcagaatcacacttgtgatctgacacagtatatatacactcaggtattgatgtgtgtatgtgtactttccattctgttcagtctagaagtgtatagatgctcaatctgggtgctttgtaaggaacatcacaaatgttcaaaatcgtggatggacttgaacatgaaaatgccttggcctcaaagttttgcttttctgttctcaaagttgttgaggaaactggcttagttaaagctaagtgtttagaaaccaagtgtgttttggatggtaaggtggagtcagcattatatatattaatacatttttggtaccagaaacagcaacaatcccttagtctggtgtgtgcagatgtaatatgtttcatgatatttcagcctgtattttctgtcttaataagtgaaagcactgcagaattgggctgcaggccactgccccatttctctccttttgtagtcagatctcccttgtgaatgataaacacccactcctttcatttattcacccattcactcaacctcctacaatctaagctgcatgcttaccacctaccttaaagaacaccagtgattgcttattgtgacttacgtcataaatatgtattctagacatgacttctcacctgaatatcagtgtcacatccttcatagcctcaaaactttgaggaaatatcctcttatggcatactttaaaatttgtaattttaaagtaagcacaaagtacgttttgagaccttcatttttttctctaacaattctgttttgttttttttttttgtattctgtattttttgttaagtttatatcaggatgatttgtcattagtgttcttgtaacatattttggagttttccttgtgcaatgtggaaatagtaaggttgacattctgcttttaactcttctttataaactatgaggaattcccaaatagaatgttaccttgaaagactcttgacataagtagaactaaaccaaatattttatataattatttttattttttatttttgagatagggtcttgctctgtcacccaggctcaagtgcagtggcgtgatcatggctcactgcagccttgacctcccaggctcgagcaatctgccctcctcagcctctcagagtgcttgggattaaaggcatgagccaccatgcttggcctctgtaattcttaattattattttatatatgttatgagtatgagaactaagcagttccataaagatgagaattataatatctcattttagtagtattttgctttgtattatttgacattttataaaaattcatagtctcaaaaaatatacaatgttcttcgtcaagtagctaatactctctttcttagtgttcggtttaactattaatcttatcctgttaaattatttaaaatttcctaataattggcacataataacagtttttaatgtcagcattgataacatttttctgtcataatattcaactaagggatgcatcttcaatgtataaagcccataagtaggttttttcaccctagattagatctaaattgcttacctgtttttggaagtgaatattatgttattaacaataaattccaaactgctttgtattactgacattgtaacaatgtcttgatatgatggagacccttgctatcacattgtcattgatcatgcacattgatcatgcccgtgttgaaataggcaatgccagagacagaccaaagacgaaactggtagtgattttggtgaacattgttgccatgttaaacttgagtatatttcttgttgaacaaccccattttagagatacggaaaatgttgtgaggcagagatattaagtaaccctgcccagagtcgaatggttaataagtccttgccaggatttaagtgataaaacaaaactcatgcttttaactactatagtcttgtaagccactcaacaagtattggccagttaaactaatgaattccctcaaggaattgattctagtaatagagataaataatcaagtcataagtcatgactcaatgtgaaaagtcttgtgactaaggaatgaacagtacaataaaggaaacatgaggaacagtgaatcgtggtaggattatggagaggaggaggaaggaatgggggagagtggggcctcagagaggtgcaccaagactggggcccaggccttgcttccaaggtaccatggcgttctgtgtttttccttgtcttgggcatactattcagtgtttcgatttatttacttgtccttacctcccactaggctataagctttctgactgcagaggtaaattgtgtgtcttcatcacttagtgcaggaagtggtagctaatgagttggatatgtaggggcgagtacagtggacaggtgaagtcaggacatgatggacaaaagcatgaacatgaaagaagatgtgaacattcgttgcctctttaggaaatggtcgacagtgtggagtggacagagcacggacatgtagcttggggtattgtgaagggatgggtcagccgtgtatacttatctaccatggtaaaaagtgatattattagatttctgagtgcttgcctttccctaatgcatcttcatgtctttaaggacaaagatgtaggaccaagagtgggctacatcacaggagatgaaaagatctgtttgcatatttgacctctgctaattatcagcagtgtgatagtaggcgtgtcatctgacatcatcttgcctgttgcatagtagacatttggtaaagatttgttgaatggattaattaatataattatatgtttttgcggactctgaagaatttgagatacagctatataaaagagttactatttattggtacatattgcttagtatttggaataagcttggtaattattcactaagcaggaaacagggtttagggatttccaggcattagggacactgagccttgagacagggtagcagctctgtggttcagagtgactggtccaccaggaacagaaacaagctagtattgggaggtgagggagtaacattccttgggaggattatttggcaaaacgaagtaagaatcataggggcatagggtcatggaaaaggcttcattcttagtagagctctggagtacccatcaagtctgggtgaagatgcttacctccctgagagggcaagcatcaggaaagcctgggtatgggggtcccgggctcctgaggcccaggactcattgctaggatacagattgcactgtcaagtccagactgtcacgtgtgagtctaagcctattgttttggggcttgccatggtctggatggggcccctcttaaaggttatagagttgtggaagaaagggactgacacattttgatagtcaaagagtaaaagaagctatgagttaccagtgtgctggatgcttctgaaagcgtttgacaagtgctttttgagtttttaaattaaattacttttttatttttgtcttcctctctataaatcataccagagaaggtaacatttttctctatactgactttgacaagcctagactatgctttgtctatgtccagtgtacaaatgtagagaacccattcatttctttactcctcacatatttagtaaagtccggctgtgtgccctgcctttaggggacactgagcagaaagcagactcctccagacgattgcattgcagtataattagcaccataacaagagtctggcagattctagtctgtagtagcaaaatgaagagcaatcaggtctatccagggaatgaggaaatacctcacaagataggaagtgactgaactcggacttgaaggatgatcaagaatctgccaggtgggtatgggggccacctggcaaaaggacagcatatgggaaagcagaggcatgaaagaccttggtgcatccacaaagcgttgggcacgtgagtctagccagatcacaggttgtgtgttggggagcatttagagaagagaacacaaagtcctcacgtgctttactcaggctttgggcttaaggagtgtttctgatgtgggctctggagccagactgcatggctgtaagccccggcctctctgcttcacacctctgtgatcttggacaagtaccttaactttctgtttctcagtttcctcatctcagatgataataggacatgcctcacagggtggttgtgagaacctgaataacatcgtaaagcacttcaaacagtgtctggcacatcagttgttattaataataattatataagataaaattatataattcataatgatgatgtttaatttgtaacctgtagtcaaaaagtagaaccaaatacaacttgcaagggaactggatgcttctggaagagtttgataagtgttgtttgagtttataaagtaaattaccttttttactttccaggtaaaaaaatatacctttgggaggggaacaacacacactggagcctgtcggggggcggggccacaggagggagagcatcaggataaatagctaatgcatgtggtgcttaatacctcagtgatgggttgatggatgcagcaatccaccacgcacacatttccctgtgtaacaaacctgcacggcatgcacatgtatcccggaacttaagaaaaaaaaatacattttttctttccaggacagcgtcagtccttaagaggctagctcaaagactagaggaaaaatagactactaaataaatcaaaattatttagtagggtatagagttatccataaagtgctgggggtcactaattattaaagcagatagagcacaggtagttgttgagcgtagaacagcccaatcagaatgatgcctcagaaaggcagtagttggcctcccagagtggagcatggattgcagcagggggctgaggctggagggggagaagtgttgaactaattcaagggatgttggagggctaaaccagtgtctcttctgctaaatctgagcagaagagacagatctggaagcttctggtaaggtaggcttgattgagtttggtgagaagttagatgaggagggtgagaacctagcatctgggtgtctgctagatagatgctgctgcaccacaccaatgtccgtgtgtctgggtaccgaggtggtgttcaggacaggtcttctccacgtactgccgctgagctcacatccacgctgtgcatgctgggctgagttctcttcaggctgttttcagctgacttaaatgcaacacgtgatgatgagcatatttacataatgtatgcctggtgaaatcacgaaagattggaatttcccattttaattccattttaaagatgcttgttaagcaaaaggatataattcatttttcaaactgctgaaatgttatttggcctcttgaatcaaaggcattccgcaagtgttttctttattacatgccttaaactttaattagaatttaattataagatcctgaaggcatgagcaagaggagcagatgggatagtaaaagcagcttagtgagggaggattaaagattaaaagttgcttgttaatggcataagaaatgaacagagagctaaattactatgcttttgtgctatcctgatgctttttcgattctgtaacttattcctggttgcaggtttttcaattctgcaacttattcctggttggaagttgaagaatctcacaaattagatttttaattttttgagttgctagagtagatttgtacatagaaaacaggtaaaacctgacaaaaaggtgttttatggctagtagcaccttgtacaataatttctgcattgtaggggcttagtggtatttactgaattgaactaaaacttacatcatctcactagtaaacatcgaatgagcataaaataagatttttttttagagatggatggggaaggtgtgagtctataagtccaggctaacctgtcccatggaatgttagatacctactcaggaaggtaacttgtatgaacctcccacctttagcctaccccccagtcgaccttagtcatttgccccacttggttggttggctagaggagtggtagaaatttggtgtgggaaacactttgagactgctcctcatgtcacacagtgaggatgacctgctctgctctctggtgctatgttacgatgatctcccgttaggctaaattattctacttcttagtgctttttcccctagcttttttttttttctttttgaaatctgatatttagagtcctcttccccacttaattgcaagctcaatgaagaaaaactagagaacaataagatagaaaagaagacaaaaatgtagtgaaacaaaaagcattctatctcctattttccaggaacaaatgttttttaaaaagcttttttaagcctgttaatagacagttgattcttcattatttgcagattctttgtttgcaaatttgcctacttactaaatcttatttgtaaccctcaaatcaatacttgtggcactttcacagtcattcgcagaaatgctcagagaggaggataatttctgagtctctcgtcatgcgtgttcctagccgatggcaaataacacaacaccctgccttcttgtttcagctctcatagtgtaaacaagtgtccttttcgaagtctactcgtgccatgtttttctcatttttgtgctttttgttggcgatttcaccatttaaaatgcaccccaagcattgtgcaaaagtactgtgtagtgttcaagtacagtgcaagaaagctgcgatgtgccttacagagacaataacgtgtgtttgataagcttcattcaggcaggagttaagtgctgttggctgtaagttcagtgttattgactcaacaatatatattaaatgagttgtttttaagcaagaatacacatgaaacagggttgcgtattgatgagttggcaaaaatataactggaggctcagaggaacctagccctgtatttcccttaggaacaatggtccagtgttccctaatttaatgtttttggagactaccaaaaataataaggtcagccatgtatctttctccttttctccttgctcttgcttgatctttccatctcttgttacctcaatctgtgtgtatatgatatgcatatatttacttaaattatatatgcatatatttagcaattatgatatcacatgatacacgattctgcaacctgtcttttaacttatcaattgtgttggcctttgggctgtttgcactgagatccatttgtcacccttgccctgctctgcaagggtgctgtgttacagggggttgacccctgccccctgacaatttgtcatcagtgggagatggcaaggcaagagaaagagaagctggagtatttgtccctccctctgtctgccttgggcagcatctctggcagtggcccctctacagctatcccacctgcaggttgggtcctccatggctctgtcatcggctggttggtcctgggtctcgagctttagccctgccttcttcctttgtccttttagctgatgggtggaagaagcttcctgctgatgctgatctctgagtttcttccctgtcccctgggtagagcatcagatttaaaagccaaggcaagacaaaaaatgagagaatggtagcaaagatccaacactttacaagaccgcctgagaaaagggaggagggggtggttcgacaccagggcctgcacactgagtgtgtgatgttgcagctctgcaggcacagattaagcagctaagatgccatcaatgcttggaaagcagccggtgcctcttgtcctgagcttatttgtctggaatatgattcccttgaacctgactagctcatccacggggagagagaaaaaaaaatattctgatagttatcctgaccaggctctaacagggcctccttccctaggatataattttttctggcctctttccattcacttcttcacattaggacccttttcccccagagtgtgagattccctgagggctctaaaaactggaatgctatacagcattttaagccccctgtgttggcacagtccttattaaaaatgtattttcctcaagccatggctgcaccccctgaagtgtggattaacagaaaggccttcagagctggaagacatttttgaagaaccgctgtaccaagtggcattaaatatttattgcctactacatgtaaattgttcatcatcttgttttaactcttggaccaaaaggtttctcatctgctttctgctaaagtggaaatcacaggaaaggtactctttactttgctgtggtattttgttttcccaggaatacggaatatttctttgttctcataagtaatactagaaaagattgccttgactctcagcatttcattgggaggccatgtggtgtcatgatggagaaaaactcgaattctggggcaagtgcattgggctttgccacctgcaagctgtgttggcttgagaacctgataccatttatgtttgttgtgctggaaaaatgggacattgcataaatagcagatagcacaattcctggcacccagtaagttctctctttctcctaggtcttctatttgggactttgcaaatacatttctaagcaacctagaataaaatatgctattaatatgctgttaataataaccaaaagcactcagcttaatctttacttattaaataaaactgaaatgttgctcagacaccttttgctgtttttggaatgcctttgtagacacttttgatcttgcttaaaaaacataacagcatttcaaaggcttatcttagctattcttattcatacctgaaaacctacagagtttggataattttggcacacatatgtgtgcacgcatgtatatgtataaatattctgtctctctaaatatatatgtatatgcaggcacatgtataactctttaagaaatgtttttctaatgtttaattttcttaaagtctgtacttcacatcatttttttccccagaactgtttatcctcactccagacatgacccttggaaaggtggcagaaaaaacaaacggctggtgtgttttggggcagtctgcattccttttaactctctgagaccaggcttatgcatgggctttcaagctatttgtccagaggcccaaccactttgatttctgcttgaaaattagcctgttgttcaagctcaggagagcttccacagagctttcttgggttcgcgaactagagatctatgaagtgtttgcttttatttgtaactttaaccacggcagccttaactggacttttgttttcttatttaacttttatccatgtaaccttaacctaagttctttttcaaatctccatcctcccccatctcacaatttctaatccctcttttgtccttagatttttccttcaaagtcaggatatgacatttatatctatgctttaggaagtatctgaaagctaacatacacatagaattatgatttttttcttgggttgcttaggaggattaaacaaaggttttagaaggcagaattcagaaaaaaattgatagaagttgtgctgcagcttggaggggagtgtggattttagaaagcataaggacactttcatttgtccctttcatatggacttttatttcctctgcgagaggcccaggggcctggcctgtggatggtttagacaggaaaagactgaagggataactgcttccagaccttcagccttgaatgttcagccattattcaagccgttgagaaagggagcaagaggcataaggaggcttcgggagtttccatgcagcttctctgagttccagcttgtgtgcattgttctccaaatgtgtccccagcactactgaaaggactttcatacctcaactaacccttattgcaagcctgtgaaggaagagttttttatatatatatatatatatatatataaacagacaaggcaactaaagctctgggaggttacagaaacttaaggcctaagtagggttacattgagaccagattaatcagttagtagattgtctttctatttcatcatgtgcttcatttcctccttggtttacatgacccttctttggaaatttccttctggtaatatcttagttaaatgaaataactaagttttatggagtatccattatgtgttaggcattgttttatgcaatatgcatctatgtagtgcacattctgataggaaccatgtgaagaaggtgtattacctccattttagacaggaaatccctgcaatacagagggttaggtaatttgctcaagatcacacaggacacagtaggtgacaccaggatttgagcccaggtctgattccagaacttatgccatgcccactacaccagccgtccttattaagaggaaggccattggtatgaggccacttgaaatagacatggtagatatgtggcaatcaatgcaaaggtattgtctttcatgctctgttgcaatctcatttcatttctagcattataggtatttaaagcagaggtaggcttgctttcttagtttcagttttctgagaaacaaagatagtaacaacaatgatgatggatcttgttaccatatgtgaatatctgtgtgtactaggcacggtacttggtctttacacatgttcttctaggttaaccttatgacaactctgtgaagttttctcaaatttatatctgagaaagcactcagaaaggttgagtcacttgcttgcccacatcacactactagtaagtggaggagtgaggatttgaacctaagacctcttacaataaaattatgttctttccactcagtatatgggacatgtatccctgggggcacatgtgagaactataattggtctgtaagattattgatgatggtatagggatagggtgttaaagaacattgatgcccatagtgaaaaagtaattccctttcacttgtcctaccaaccatctggttacatgaaagaggaagtctcagttaggtgccagtatgccttttacaattctaacagagaacagggctcagactctgaggctcgggcaggtaattgaatctagaagaccatggtgacgttctttttgtttttattgtattttaatatcttctcattaaaaaatattataatgtgttcatatatacaaaataaatgtaatgtatatataaggttaaaagaataatataatgagtatccatgtacctatcacctattgaagcattagattaattttagttactatgggaaccttctgtgtcactcttcccatcccaacttctttctttctctcctaccaacatcttacataatcactgtataactatcaaaatcagccagttaacattcacataatactattactcagtctacagactttttgctagttttgccagttgtcatactgtttcatttcctggaccagaatctaggatcacacaatacatttactagtcatatctcctttgtctttggaatagttcctcactctttttgtctttcatgaccatgacgtttttggagtctggttaggcattttgtagaatgtccctcactttgggttggtctgatgtttccacaatattaaattcaaattatgtgtttttggcagggaagctacagaaatgatgttgtgcctttcacagtgcatcacagcaggaggcacatgatgccgatttatcgtatcacaggtgatgtgaactttggccaatttgttaaggttgtgtcttccagtttatccactgtaaagttactatttttccatttgtaattaatgattaccttgtagggagatactttgagattatgtataatatcatgcttcttatacctttgtccactaattttagcaactattgtaaattcttgcctgaaacaattattcctgtggtttttccatatggtgtttttctatgattataattctttctatatttattaactggaatgctttgtaggtggctttatcctcgccacacacttatttattcattcagttgtttatttgtatcagtatgtacttacaaattcttattttattgtctggattataatccattagtatcattattttgttttgcaaatagtccttttaaccaatggggatcccttcaaattagcttttctatctttctgacatgtctccatcttttttaaggcatttttgctttctggtgccagaagataccactttgtgctttacttgctccaaccctgagagaagcctcctcttgctgttctgcatccattcctctcagtcactccttcatgcactataatatgatttccactctccccagtgcactgacacttccgtcacttaggtcattgctaaagcagtagatattttaattcttctattactgcatatcagacatctcttggccccatatcagatcttctcaggaggacagtaaagggaaattgtaccatctcttgttccagctgccgtgaccaagtttgcatagactctgaaaaacttcctacagtataagctgacagtacctcacctcatgctgcatgcttttccatagggcaccccacgaggttccatggggtttccttgtggttgctacctctggatctcactctgttcccacacatgtacaacctggatagagaattaatgcctcctttctctctatcgtggatggttctgagatacagttcatgtggcttggggtgtggagaggttgaggatgatcctatgggatagagaacgagtcacttctagtggggccatcttgataccacaacttcatcttgcctccccctccttattatttgttttattccctttgtctatcagtcctctccttctccctaagattgcactacctgatgcagtagaaccctcttccttgggtctgctgtctcggggacccaggaaaagatgtgcagtgtttaaactccttctctataatctcttaactttcacactatcacattttcattcatttattccaattcattcattcatttacaccttatttattgagactttccctgtgtgagacattgtgtacaggtagacaaaaatcttgatcttatagaagttattgtatttgggggagcagaaataactaaataaaaccaattcagctgaattataagtgcttttaagaaaatgcaacagggagagggcagagagtgggccacgtggggcctggcattgggatggttaccacatacactctgaggaaatgacatttgaactgataaggggtcagcaagaagaaatgggctgagagaagactgatctattcacaggaaagaggaagtgcaagagccctcattttctgttttgcactagaactgctttcctatgattcttcagattgtgccacctttcttccaactcccatgcatttgcacagattgtttctttgacctggaatgccctctctgacttaccaagctggcagatttctatccttagctcagatctcatctaaagcagctctccacccccagggacattttaagtcctttttctgttgttggtgtgctgtgctttgagcacagtattcatttataatagtgatgtcagtgtacgccttagaattgttcacctgcatctctccttcttggactaggagcactctgagggcaggactatgtttgtttactttgtattcccaacaaagtgcttatagggatttaaatctatttattgatgagttggatggatgaatggatgagtacatgggagaaagaggaaaaatgatatatgaattgaaataaataaatgaaagagccagtgaataaatgacagtgacctgaccttaaggcgttgtcttgtttgtgggtgagacaggagtataaccattcagagtactgtgatgaatgcttagagattctcagtgcatgaataacagtggcagtcagcaagttctgctcatagatgcatattgtttcagctatttcatgcttatttatttagtttttaagaaattcatttaggtaccaaacataaaaaaaaacccagacttgcagctttccagatttggggccagacacatgactgtaatcccagcactttgaggggccgaggtgtgcggattgcttgaggctaggagtttgagagcagcctgggcaacatggcaaaaccccgtctctacaaaaaatacaataattagctgggcgtggtggcacatgcctgtagtcccatctccttgggaggctgaggcatgagaattgcttgaacctgggatgtggaagttgtagcaagccgagattgcaccactgtgctccagcctgggcaatagagtgagatttcatctcaaaaaaacccaaaaaacagatttggcagtgctggacccttctacatggagctggggacaaaaatctgctggaaagtaggaaattattagaataactaactgtattaaaatatgttgaattcttcttgtcatgactgttttgacatttgtttgtactagttaagggaaaatgaaacttcaggttgacagcctttaccttccttgtgccataattaatttgctctattctgtttgttcaggaaattcagcttttgaaggcccagaaagaggactaagggtgcaggtggcaaggaaaggttgatttgtggtgacctggcatactgtattccatctttaagtcctcaccacaagtaggcctttatccaggttcttgttacctggaaatgtgtgttcatttggggtatctagatgaggcaggacttcaaggaaggggatggataatgcacttaatcttcatcttcacataaggatagctgctctttatcttctccctctggaagctgccattgtgaggcagcattaaggtgggagaggaccctctggagttcatccagaaccctctgggggcacctgtgtcccttctgtttgtcagtgtatcagccatggatcctgcgtgaaacaggtggcacatttaaatggggtaatccgagaagagtggacaagtgtagggaaaccacatggatagtgcaagatgcttggctatctaaagtggggctggtactctctctgggcctaaggaacaaggagaggggctacgagcaggccctggggagattgttttgtggaggtacttacctttgtgacctttggtggagagctgcagccatcctacactttctcctagtccactgatatccctctgtgtcctccattagctgaacctggctggaggccagaggcagaagagccctctggtgtgctccacacccatcagcatcctggcttacaaggcagggtggagaaagttagagattgaatttgaagagcacatggaagatgtctgggacatctgggcattctttctgtgtggttggttcttgtggtcagatatttgtggaggagtgaggtggtggtggtagtggctgtgctttagagtcagtgagtctgggacaggatcacatctgccccactcgctaacggagttaccctcagctcaaggtcagcaggcaccgatttctttgccgtctggtggggccaagggcaaatgcctatctcaaaaagctttgggaagatcaaaaatgaaaatacttaagtgtttttttgcagatttggaaaaggctgaaagaagttttattaaaatgtgagcaatatacctcaataaagttgttttcctatataagacaaataaaactgtgttgtgatttcacaacaagtgttgatttttttcttcattatatttttctgtattccagattttctgtcatcagaaaaccagacatccataagtgctatttagaaatatgttagtactgccttcaaattattactgttggctaatattgccttctctgggttactgaggtatgtgaattcacagctgcagcatagctgacttgactatggacagactagagtgaacgtgtatgtcatttcttacgatgtgcccatggattcaggtctagtgccccatccccaggaagcctttggcccttcagatgcttctcctctgagctcctgcagctcctgggctgcccctagcagttatcacactgttttgcggttttctccaccactagactgtggtctcctctaggtccaggactgaattttattcatctccaggtcagtgtctagcattgtcttgtaaatgctgtctttattcatgttgcccagcttctaccacacggctactggaagttctcaagctcataacaccgtagcttctacaacagagagcaactgactgtgctttctcctttctgttttcaaagccctgggaaagaattctgattagtttcatttgggtcaagtgtacctacatcccttattgaaccaactatacccatggagaggtatattacagtgatctcagctttggtcaagtgctcattcccagaggaatctgttgtgtggccaatagggtaggatctgtacaactatgacaggtcttatttaaatcaattagttacagtggagaagagaatgaatcagttaggaatgctttcagctgcagtgacaatgcaaaaaagcttttatttaaatcagttagttgcagtggggaagaagcatgtatcaggaatgcatttgcaagggagcaaaaattggttcttgggggatgaaaaagatcttagatattacaatcatttgtggccttctaaagcccatccttatgtaacagcataagtagatacacaatctgtctgtggtattgaaatttcacagtggcagggaaaaggaaaagactgtctggaaagggtctttagtgggggcgatagtgaaaaaaaagtttgagagtgatttatgatgacaataatcatacctaacttatttagtagttatgcaccaggaactgttatgaatgccttacatatactatattaaatcatttcaccatatatccatttgacagtgaccaaaacacaaatagtcttgatttcccactctcacacccctaaattacaagtacaaagatgatttgaccatgtcaccttcagcatatctttaattctttggacttttccctcatgctagctgcctcatggttgtaggatagttgctgcatctctggacgttacattctcctttgatgctggaagaattggtgagaagagcatgatgagattttttgttttgttttttaaatgagaggagcaaaacctttcccaggaatcttctcttcctactatacttctgcttaggtcttattggctggaattaagtcccatggccactcttagcagcaagaagcagggaaagtggaaaacaagattatcatggttggcttaaacctgcacattccaatatgatagttactagctatatggctatttaaatttttttagagagatataattcatataccctaaaattcaccattttatgtatacagtatagtatttctagtatattcacaggattatgcaaccataccccagtatccgattccaaaacattttcttcgccctcaaaagaaatctcatatccgtagcagtaagtcctcatatccctctacacctagccattggcaaccactagcctactttctttctctatggattttcctggacattttgtttggcttctttcacttggcataattttttcagggttcatctatgttgtagtatgtgccagtaatttttttatcagttcctgttttaattgataatactctgttgcatggatgtatcctattttgtttatccattcatctgttgatggacatttagattgtttcactttttagttactgtgactaatgctgctgtgaacactgattgatgtacaagtttttatatcaacatagttttgatttttctttgaattctcttgagcctattagaaggagtggaattgttgggttttatggtaacaccatgtttaaccctttgaggaaatgtcaaactgttttccaaagtggctacacattttgtacatcctggtaggaacatgtaaggattccaatttctccacatccttgtgagcacttgttattttttgtttgtttttattataaccatcttagtgggtgtgaagtggtatctcattgtggttttggtttgcctttatgtaatgactactaatgttgagaatatttaatgtgcctattttccatttgtatatattctttgcagaaatgtctgttcagatcatatgcccattataaaattggattgtctttttattgttgaattataataggtacttaaatttaaattaattaactttaagtaaaatagaaaacttagttcctcagtcatactggccacatttcaagtgctcagttgctgtgtgtggatagtggctatgttattggacagttgcagataaagataatttacatgattgcagaaacttctgttggacagcactggcttagaaccaccatgattgatcacttatagctgggcatatgacttctctaaataaaattgaggttttgttaagctaaggaaggattggtactccagaaagagtgaggtgtcctggtcccagaaaaggaggttatgcagactcagtgtataactcctaaagatgcatcagagtttaccaagggaagaactggggcaggggttgagtgggagggcaaaattctagaccagggcttggcagatgtcttttgcaaagggtcagatagtaaatattttggctttgctgactatatgatatctgtttcaactattgaactgtaaccaaaaagtgtctgagacagatttcaatcgatttagagaggtttattttgccaaggttgaggaagcacccgagaaaataaacacaagttacgttaggatctgtgactggtgttttgtccaaagaggattgtgaggacttcaggatttaaaagggaaagagtgagcaggaagggaaggaggaaagaaaaaaaaaagtttgaggggcataggcgatgaggcaagtggttacattcttgtgaggctttgattagtgctcaccaaatccacagtttacatgtgaaaagaggagtgggggaaagtcatttatgctcagtaaatctacattttacgtaagataaaggaagcatgtgaagttacagcaacccatttgagaacaaaaggatggcagttttttgattttttctttttttgtgtgtgtgtgtgtgactcagttcccaagcttaacttttctctttaacatagtgagtttggggtccaaagattttattttcctttcacacaactttgtccttatagtgaaaaagcagcctaagacaggccataaatgaatggacatggctgtgttctaatggaactttatttacaaaaactggcagcaggcacatttgggctacaggccagggtttcctagggacaatacatagaaaagtatggaagccagaaggggcctggcatactgaaataaagagaatggtaagacgtttggtatggctgaaaactggctgtaggagctatggctgtagagaaggctaggaatagagactggaaccagattataaagggtccgcaatgcatatcaatgttgttttgttctggttggtggtggtggttgtggtgctagtggcagtggtggttttctaaaatcctctaagtggcaagaagccgtcaaatatttttaagtaggacattatatgattatggctttttagacaaccctctggcagcattgtgaaaagaatattggaggaaatgaggctagaggtaaaaaaataccagttaagctttgtattttgtattaaaataaagatctggtaattatcttgctaattgcatcagtagagacatagaccaccaagctgataattcttatcctgactaacctactcactatgagctgagtaaaaagcagtattgatttaaatgagttatgaagagtggggcttggatatgctctttttatatcccaggggaatcaccctggaaacctagagaactggttccaagtattcatctgagaacatctgtgactctcagaaagttatgagattggagttgtacggggaaactcgctgtggccttggaagagttgacttctaaatggggtagtgaacttattctccgtggctcagttctaaaaggccctaagaggagaaaaggattcttgatgaactactaattgatgattttaggtccagagttaagcataatatggaggtttgcctgagagtgtctgccgtcagtgaagatgaattatccatgtgggcttagaaaatcacacatgcaaattatgtgtcaatggatttttttttcaacatgctaatcctagcctttgagtacacagcatattttcaaagccaattttgcaaacaactctatggtaaatgctgctaagctgttgataagttggctttccatttgtaagcctattagttcagaatcttctgaagtttaattcaaaatgagataatgtgtagtgatttgacagttttcattctgtgacgatgctcttcaagaaagcatcttggcttgttcactagttgaatcctcaccagttcctgaaattatgaaatgtaaatttgttataagcagccgctttgggcccttcacaaggcagaattgtaccttatccctgagtggaaataaatgaacatctcatgtgtgtagcttctctctctctgtacatcctgactccaaatgctgtgaggcaccagaaaatgtctcctgaatctgattttgggtggctggatcaatgtccagagggaattaggaatttttccaatggtggtacagatagaggtgataacattagaaaagactgacccttgacaagacccacattagtgaagtcgttattcccaaggagttgggtatgtacttcccacgtgttgtgaaaacagggctctattaccttgccagcaataccccaaaggcagaggctgtatttgtccttggatctcagtctttgacattgttttgggaaggtatgatgagaggcatgaggaaacctcatccattttgtgagtccagtgtacttaaacggtagagactgactccagggcatttggagttcacagaatttgtcaaattatttttcaagcttgtagggttcaagacttccccaaatgtatttttccaagtgcttgtaccctggtgtccattaagggaaatgtactccatatgtttctaattcttctaccctgaaatgatcaaaatattatattgctgagatctctgaagactagaaagatccttttcaattttttttttctctttgatgacactaacagaaatgggtgatcccagtaatcacaaagaggctcaaattcactcccaaatgcccggccaccaagaagctttggacataagtattttttgggggtatttgtgccaactgctgttttaggacatgtttctgataatgctttacacttaccagaaaagctgtttttgaaaaatccagtgttgtcttacaatcattaatttaaaaaaaaaaagtttcccaagtattttcttagagcaaggagatctctttctgatgaagaatacactctagcctaaaaagccacttaggtggaccagtttctttgattaacaaaagttacaaaggggaaaagaagagtgttagagaggatacctgtaacaaaaagagacaggagacatatggaacactcgtggtgtgtcacccttatttgaaccctcattcaaacaacaactgttaagaaaagtaaaacataggaggcatatatcaatacagaatggctatatgatgatattaaggaattattctttttaattatgatattgataattagctattttttgaaagatacctccttttatagatacatgctgaaatatttacagaaaaattttttaaaagcctggaatttgtttaaaaagaatcagggtgtggtatagttaaaactcctccctccctccatctctccctctccccctctctccctctccccctctctccctctctccttttctccttccctcactcccttttcttcttttttccctcccctcctccttcccctcctttctcccccactgccccagcttctcttcccttctgttctctttttctggccttcatttgggctgacaagaagaggatgcatgttttatatcaggttggcaggtatacttgagatatattgtcttggcaatacaaaggcctgacacttcctagggacccagatgggtattgtagatgtttagggcatgccttgacctctgagtagccttcttgggcttgaggtctcatttgactagactaccactccacagtcagccactgtggtctgttttttaaaaacgttgccatgatgagaatgtgaaggatttgggttgaagttaaggacacttcctttttattattagtctggagttttaaaggagatacctgggatcccacccttactttgttactttgatttggagtcagcccttggctttgagagtgtgctgtgatattggtctgatttaatcattgcctatgtagaaaaagagattagatcactggatcccaaactagcctcagaaagtaagtcattgatggcaagaatcacctggagagattttcagtttaattcttaaaaaatttagtgacgatacttggataaccctctgggaattctgattcagtagtcctgggtagaaatagaatctaaatatctgtaattttatcaggtttctacacgattctcatgttccaatagtttggtgatttaccaggttcaatgccttttaatagattcagttgctcaggagcagattgaggttgtatttccatatagtcctaccttgtaaaaaatggatgtgtcaagttttttgttggtgttattgtttttaattgttattttgacttgctgggctgggcgtggtgattcacgccagtagtcccagcaactttgggaggctgaattgggtggattgcttgagcccaggagtttgagaccagcctgggcaacatggaaaaaccgatctgtactaaaaaactggaaaattagccaggtgaggtagtgcgtgcctttagtcccagctactcaggaggctgaggtaggaggactgcttgagcccaggaggttgaggctgcagtgagctgtgatcatgcgctgcactccgatttgggtgacagcgagaccctgtctcaaaggaaaaaaaaaaaaaaggttacttgcttatgaataagaccttccatatagcagttattatataagcactaggtaaatattaataaatggcaaatactaaaaggaaagacaggaaaaggaaaggcaactgatatttattgaaggcctactattatagtaaacttgactcataatttatattttcttctttaattttaaccttggcatgcaatgattattacccaattttgtattcagtaaaattaaagcccagagaagtttagtatttttcctagagtcacatagtaaacacgtggcagcaggggtgtttggatactattgtgccaggcagcctttccgaacactccagcctatttctcaattctttcttggctccagaggattgtgtagcaggaggggaaatctgttcagagatcaggaaactggaccaattgggcaagctgccagagcttcctttactggattgtaccagcaagtttgtttttctctgtccaatactgggtaaaggtcccaccgaaagcctttgtctctgctcagaatgcctggtatgatctctgggaaactatttggcaaaggagtgtggcagctgaagcacagaagcctctcctaggtggttcacccatatctgatttttttttctttggcaccttgtaacagacctgagaatgttgaaattttgtgccaacgtggacaccattcagcatgtcagatttctctgataccgtgaagatcaatatgttggatgcaaaggaaaagtcccagcaatagattccagccctcactgccacttacctggtatattacaacagcctccatactggtcttcctatctgcagcctgtcctctgctttccggcccacttttctcagggggatcctctttcaaataaaggtctgattatgttcctccaatattaaaccccttcagtgactccccagttcttgaggaaaaaatgctgagtctctgagcatagcactgaatacccttcctggtctggccctgtttctccgcatgcttctcccactccacccagcttctggcaggtcatactaccgtggctcaccaaagatgccttggaaaccaggtactttcatgtctctgtttctccagctggagtttcgttccttctttgacctgcctggcaaactcctatgcattctttgattcctactccttcatgaagcctttcagcagtttctttcttagcacaactctaccaccttgtctcacctgttcacagacatctgcctgcctccctctctaggctatggtgccctccaaggggaggcaaggtgttgttttcaaatcattcacagtacttactacataggccacttacagtcagtgtgtaataactgaaggaggacttgagtgaataggcaaataaagatggttaccatgataggccgagatctgaaaagaagctaataatcaatgcatgaagatgtgtgaggaacttgtgtgtcttcagtaccattctaaataccatacaaatacaggtgccgccagagtgcttgcacatggcagcttcacagcccatttgagaagtagaattaatacatgtgaagaatgaggccgggcactgtggctcacgcctgtaatcccagcactctgggaggccgaggcaggcgaatcatgaggtcaagagattgaaactgtcctgctcaacatggtgaaaccccgtctctattaaaaatacaaaaattagctggacgtggtggcacacgcctgtaattccagctactcgggaagctgaggcaggagaatcgcttgaacccgagaggcagaggttgcagtgagccaaaatcgcgccactgcactccagcctggcgacagagtgagactctgtctcttaaaaaataaataaataaaataaaagaatgagtaagaaaaccaagaaaatatgcaatttagttcagcttgtttggtgctggtaatactttatttttcatgtgtcgatttttgatctccaccttgcactgtgagctccctgaggacagggactttgtcttggcaattatgtcttcacacttggcatacagtcagttttcaagatatgtttgttcaatgaataaatggatggtaggcaccattcagtgctgtttagggtcaaaggaaggcatgatttgtgtgggttgaagtggtcaaggagggcttcacacataagccagttatgaaggatataggcattgaagaagcactaaaactggttgtgagctttactcttcagagagtcacagttttagaaaagctcttgctctattggaaagaatatgggttttagaccaaatacatctagaatcaaatttggactctttcccttatctgctatgtgatcttgagatctctgagtttcagtttccttgcccataaaatgaaatcaatattacttcccttagaatatgcttgtgagccgtaaaagcgatatcatatataaagcatgtagcataatgcctagcgtacattaggctctcaataaatggtaagtaaaagctgatatataggtatagtgtgtctgaaatacctgggaaacatggattatttggatgacgtagtaacatttgattaaatttgcatgattattatattggcacataacaattagaattataatagattccagtatttttatggccttttaagtgtgttttggggatttctatcacatttctttacttttttaacattggaaaattggaaatggatatttgcccccaaattgtctgatatatagatctcgcccttcccattacacttgtgaagggaaggcttttctggcaggaggagcataatgcgtagaggagggaaagggaaatgagctttccattttgggagaaaaattagagctactcttccagtgacaaaccgcattgcctggctttccttctgcaggctctgcctcatgcctgtgttcctatagacattggagttaaagctctcattcatggtcatgattctcgcctctgtctaattcttttactttgtcgtgtaccatctctccttttcccactgttttttccagccacctctgtttcttttggtttccttgagcatgtcaagttcttttctggcctatgttctttgaatttactgttccctttgacagacattcttttcctctggctcttttcatttttcagaaaatcagctgactccttaccctgtggtggtattggagccaaataatggaattgatttttcagtgtttattccacataattccaaggaatatgattttaagagtgttcacaattcatatttttttttaatttttgaaattgaataagtttcaaatacgaaaatttaggaacatgatacaaaacttttctctgtgcaccactggagtactgcttttgaaatcaattctctctgtcctggattacccttagagctcctgtctcctgcatggaggagggtggagggcatttaacatgtccatctctcaccccattctacctgagcttccagcaccaccacctctgggcagttccgcttttagtcagcagctcccagttcccataattttgacttctgtccttgctagtccagaagaaatggctcttctgggattgaattcctccctttccccagcagaaatggattggggcagaggaattgcggagctccatggcatagagggtcctggaaggcttgtcattagggtatccagggtgggaaggggagtgaagggaggggaaggaggaaggaattgagttgggaagagtcaaggaggatgaatgaagttgctgactgatgtctggaataacattatttcaccctcaaaaataccagtaattcaggactgaaaaataaatttcacaatatgttttaatttcaaaaagtgatagtgtatttgacattcttatccagcctggtctcacctcaggagttcccccattggagaggccatccctgaatttctaactcacaggcctcccctacgttaatatatttatgtcctcctggcccttgtttactttttacttgtttacttttgcttttgtttacttgtttacttttgctccatgaagtcagggacctgcctgcttgctccgcaatccctagaactgtgtctagaaccttagttggttgcagtaaatatttgttgaatggatggatgagatggttgtagcaatctaagttgctttggatgagattaacactgaaaaaaaaaaaaaaactggttgcctgcaattctgtcagccagtccaggcaatgctaatacagctttgattattatgatcatgattattattttgttttgaaacctttttcagaggccaagcatgctggggacttgagggacataaaaatctttcaactgattatgccacctgcaaacaggataagcctgactttctacctcacccacctcttgctatcacagatatgaatcaacgaacacacaaaaaaggttttcaattctccctttggaaagagggcacatttaatattctgagtcaggcaaggaaagactctagccacaaagacagctgggaactcaggtccatagcaggcacccaggacggaggtgaagagaaggcgcctccctgtctggtgacagcagctggggcccttgctgcctccctccccacaaaaatccagttgggaccagtgcatgctgggaatctgcctgcctgacagaaacagatggcctcaggtggtgactgatctcttggtgacactaactgcatagctgctgctttactcatgaccgaatgagacacgagatggcggaggtaagagttggttaccttgccgtctcctcctcagctgaaatgactcacattgctgtagcttaaatttcagtccaggctctctggactcggggaatttctttttgctcatgctcctgagaaccagagttctccaggaacatctgtagtctctgtcttcaatcaaagcatttgagagatgctttatttttcccctttcctctgtacctgtcacagaagggggcctgtctgaataagatggcacataatctgctgagtgcagcaacccctctgtgcagccttgaggaagaagacaaggcagtcaaagtaccttccatcatttcctggaaaatgtgtcggtagcttggagaggcagagtgggagatggaagtaacactgcatgaggagttaggtggtctatgttcaggggccagggttgtcacttactagataggggacctttagccagtcacttaactccaatggccttctgcttcatatcatctcttatgtagggtggtgggactggattaaggacagcagatagattagctgtcagtcttactgattggaagttgctgtccagagtacagtatgggggatggctgggaagcccatctcagctaagtgagaaagagcagtcaactattggtatttgccaagtgtgtgacagtggcacatctgcctgctattatgagacttgatggtcatttctgcctctgtggttttatgattccaagtgtcctgcaagtgattctagagggatcatgaaacattttctggtcttaataattactcagggatctattaacaatggtgaggaacatactcacaaccagactttcattgagagtttaccatatgtatattatatcacttaaccctcatccttacggatagggaggctcaggctcatagtgattaaatgacttgccaaggtcactcagctaataggtgatggagctggaattcaaactctggtctgtctgcctccagaaccgaagcgctgaactgccaccctatactacttcccagttggagaatacctcagtacagtaattagatgccagtgtgtatggctttgcctatcagtacacagaaatcagaaaggtgattgagagattcattaatgcctccttgcccagttcttttgagcatatcttatttgagaaaggtgcacgtgaccttgggtcagtttgtctaactctgtcagtctcagttatcttatttgagaaatggggctatagcttttaagttaataatccagataaaacatcctatagtgccccagatgtcagtagcactcagtacatgttcatattatgttgccccaaggtcacgtggctgggaattgagctgaggactgcccacctccgaagtctatgatggcaccttttggttttggtacaagtgagtcctgagtggaccacatggcagcattagaggtgcttttgaatacgaaaggtggcgtgaggatccctctcacttatgtctgttctgttgtccagaacttagtgaaaatcctggtccttacccgctagagtgaaaaaggaaggaaaccttaccattctttctgtgtacctttctctggctggggctttctctggtctaggtgtgctcagcaaatatgacaagtagcaggccactcattttgaccacgcccatgtggcagacagctttcttcactttcacgcaaatgaagtacaagacaatcacatgtatggctgcactgaatgtaaaagattaaagagaagtgatatgccaaatagatgactgggagttgacgtttagcaaagtaaatctcttggtggccctggtaaagttaatttcaataattctggttttttttttcatcttagaaacttagaggttaaaaaataataaatatacatgaggagatttagagtgtatgtggaaacagagatcttcggaggacaagtgggatatttctttatagaaagagttttccctcttgatttttttgcttggtaagtttctttcaaatcaactcaattcatttggtgctattgcttttcttttgtgaaaacgattctggggatttgatcaaaaccgacatgaaaatacaaccctcaaatggtaaatatcagggaatctggaatttgcattttctaggctaaagtaatttactggccaagtttgctgtctcctcactcccccaacacatgtacaactcttaaatctcattcccctttaggctccttctctctcagtttatttccagcacacatgcatatgcatccatgcatacacaggtgtgcacatatgcatgtatacacacacacagacacacgacacacacgtgacgcacatattttactctgtgctaataaataggccagtattggctaggctgggcctcaggactgtctggtttaaatctaagctgcctgggagatctggagtaataagtgagtgacaacaggtgcagattttgttacacccttctgaactcagcccatagttctttctttgattcttttcacccaacacccttgcttcaattgtgtccaataaattttatagctgcatgatcctgtttcagagctgaagggagatttttccctccacttggctaaatggtgcctaagtcaaaacaccacttcctgccccctcctcacactttaagaagtaataaggaataaaccccaggccataagctgttgctgggtcctgtatcttcagttttgcatgtgaagagctaattttctggtcccattttagaaaagccaagaattaacttgcagagaattagccataattggggagaaaataattacttggctttttctgccctgtgataactggagccactggcaaatctttcacagcagtgtcaacgcctacttctgtttaaaacaaagtattgcaccaggggccttgaaagtcacatctgaatgttctctgtggtacattttggtccaaaccaccctgaatattggagttggattcatttcatgtcttttttggtgtaaaatcccggtgcagggagacatttcatattacactggaagacatgaatgtcttttgcaggtgtcaggtatgctcatgggccctgcatgcatacttaaggttgggtccaattggatttttttaggagcagtctgtggtctaagctgagaattttttctcataagggcccattttcctctagcatttttctgttttgagactttgcccagctgcctctattccctagtatgtagacttaataaaaaatctcttggttcataataaacatggaaaggagatggtacacgttttccatttgctagtagaggtttacctgaatacagttggtcatatatctcagtgtcgtcagagtacaacaaaatgtcatgccttcccatgatttcagacaccactcttcagtaatgacttatctgaatatcagccctgtacctctcctgagctccagccttaagggcacacttttcattgggtagccctacctgctgacccatagacaccctaggctcaactcattttccctaaataaatttgcttttctttctgtgttttctatcatggtaaaggtgctgtgatccaataactcaaacaagaaaccttgatggcatgccttccatatccattactgttagctaagtgggggacaatctatatattgcctcagatatcactgggatccattgccctcctaactaggctccctgggtccagtcatctttgcctttcctccaacttctcccccatgtcacctacctcctcttttctctacccccaccaaaacagtacttcatacatccctagtattgtctttaaatgtaaatctgatattatttaactatttgaattctttagtaacatcccactgctggcaggaaacaagtcctaacttcctagtataaggaatataaggtccaatgtgatccagctgctccctgactctccagtcttacctcctgtcacactaccatggatcaagccccatggttccctttattctctttcaactctgtattttcgcatatgtgactttcttctgctagtaatgccctttcttaattggcctgtacctttgactcctacacttctgtattattaggctatagcactagatgtggcttaaataagttagattatttgtttatctgatagtccggacgtagatgctttccatgagatcatccaggaacccaggtagcttctgcattggactgtgcttaacatgatgcccctttctgcatgatccaaagtggctttcaaccacagcttccttcaaggcagcaagatggagaatagatgaagaaggaacacaccttctcccttttggtgctgtgactaataagaaatatatttttagtttctgttccaggtttgtgacacagagctcctaaaagccttgtaatttccagagtgatcaacattctaggagtatcttttgttgtactatttagactttgactctggttcctaacagagcttctaaatcccttggggtttcctaagcgatagagcatcttttgctttaatgaggcgactcttgggctcctggataacttcagaatgggagttggtcagaatgggacttggtcactagaaagaccatgtgatggatagcagctcagaattttcagccctactccccacatccacccaatccaccaggaggggagagaggctggagattgagttaataagcaatcatgcctgtgtgatgaatcatccctaaaaatccctgaaagatggggtttggagagctcccgggttggtgaacaagtggaggtgcctggagagggcatgaaagctccccaccccttcccacataccttgccctatgtacctctttgtctggctgttcatttgtatttgtattctttataataagccagtaaatttaagtagagtgtttccctgagttttgtgagccattatagcaaattatcaaacctgaaaaaagggggttatgggaacctccagtatgtagctgatcagtcagaagtatggaaggcctagacttttgattggcatctgaaatgggagcagtcttggattgaagccttaacctgtgtgatctgcccttactccaggtagttagtttagaattgaattgtgggacacctggttggtttctgaagagttagagtattggttagtgtgggaaaatccctcacacacgtgatgtaaaaattgtcatgagtatgcagaaaaaagtttttcccctttagtggcagtttccagagtttgtaaatatctctgcttcccaatcttttgtgcctcctgtctgtctggtactccacctctgtagtaatggcagcagcagcaattctagtagtagtcacagtggtgtttctctagtagaagctgtaatagtagtaggaagaagaggtgtaggagtagtatcagtatcataatttcccattcctagtttcagaagagattgaaaggctaagtgacatgcctgaggtcacatagttaataagtaaacggcaaagctatcgttctgactgggagctctcttacttcagagctcaccactagactgtgggtagttttcaatccagtcacactaaatgccagttatttccttacatgattacctctcccacaagattcagaacttcttgaggaaaaggacatatccaactgacctttgtatctgtagagcctagctccaaggctgggcgtatccatcagttttagacattgaaatcagggtttcttaaccttggcaccattgacattttgggccagataattctttgttgtggggctgtcccattgtgcatgacaggatgtgtggcaccatccctgacttctacccactagttgccagtagcacatatccccacccgcagccagataaaccaaaaatatctccatgcattgccagctatctgctgggagacaaaatgtccctgattaagaaccactgatttaaattaaatgaaggccaaggagccttgagtagtgttcatatccgaaaagggcattttcagaattgttcaggctgctggatctctcaaagatgatgatgtattttccaggcctcatgtgtctggagcacaggttgcctgtggtggtggctgcaatgatctcagtgtgccaggccttcacggggaataccagagagggtccctctggagcagctcttactgggtcatggagaccatctgtctggcatggtaccacctggcaaaatctctttgccttaaccaaaaatatgcttttgtaaatttcctggcaaagcaggggctgcattctgtttcctgatttctctcttttatttccagatgtgtcactggtgacacatagagcccaatgagaactctgttggaaactcaagtttctcattcttcgccagctccgttgtcatgattttcccaccgtctaagccagtgtaggttacgttacccacgtgctggttagtgcttggatgtcagttttcctttttaaattctagatctgtagcatgctttagggaggaaactttatggcttattacacaaatggagttaacccttccctgctttgcagtgtttttgttagtgacagagacatgaattcaagatctgccatttattatttgtttcattttggacaacatgcttagcttctttgatccttgatttgtttaccttcaaaacagagtaacctacctgtcctgtctacctccatgggattattattaaaacacaataagataatctgctcaaaaggcttaaactccctagtatgatttactatcagtataccttttgcacccaagaaaactctacagtatcattgttcatgggcaccaaattgtaagttcagttaaggcagactttgtgtctttttctgccagtttctaggacctagaaggtattcagtaaatatatggtgaatgacagtatgaaaaaaattgggaagtcagattctgtggttcattgtaccagtgggggctggagggaggtaagtgaatggtttgtgtggctttgtgtcatttgtatttgtgacagacattccaagcaatagcattttcaagggttcacaagtgagtgcctgcagaggcaggacacacttaacactctggcagatatgcgacaagacagggtagggaggggcccaagggaactagagagggcatacccagctgtcttagtcattttgggctgctattaaaaaatgccatagactgggtggcttataaacaacggaaattatttctcactgttctggaggctaggaagtccaagatccaggccccagtttattccatgtctggtgaggactcacttcctggttcataggtagccatctcctctgtgtcctcaaaagacgggaggagtaaatgagctttctgggatccattttacaagggccctacttcttcatgacctaatcacctcccaaagccccccccacctccaaataccatcaccttgaggattaggtttcaacacaggaattttgagggggggatacacacactgtctatattgccaacctaaagacattcacagttacacattttgaagtctctgcatcagctaaacaaaatatgtctttgggccaatttaagtcttcagacaaaaatttacaactccttattgacagagtacctaatataaatactgggacagatgcggggcagataaagatgaggtgctcaggatccggcagcagtgatagacaggaaattagtgagacaatgagaatatccaagatacatggagagcttagcccagcactgtccaatgtcctttacaaatgacaacttgtatttaatcctcacaacagcccaatgtgagttagtggatattatgtcccctgttttataatgaggaccctaaggcacaaagaggttgatattttgccagaggctttgaagccagtatctggggaataataaaatgcaacgtgtatgtccaatgacaaaggaaacacagaagccccctcttagatctcactacttctactcctgcccctccagcccctccatttgaagatccctgagggatctgaaaatgcaactttgatcgtggcacagaccagtcctgaggttggtgcagtgacatccccatgccacagaggccctgtgccttctggacgctgcctctcttgccagccttgcccgcccctcatgctctatgctccacttcacttgcccagacagacaagcactttgcccctttgcagccactctcccctttgcctgtgtctccttgttatgcagggcctttcttattcctcaggcctcagatcaatgtcacctcctcagagtgggcctttgctgcccacgctgcccaaagatggcctactgggtcactttcttctttgccacttgcttatttccttcctcacgtgtgtgcctgcgtgtgtgtgtgtgtgtgtgtgtgtgtgtgtgtgtgtgtgtgtattttctgatgcctccacttgactgtaagctccaggagtgcaaagatttttgtcacgttcactgctgcatcccattgcctgagacagtggccagcatgaaggagatacacgagaaagcaatgtgtgtgcactgagtgagcgagcacatgggaggagctgacttcatggggcagattcagtcagagagactgtggctggcctggtgtcacattggtgagaagtggcacagtcgggatttgaactgatcatgacagcatctcgcttgaatcccatcattgcctccctaccgcgctcaggttggactccctggtgtttaccatggacaatgaatcttgatgtctggcccctgtagcacttctagcctcttcaccctcaattgtctgcacatcctcccttgcccctttctatctgcactgacttcaccgtccctcagtcaccccaccttctttctttccctgctcttccttatgttctcttcccacggcaggcaccctctgcccttctgtttcatggggctgtctcttcattgtccctgaaatttgaacttcagtcctcctccccccgcaaacttcttccaagcccatggactagactagaaccccctcaagtgcccctcattgcatttatcatggttgtaactctatagttatttttgtaatttattgtcttttctggcttttctgcccatggcccctacaacaacagcatgttcatctcattcttcttctgccctggctcgttaggtaggaggtgcttacataaacgtttgtcaaggaaatgaataaatgaataaataaatgaataaattgctggatgaatgaatgagagtaagtgaatgaagagttcctgaatttgcttttatgccacctcccttctctgggaaatttcacacaggataggatttctctggcatagagcaacacttctctttgtagatctcagcctgtgcctggagactgggtaaagttgaatgacggggtgcaggaagccttgtgttgtcttgtcacaacacaggaagggaaagtactttggcttttactgttgtaaataggactaaaagtagctcttcgggggtgatctttgtttaccactgcctaaggccactgtccttggagaaaggtcaggaggtgggtgtttacaagttctgtccaaactctcccatgacactatgccacaggccctcatttccctgacccattgttaattagagcagaggaggaacttcagatgctgagtttgtctttgaagaaggatccagaccctaggatgtcatcctggagactttgctcttccttatccttcatacctggtcctccaccttcctgacagtttctcttcttcctcatggttattgggagatagaatgggtggcagatttttattgtttcctgaggagccctgtgctttaatttccattatgtgtgaagatgtctgccatgaccaccaggttgggtgttctgctagattggtgtttgggagccagttgtagacagagtcaaccagaatataaaaagtgtgagtgcagagataaacccactcctgccctataacgacagtaacaaaactggcccagtggtagagctctcatcacaggccaggcactgcgctaagcacgcagtctgcacccctttagactggcccattctctggaaagtttcaaacatacacatcagcaaagagtataatgaaatcctgtgtacccattacgtgtaggggctgaaaatgtatttgccttgatcctgctttcaaagcaatgggtctagtgactgctttgggggaggagttagggaagtgcttaactcatattaacactgatattataaatttacagaatgcagctcgctctggagattatatctggttatatatgtgcacatatcagtgattgctatagtcccctggtaaggggatatatatttaacttaaaatgttctgtttggagtttttacataaatgtcactaaatacatgaatatttcagacccccttcccagtctagagtagtattgggttaagggaactaactgttttgagggaatctgagccaatttagtctggcaggaaaatcatgtagtgaagtagtgaggcccacatggcctctgaccagtcagggagagatactgaagttttacaagagaccatttaatgagagattatccataaaacttgatgcacagatttcaggagaagtctttttagtacttatgtgtgtgtgtgtatgtgagtgtttaaatgtggcaggctaaagtgaagaaatacgactgctactgatagtagctattgtttattgagggccagtatatgggtcagttgctgtgccaggaggtcctttgactacagtctattcctcaccaaggcttttagttcattgttattaccaccattgtagatgtgagaacatggagagtttcagagagttgcccaagactattcacataacaagtggcagggctggaatttcaatccaagttagcctgtttgcaaagcctttgccctttccattagactacatagcatcttaaaatattctggctgcttacttgagaggtaagtatcagttgggaacttactcacttccttctttgtttcaatatacaacccagaatgctttacaaattctgcagaattagccagtgctcatgtttaggcatatcatagattttttaaaatggctaatgttgctgttcctctccttgtgctttggaaaaaattttcagagtccgatacctattgtgacaacttttctaaacactcaaagtgccaagttcatcttgttagctgttcttccaccaggcaatcaaaactcatgttagttccctgtggattcattatagtccccgggaaaccaaaagttttgcctgtgtttggcacataccagttaattgcctaaattgtaacttctgagtattaggaattatcttaaaaactaataccaaaatttggtatgatgtatttcaattgagggggaaaatatttggaaatgaatttattttgactctggggtaatatcttttgcttcacatttagaaatttacatactgggttacttccatgacctaaaacaacttccaagttttcttatttcctcagtacccctagctttgttctggatgaggccagtctctgttccaacgcatgatttaaatatacacggttctgcatctttgtctataatgtttataatatttactatctcatgaattttttatatctacttcataatctactctctccctctatttttccttgcacttgacagcccaactggatgttgtctcttaattctttgtcacttcatggcagtttataattctttaatgttacttattatatttcagctacactgcagtaatggatgggcccattttctctcctccagcgtactgaatgggactgtgtcttgtctccgtgtgcctgacaccttgcatggaatttgcacctcatagccgctcaatagattttaattaattgaaatttaaaagggaacttgtgtggttttgtttaaacaagaccataaattagaaacaactattttcatgaatttgaaattcccagaaacattattctttaatactgtacttttgtcgagactgaagagtttggctttatagtaaatgaaatgaatcacagaatcattgaaccagagtaacaacaatactaataaaaacaccagaaatcatctgtgtaatccattcctctctcttaatgccagacagttccccagccaccttaaaatgatagaactctcctttccttaaagatccttttaaagaagactgtcatcttttcccattccacatcatcatgtcttctagccctacaagttaggcagcttctcctcagatgatcgaaaccctcccttactgaaatttatgcttattgctttcataaagatgaaaagcagctgcttttaactgaaaatagttctcttcctaaagatggttattccattattccatatccttctcttccctaggcataattttcctttccatctgacattcctttttgttctatatttccaaaccattgaatactactctctcaacttacggttttttgcctaagaaaacttggactgggtgtgattagtaagtgatcgttgattttagatgtactgagaaatatgtctcacaccattaaaactagtcgatccagccaggctggtgggtaactggaatactgtgacctcaaatgatatgtggtggtatcttttaaagcctgccatcaaccattcccatctcagtttctccagttgcttaatttataagacataatttatttgttataaactgctttgcaaggttcaaaaaaaaaaaaaaaaaacggaaatgatacacaagagaattagattgaatttaggccattttttccccctcatatctggtttttaaataagccctaagagtgctctcaattagaaaaacacatggtaattctaaaggagataaaaaaggaacatgtacactccaagtgcacttttatcttttcatatttaagaaaccccacaaagctccttcttgcaaattaaagaggatagcaagcaggcagctttctttcctcatttagtttagcaagcatattgatttacatttgagtaggggcctctgatctcttttgtttgtgggtggctttgtttgtttttaatatgaactcatttaaaaactaagcttatggactgagttgcaaaggtagagcttcagtccaacactcaaagtagtcttcctatgcaaaaataaaatagatatttatgtatgtggtagtaggtcaaagaagacatcagtgataactattgattcagtaaatattaaacatctactatgtgtcctccttactaggaagactaaaatgtagaatgtaccatccttgcatctagtgtgcagtgtagtatgggagagagaaataatttagcaggtgatcataatgcaataaatgctatgataggaagcaattaaggcacagtggaggggcgaataacacacctttggatgaattcccagaggaattgacaccagaaggtgattaggatttaccaaggttaagaaaggtgaaggtgtttcaggagtgcgttaccaagtacagaagtgaatggaagtgtgacccattcaagatactcttgagtttgtttcagccagagaacggacaaacaagggaaaacttaagtactctatcctgggttcctcaggatgcacactttaaggacgttttgcgtttttctctggtatttatttattgaagttctcagaacctccacagagctaatttctgtagccttttgtgctcccataaagctttatatatgtacccacatttaaaactttcttacaatactttttgcatttcctccatatgtctattttcccatctactctctgagctaatcaagggagaagacctagtactcacgtctatctatctgcagtgccatgctgagtgcttgcagaaatgtgtttgggaatcagtgcatctctctatgaatggctagagcattctaagtggttttgcttctaactgtgcaggagggcacagtttgggcccaatattggtttgcaaattcaagataagaaccaagaatttgattcttaactcaattttatgttgacttgagcaggctgaactgggttgcttatgccattatttcatttagttcggataatggctatcaaattagctgacaacccatctcagttccctgtagtattcttagcagtgtcttaaagtgggttttcatttgaacatttctttattatattttctttctcagaagtagccaagagatgatgatgatgttgatgctggggaaaacaatggtaacaagagcagctgctttttattgggtatgtgctatgtgaattaaccctgcacttaaccttttaatgaatttatgagataattactactgttaccttcttaacagatgaagaaaatgaagagcaaggaggatatcttactcactagtgaatgatggcttcaccatgtctgatccaaactgtactttgtaatgccttcttcatagcagcactaaaatctaaaagtctggaagagtctttaggagatcagttattccatttcacatctgggggcaggattatgcttgaactgaatgccttggtccactgcctgaaatgtatcctctacaacctttgtccacctggtgaactcctactcatatttcaggactcacaattcaagctgctactcccaagtgaagcttccttaatattcccaggtagagttgccctcttcctctgttgttcctcttaaatatcttgtatttcactcatgaaattcaccaatcatgcagagggtatgtttctagaggcagtttgtatagttgtgaaaggtatggactctgcagctaattgtttgggttccaactctagctctacccgtattagctaaataatatggtgctctcttcccctgacagactgttaatcccttgaggccagataatatttacaagaatttcttaaatggctaagtcacaaaattgtcatgttttttaccttaatagcaagtctgaatgtatcctccttctgaagagctgatgtattgtttctgctggtttctgcatcttgatccctgaaagatattgaaaacctaattttaaggccattttcctgtttgtttgtttttgtttttgtttttgtttttgtttttgttttccatttctgtttcctttccctcttttcctgtccttccttagagacaggacatcttgaaaggtacgaaatcttcaggtctgtacttctacttcaccaacttccttttaatgtttttacctctttgtcttgtgtggaaaatcttaatctgactctttctgctttgtgtcaaagggatactgttcatgttaaaattctcagctctgagaggtatgtgagtaggccgttccttgggtgatgggacagttgacatcatatctgagaagagcatcaccatggtgccctttacttatggccgttgtcatgatgacagtcatagccacctggagcacagtggcctgacaaagacaggaataggaagagggaaataattcgtccaacacttttgtattttgcacaatgggaaaagagtggcatcatttctagatcctaaaccaaaattgatagaaaaagaagactagaatgataagatctgctaaatattctcagggggttgaagtatcaaatatctgcagatggtatcactgagcaaaatcaaggagagcagtttaggatttttagtatgagggaaatgataatgcttttcagtacttcttagagttgtcagtgtctcataaaagataaagaatatttgttgagtgaccacaacttgctgggtactgggctacactacagtatagtatagttattactgagaatttgtagagataatcctagcttatcaaggaaatatttgttttataatttgttcaggtgcttatttatattgaagaatattctcaagttaagatgatttttttagatactccagaggccagaattaatcataaagggccctaatagccaaaaagaattgaaatgcactaggccaattggcagacactatttcagtctgctctctttcatcctttgccaggaattgtacattatctctttaaggcagagcagccttggatgaccatatattaatatgataacttgcttttccttgctccccaccccccaactagtggctttagaatagctttgctatttttcacttatttcttggcagtagcactagatcccaggcttaccgattatgcacactttagataactttgggtcagctcagtactgaacaaatggcaagtcaggaatgccattaagactgaagaatgttggaagataaggattatatagacaccactgtccttatacacactgtgttgtcctgtaattggataggccaaaatgagttgacactggaagaggtattttaatattggagcttataaaatgtttagaaatgttttcctatctgagtcagactgagataggtatgtatgttttctgtctcttctgagtgacactgggaaatagttatgattgggaataggccttggtaccaataacctcatatatacactagggtagaccttgcagaggaagctggcaccagggcatgggaccgtgaagcaaaggggttcagaagaactagagagtggtccaataatgagtcttcagatggccagaggcaaaggctgagatcaagcctcaggtccaagaagccagaatcataagcctgaaataattgagtgagaaacccaacattactagaatggagaagaggctaggggaaaggcaggagcaaacccaagggctgggggtctgaagatgttaccatcacaaggcagccccattttaatggcctctagccacagggtttgccattaaaaactgtaggagtagacagatgcttgatggaaacccttgaccccgggtctttgctcccttaatgaaggaatctaaggcaaagtagagattctttttttaacatttaaactttatttttaattgacagataataattgtacatattcatggggtacatagcaaagtttccatacatataatgcatagtgatcagattaattagcatatccatctcaagcctttttcatttcttcgtgttgggaatgtttaatatcctctttctagtgatgagaaactgtataatacattattgttaactgtagtcatcttacagtggtatagaacagggctccccaaccccatggggttctataccactgtaggatgactagggttaacaataatgtattatacaggtactggtctgtagcctgttaggaatctggctgcacagcatgaggtgggcggtgggctagtgagcattaccacctgagcatcacctcctgtcagatcagcagtggcattagctcctcaaaggaacaggaaccctattgtgaactgcgcatgcaagggatctaagttgcacgctccttatgagaatctaatgcctgatgatctgaggtggcacagtttcatcccggaaccttcctcctcgcaacccccacccatggaaaaattgtcatccacaaaactgggtcctggtgcccaaaaggctggggaccgctggtataaaacagagtttatttctccttatctagttgtaattgtgtatcctttaacagatctctccctatctttttacatgtcctttgataccataagctctatggacaccctataatatttcttcattatacttacccttcatagtaattactagagtgagctcttcatggatttttctcttttactagactctaagctccacgaaggaagagataatatctgtgcctggtacatagtaagagcctaataaatatttttggaaggagggagagaaagagggaggagggaaataaatggctcttttgctccttttcttcatgccagggcaacactcagcttctgaggtatgcacagcaaggatcttgctgagatgggtgtggccacttgcttgcctcacttccagccctgggcacatgcagttctttctacctggtgcagtcctcttcctccctgctctggcacttgcctctgcttccacttctgctgctgcttctttttctagtctcctgcagcctaatcatcctcttgacacattctttctttaaccatctgaatgccttcagtatggttcctgtgagctctgaatgttctggaagccattgttttgttttgataattttgaatattttactcttgctcattatggattaactttacagctgaactctcaaaaccagacttcattttcccaacttgagagaacatctcattgttgtccctgtgtccttgcctatggcacacatctcccgaacacccttttttaccagaacatcctcacagcaaacctaaggcagctaactgctttctacagctctgtgtttcttgacctcttccatctgttttattttcatatttttcctttgttaaaaaaaggagataacagacaagaaaaacacgagaaattaaatacctcaaaattactgtacattttcacttggagtaaccagtctttgtaatgttttgtaaatatctttccctgagtgggcctgaataagcatgtagttaacaagcatggacttttaattgatcagggcaggttttgaacttctgtcctgctctttcctaatgatacaacctccaatgacttaacttctgagcctcagtattctcttctgtgaaatggaaatactaataatagtatcctcacaagtttgttgtgatattcagtaacccacataaaatttctatgcataatgcctggcgtataataggcactaagtaagctgtcacttgttttctttactttcctgctttctctcatattgcctctaattagtaccgtccttattttttaggggacagatccaaatccgtgaatccaggggcttcatcacgatcttggaatattttggtggcaactttaagatcttttgttttctgactcttagatctctttcttttggtggcatgggaaaattccctcaactcgattatttattcagttctttcatgctccccatattgtcatggccacgtttgaatcatgttatcggcaagtctgaccgaaaaagcaatttaatattgccctgtgttgcatcattgcatatattatttcagcctgtcacgggcctgtcagcaagtcttgatgaagtacagagccaatagtaacaggcctgaaatctgacagctctttaacagaagctgctccgattggtgcagtggtatttcttcagaaattaaggccttcttggtctctttgttgatacaattagcaatccaatctgagtcattttatctcccaatgagctgtatcttcagggctggtaattcagtctgttgcatggcttggaaaaacagagccatcagaggcctgtgatgtaccaaaggctgcagccaggaatatcttggtaatttatccccactctcagctctaattattctgttcttcactggctggttcgattgagactctccaggttcagccttccctaagcagagaacaaaaggtttcccttgaaagttggggcctggcaatgtcagtacagtgagctgcgtataaataatgcagcagtgccggcttcatttttataaaatcttggtggagaaatgcatgagaatgatcaggcccctggaactcagcaggcatgtgcttttgatgtgcgccttgctctgagtaaaagcaggagaataaaaagttcttgtttgtgctgaggctacttcatggtctctggctcggattttggtgaccctttcgctttgtttctgatagagtctggaggctcctacctaactaggaaaactctgatatgtatatagagggaaataccttcagtaactattttctgattgaaactaaagatgatgaaaataaagatggtgattatagtagctttacttatattagctttacttacattccctcattttaatcttcctaaggttagagttatctggctaggctattttctctataccttctgctctcccaattagccttatatcttttcttttttctggtcagattccccaaaaataaatattcagggtgtgaacctagcagccaaagctctgggagctgagtcggggaaaggagcttgagggctggcctgcaaaaaagcagatactgaatcagtctctttttgtcaagatactctacccttacctggaccttttatcgcaccctatctaagggtggatgctatggtttggctgtgtccccacccaagtctcaccttgaattgtagctctggtaattcccatgtgttatgggagggacccagtgggagataattgaatcatggggctgtttctcctcctgctgttcttatggtagtgaataagtctcacaagatcagatggttttataagggggaaacccctttcacttggttctcctcctctcttgtctgctgccatataagacgtgccttttaccttccaccatgatggtgtggcctccccagccacgtggaaccatgagtttattaaacctctttttctttataaattacccagtctcaggtatgtctttatcagcagtgtgaaaatggactaatacattggaccttagtacttttcttccgtagtgtgggagaagtagtaccctggttgctaatagtgaggtcacatgggatctaattacttcctaaacatactttttgtaccatctgctgtttttagcctcatttttatcctcactttcaggggtggtgagcaccaccacctcctgaactttttgggtctctgtagggtaatcattttgcttctgggtttttcctgctgctatttaggttttacctttctcaagtctaccaagagagttactactaccatggtttttggcttttagattttcgatgctgtcatcttctatcctgttctcattgtgggtttttgcctctttgaaacattcttgtacaaccattttgttggaatttttaaagggcacagagttcaacacgtgtagtcaatctggcatctttaatcagaagcctctttttgtttttgtactttttgaaataggaaagaaggtctgctagagatctggcatgcatttgtgtcttgggcagtaggtggtgggaggaatgtgaggtaggcaaaaccaggagagcattgttggaaggctctcctggttccattgaggttaatggtctatgcaaggaacccagtgttctgcttcatgcactccaggagtctaacttttgtctcttctccagcctgcatacagagcagtatctaaagatctaggctttataatagaagccattaaaaaatgattaggaacctgaaagcttccttctataactgagatctgaaggtttttattcattcacttaattaacatgcattgtgctctcaaaatttgccagagtagcattgtgcttattcatccatataactggatgaaaaaggcagatatggaccctgctgtgggaggttgtggcctgaccttatatactgaaatttccagaaggccagatagagcatcaagaaataaaataaaataataacattcttttatgataatgagatagatccttcagtgcctcctggtcttccccactcatacacactcatgcctaaaatagtccacggttctggactcctttagtgggccagatcctttcatcaccatgggctgctgagaccactggaatttcaggcaaacctataaaacaggggcagctttaggtgaccacattctgtcatgaatccttgatttcatatacagtttttgcattacatgtttgctagtcctaggccaaaacaaaaggagaaaagatctaattttagctgagttcgagttgcctttctaaaaattatgatttcttctttatgagtctttttggtgaattgacccttttctcaatatgtaatgtacctgtttattcctggtaacatttcttgttctgaagtctactttgatattaatatagccacctcagcttattatttgtatctgcatgccttatctatttatttattttttgagactgagtcttgctctgtcccccaggctggagtgcaatggcacaatctcggctcactgcaacctccaccttccaggttcaagcaattctcctgcctcagcctcctgagtagctgattacaggcgcacaccaccacgcccaactaattttttttgtatttttagtagagatggggtttcaccatgttggtcaggctggtctcgaactcctgaccttgtgatccacctgcctcagcctcccaaggtgctgggattataggcgtgagccaccacacccagcctgcatgccatatttttgcatctttttactctttatcttgcatttttatattgaaaataagtattttttgtttgttttgttttgttttgtttttatccaggcactgcgactcacctcacacctgtaatcccagctactcacaaaactaaggcaggatgattgcttgaggccagcagatggagaccagcctcagcaacatagtgagacccccatctctaaaaaataaaaaaaagaaaaagtaatctgggcatggtggtgtgtgcttatagtctcagctacttaggaggctcaggtggcaggattccttaagctcaggagttaaaggctgcagtcagtcctcatcatgccactgcactccagcctgtgtaacagagtgagctcttctctaaaaagtagaataagtttcttttaaactccatatagttgggttttatttttattcagctttattatctctgccttcgcactggagattttaggtcatttacatttattggttgggttttaatctattttctttttctgtcttccatatattctatataattattcccttttcctgtattctccagattacttaaatatttgttagtattccattttatctctaaaaagttttacctcttgccagtttctaatatgcgtctttcacttatcacagtcgaccttaaaataattttgatgcctcattatatataatacactttcatatcttcctgtgatttgtgctattattctcatatgatttgttcatgcattggattgtataaagatttaaattcaatttttttaaagaaatttatgtctgttgtatttactcacatatttagcagttctgatactcttcattcctttgtgtgtgttcacatttccatttggtatctttaacccatgtagtttctgcatgaattataaagtattctccttctccctcctcctatatgagtatacagaattgagtttgttgattgtattaacaccctttaattccccagtagtaataataatagctattattactcttatagtttacatgtctcttcacattctgaaagtacaatcacatatttaaatagaattgtcttttttcaaatgctttttaaattttagaagctcttgtttcatatatttcatactacattgtttggttcataaaatattatgaatggtagttttcttggattgagcattttgtcattatgaaatattcttcttttccttgttaaatatttttgatcttgattctactttgatacttatattgtcatttaaaaatttttttgtttgtatttgttgtagaacatttttgaaagaaaactgaatcacattttaaaaaatctgaattataaacaaggtatatagcttaattttaaccacagtatgattaatcttatcttttaactggttgtggaattcagcccattcacatttgatgaaatactgagataattgaccttatttgttccatcttattttgttttctatttatattacatcactccccattccctttcctttttgttttgtgtggtttattggtttcactggcttgttaattttttctttattcccttttattccttgttactttgagagtcctactaagtgttttgtttctactagtggttacattctcattccttataaccaacaataaacttatgttctgcctaaacatgtatatgtatttcaaggaacgttttctgtgtaccccttctctagactcttacttaatatttgcttacttaatgtttattttcagttccagactgttactaagttttttttgttgttgtttgttttttttttgtagaacagcaagcctattgtattttaagaaaactcaatattacagattcctgcttacattattattatccacttagatttcaatacgtatatgcatatatttttatgcatatatgtatatgtttaagcatattatgcacatacatgcatatatatacatatatgcaggaaagagacacacagagtgagaaagggtctcagtgtctactggttcctctagtctttgatttccaccatattgagaaagctgctctgaatcaattgttatttggttatactctttctcaagtattgtcctcagacagtgcttatgagtttactttttgaatccttgtgtgttgaaaatgttttttttgcctcttacagctaaataatattttgtctgggtataggattctttaatcagtttctcgtaatagtttgtacattattctagtgtcttctacattccagagttgtagatgagaattcccttagctaggattaatcctttgtaagtaacctattctttctgtctggaagcttgtataattttctgtttactcttgaaattcaagtgtttcctggatttacttcctggacttaatgagacttttaatctgtgggcttaaatcttacttcagttcagtataataaaatacctagccctgtattcatttaattacagtatctccctcatttgttcttttctttttttttttttattccttttctctctcctaaaaaacacaaaatctgttctggaatttctgttattctcatgttaggcttctggaatctgtcctccaagcctcttatctcttccatcattatgtcaatctctttgtatctttgctacttgtagtagcaaagtgggagagatggtgaaatgaatgagcaaagacagttactatggtaaattaagataaagataaagataaaattcagatgtcatatgtcatatttcatttacttggtcttccagagcattaatttgattttcattagtgtcagtgattttttagttcttctgtggaaattttaaacgtaaaatcagtatttatacttccagaaagaattttttgcattcttctgatttctcattgttttcatcattaaaagattctaccatatttttcatcatttctacttctgtgggacttgcctcttgtagatgttctatgtggtctctcaggtgaactactcccattaagttagttaatgtttttgttttgcctactcattgataaatgctattttgactttcatataggtttttagtatctattctgcattaacaagtctgaaagcagtgaaaggtacatcagttcctgccctggcacttgggctggcagtcacccaaccggccaacagcaagtggccccttctttcttcttagagcacccttggtggaagcagcactcctctctagctgccaatcttagaagcaactcagactgccagtgtagccctgactctgtagggcccctatctctaattctaattttacaaacctttgggtgggggtgactagtaggtacagcttgcctaaaggtgaatagttatccaaagagggcaagttgctaaaacacttcaggaaatgtcaaaactggtcttaatagaagactcccggaggggtaagccctttgttctgctgctagtaccttgcctttacccactaataatatgaacaaagtcctatgttttctttccctcctggagagttttggagtacctgtggcttcaattgtactcactaaactttaccagttctgctgcttaatagcacgtccatattacccatcagtttgatttaaagaaactcaatgaattggaccctaatattgtttgaataatcccaatgaaggagggagttgccagaggcatctgtagccataaaacttctgtagtcatcttcactccaggcatactctcttattttaacttcttgtaaagaccaagacatccctaactttccctttattggggaaaaaatctgcttggaaaaacttagttatgctgtgaagtgttgagtttttaaactattgctgtattatgaaccacaaccaatgcttgttagtttaatacagtaatcatttatttgactcatggacagctcatttaggctgtgctgtcctaggtgatccttctggtctcagttggactcactcactggagtcttggctgactgatccacgttgatccaagacaacctgggggtatctgatccagattgagctcagctggctattgccctgctccatgtttctcttatcctcctcatgggaccagtggactagcctagaatgatctcatggcagtgccagaggtgcaagagaacaagcagaaacacatagaatctcttgaggctcagactcggaactggcatgcagttacttctgcttccttattttggctaaattcagtcatgtgacagaatcagaagtcagaggtaaggaatcagaatcagaggtaggaaaggaagccctgcctacaatgtgggggacaggaggaggagggtgcagtactacaaagttacatggcaaagagtgtgggtatgtggagacatgaagacttagggccatgaactcaacctttatcagctgttgagaaatacagtgcaatattttaaacttacaatggtacctcaagagagagagccacgagtttagcttggaggtagtagagaaactttcacagaggagctgacattggaactggaccataaggacaacctggagtttaccaagcagacaaagataggtgaaaggagtaataatccattaagatggaaggagaagtcaaagtagaggcccagcactctacagacaagaatgggacatctggggatttaggagttaccctgtgtgattggatcattggaaacaatccttctatactgccttttgctccctaatattactcttgccagggagctatcgtacctccccaaaagttggaatttcagatgtcatatgccaggaggagttagcatattgtatactcttcagaacatgttacataggtgggctgccttctccacttattagagatgtatgttgcttaaaaaaccgtgaataatttagcatgtttctagaagtgcttgcattccttcagtatatttatgccacttagcatagctcaatgtgttctgtgatctgtgccacatgtaaaaaaatcattaatgataagtgacatttgttggctttcaaaagacatttaagcctcactcagtgctacctcctctatgaacccctccttgatatttcctccctgtctcccaccagattatgtcaggttcttctgctaaaggctttcatttctccctctacttccttcagagtattcatggctgtttgttagtatatgattttagttgtgattatttgatcaatttctgtctccccaattaaactttcagcttctgtgactgcaaaagactagatattttgcataccactggtttcctggatcctagtatagtgccaggatcatagtaactgaatattaaacatttattaagtgagtgagtgaatgcatgaatctatgtgagtgactgaatgagatacatctagactattgtccttgtgagataggttttgggttatctttaaaattgcatgagctcccaggtttaccatttacctaccatgtaatggacaaacgattcattctttaatgtttccattcagtcagtgttcattgtggcttgtcataatcctgaatgtgaatgaggtatttgtgatacagagaagagtaaggctgattctgggctgacggagttgctggtttagtgggagagatggtgaaatgaatgggcaaagacagttactgtggtaaattaagataaaggtatgtccagattggaacttggagaagaagcttttcactcagtctgcccttcattggggcttcctgaaaaaggacaatctgagctgagtcatgaaggctaactaagagttagatgcataatggggatgactgttccaggaagaatgaagcaaaagggttcagtacacagggaagtgggaaatcaaggctcactatagcaaactccaaataattcagtattgcagaatgagaaggcaagggtggggatggccagaacggagtgactgtggagatggacacagtcatatcacaaagggttctttaagccctgctgtgcattggactttgtcctgaagttagagcgtagcaattgaaggatcttaatcagagattgacataaaatattttattttataaagtttgccctgggtacaatatggagaacagattataaggcaataagactgtaggggagcaatatgaagaagcagttacttacccagcatgataagggctatggtagaagacatactccatgctctgggaaatcagaagaggagtgcctaacccagaactggaatctcagcctaggctaaagtaagagtttgaattatcatggtgaagaagctgggatgagttttcccaacagatgggggtagggcaaaggcactgaagtatgtcagaacatgactttcttcagagaactgtaagtaactttttattgttagactacagaatattaagggtaaattgagaaatgtagctggaaagcatctagcgttcaagtcttcctcctattaaatattgccttagactgggatgaccatactctttattatctccaccagacactttaaaaacttttttttatcatagaaacttttgaacatgtagcgagagtagtataattaacacccatgaacccatcactctgtcccaacaaccacccatgaccaatcttgcccttagccacatgccatttacttctccttctcatgttgcttaaagcgcattccagataccatgtatcttatacaaacattttcagtatgtatctctaaatgataaggagccttttgttaacataaccacaactaccaatatcatatctaaaatttcataatttttttatcaaatagcaaggttataatttctaattatctcacaaatgtcatgtaaacgtagatgtaaatacgaatattcatatacagattgtttaatcaggatccaaataaaggactgaaacttttttttttttttttttttgagacagagtctcaccctgttgcccaggctggagtgcagtggcacgatcttggctcactgcaagctctgcctcctgggttcaagcaattcttctgcctcagcctcccgagtagctgggactagaggcatccaccaccaagcctggctaattttgtatttttagtagagacggggtttgaccatgttggccaggctggtctccaactcctgaccttaagtgatctgcctgccttggcctcccaaagtgctgggattacaggtgtgtgccactgtgcccagccagggctgagacttttgaaagtgaaggaaggtactatccataattaacaggtatccatggagactttttacctaagcagggatgtgtcattatctacactggcttattccacttctttaatacctctgcagatacctggacgggtattttgcaaaatataaaggaagcctcactcatatggtcagttctatctatatctcttctattttcttaggtctctctgctccctggtgtgtaagtggacatattcagcagagaaaggctgggacgacagtttctggaaaatgattggtttggaagactttgttgcagataattacagcaaaataggtaaaagaataaaacatctgtagagtgattatgtgcattggaggatcttgatgggtttgttgttattgtggtttgtatgtttcttgtttttgtatgcatgaaaatacaggaatgaagttcactttttccaagacaaatgagttaattatgatgggtaggccatgactagtaggctcttgccttaagatttatatgaactgagtagagatacatgctatgaaaatctgcattgaaatatagaatcagaaattgcgctgggcatggtggctcacacctgtaatcccagcactttgggaactgaggcaggcagattgcttgagcccaggagttcgggaccagtctgggcaacatggtaaaaccccatttctacaagaaaaatacaaatgttagcctggcctcgtgcatatgtctgtagtgtcagctactccggaggctgaggtggggggattgcttgagcctgggaggcagaggaggttgcagtgagctgagatcgtgccactgcatgcagcttgggcaacagacagagcagaactctgttttgagggggaaaaaaaaatgggctagactgaggaagatatttgcaaggagcagcttgggaatagcatactcaaggggctgtgtatggactgcttccagtcagtactacgaaaataattttacaaattaggttcacaggacaaggcaaggctgtgaacaggtaaaaaataaagctaaaagatcaatattagaaaatctagaaaaaagcagaaactagaacgagtcagtggctcctaactaaggccttagggtctcagactaaggccttttatgtgggtggtaaagtacatcttctatgtcccaagcacatttctctgtgcttgtatgtaccttgttttatatatttctcacaactactgacaaaagcactgttgcatgtttacagatgagaatcagagagattagtaaccttgcctaacctggcatggaatcaataaatggtaagtcaggatcgaaattctcccaatgggaggacctagaaggaactaatattttactggaacacaaatttcagcttcagttacctaatggtttaagtgatttgtaaaatgtatatgccctccaaaaaattagttgttttttgctgaatattcccatggtatgttgttaaacatagctttattagtgtatatattgattacctgtatatgtgtcttgattcctcactagactgtgagctgtttgacataaggattttcacttatttacctttgtatttcctgtcctagcacaaggcatggcatattttcatatctcagtgactttttgattaaaatattgagatgcttggtactaggaggttggcactctttcctttaaaaatctgtaatgatatttactgattttaacattatctttggcaattgggtataacttcaactctgattttctgattatttttatatttttctgctcctctttcctgcctcacacatgacacatgtttaattagtatattagctctgctaacgtagcagtatctacaagaaatattcattagaagtccataatgttaatctagcagaaaatttccagagtaactttattagattttttccctgttaagttaatggatttttaatggatttcctaaggagacatatcattaagcagaatattgctgtacgtgaattagaacttacccatttatcaaaattaattgtgtgatgtttcctttgattttcgcttctggacacttgagcttgtagtttcagtctgaacccaaagtagaagatatttaagaggctgtttattctcagttgtgactttcagaaactcctctggaagctacctctagacattctttagcaattcttggaactatgaaagatgaatctcagaagcctccctatgaagtgttaaacatttccagtggcctcattgcccgtcaagatgtgggcaatatagtgtgaaaccttttagcagatttgagcattgagcgtcctggatttgagcattaatacaattaccataatttgctccatgtggagcttttagccaagcctttaccaggcttcctgggcccatgcagtaaataaatgctttccctgaaaactgaacacctcagcaactgatggtcttatggaggaatatttttaaaatgaattatttatgaagtgtaagttaaggatcaaatgcaatatttatatggtgcatttcaaggacaggagaaaaaatttacagggttttaagtaataacatgcaagtttctaaagctaaaatgttactacctaatgccttctttcaaggaggtatttggatggcttggtttgggaacattcacaaagtaaggaaaaatagttttgtgcatcaaaagaatatagtagaaatttctttacaattgaatagaaatttctttacagttgaaactgtacaagttgacttaatgttcagaattgatggagaaaaatgaaacagattttgggtaggagattatatagccctactgacaaaatgatctgtgttcaatgaaatgatccaacaaactgatctgtgtcaataaattttgacctttaattccacatgaataattccccagttacctatctaatcctaaacatctatcaaaagcaaacaggaaggaagagatcagcagggagaaaggaccttaggaagataagcaacatcccacctgttctaattgattatccaggtgccatttcagcatgccgcggttgcctttttaattcctgggaaaatctctttgttctactattggggtagcccactttatgaaaagtcgtgtgtgcaacatggctgaattatagagtgattatctgcattactaacagggtttgtcatataaagggattcagtgtattagcttatagatcattcctttatttgggaccagggaagccaggcaaagaaaaatgtaaattccaagtccaggaagttagtaagtgttaagtgagaggcagaaatgaagataaagggcaggagacagtttcttgagtggagggaggctgctttttaaatgggtttcctcgacccgggaagcacaaggggtgggggagatttccctttcctagacaagggaagccatgacagactgtatctggaaaatcgggacactgccgcccaaatactgggcttttccaacagtcttagcaaacggcacaccaggagattatatcctgcgcctggctcggcgggtcccatgcccagggagccttgctctcactgctagcacagcagtccgagatcgaactgcaaggtggcagtgaggccaggggagaggcttccaccattgctgaggcttgagtaggtaaacagagcagctcggaagctcgaactgggtgcagcccaccacagctcatctaggcctccctgcctctgtagaccccaccactgggggcacggcgtagctgaacaaaaggcagcagaaacctctgcagtcttaaacgttcctgtctgacagctctgaagagagcagtggttctcccagcacagtgtttgagctctgagaactggacagactgcctcctcaagtgggtccctcacccccgtgtagcctaaataggagacacctcccagtaggggccgactgacatctcatacagctgggtgcccctctgggatgaagcttccagaggaaggatcaggcagcaatatttgctgttctgcagtatttgttgttctgcagcctccgctggtaatacccaggcaaactgtctggagtggacctccagcaaattccactttatgaaaattcctgcagctgaggaacctggctgttagaaggaactctaacaaacagaaaggaatagcatcaacatcaacaaaaaggacatccacaacaaaaccatcatcaaagaccaaaggtagataaaactataaagatggagagaaaccagagcagaaaagctgaaaattctaaaaaccagagcacctcttctcctccaaaggatcacaattccctgccagctacggaacaaagctggacggagaatgactttcacgagttgacagaagtaggcttcagaaggtcggtaataacaaacttctccgagctaaaggaggatattcaaccccatcgcaaggaagctaaaaaccttgaaaaaagattagatgaatagctaactagaataaacagtgtagagaagaccttaaatgacctgatggagctgaaaaccatggcacaagaactacgtgacacatgcgcaagcttcaatagccaattcaatcaagtggaagaaagggtatcagtgattgaagatcaaatgaatgaaataaagcaagaagagaagtttagagaaaaaagagtaacaagaaacgaatgaagcctccaagaaatgtgggactatgtgagaagaccatatctacatttgattggtgtacctgaaagtgacgggaagaatggaaacaagctggaaaacacatttcaggatattatccaggagaacttccctaacctaggaaggccaacattcaaattcaggaaatacagataacaccacaaagatactcctcaagaagagcaaccccaagacacataattgtcagattcaccaaggttgaaatgaaggaaaaaatgttaaggggagccacagagaaaggtcacattacccacaaaggaaagcccatcagactcaccacggatctctcagcagaaactctaccagccagaagagagtggaggccaatattcaacattcttttgttttgttttgttttgttttgttttttattttattgtattttatttttttcttctattattattattatactttaagttttagggtacatgtgcacaatgtgcaggttagttacatatgtatacatgtgccatgctggtgtgctgcacccattaactcctcatttagcattaggtatatctcctaatgctatccctccctcctccccccaccccacaacagtccccagagtgtgatgttccccttcctgtgtccatgtgttctcattgttcaattcccatctatgagtgagaacatgcagtgtttggttttttgtccttgcgatagtttacagagatatagatcaatggaacagaacagagccctcagaaataacgccgcatatctacaactatctgatctttgacaaacctgagaaaaacaagaaatggggaaaggattccctatttaataaatggtgctgggaaaactggctagccatatgtagaaagctgaaactggatcccttccttacaccttatacaaaagttaattcaaggtggattaaagacttaaccgttagacctaaaaccataaaaaccctagaagaaaacctaggcattaccattcaggacataggcatgggcaaggacttcatgtctaaaacaccaaaagcaatggcaacaaaagccaaaattgacaaatgggatctcattaaactaaagagcttctggacagcaaaagaaactaccatcagagtgaacaggcaacccacaaaatggcagaaaattttcgcaacctacttatctgacaagggctaatatccagaatctacagtgaactcaagcaaatttacaaggaaaaaacaaacaaccccatcagcaagtgggcaaaggatatgaacagacacttctcaaaagaagacatttatgcagccaaaacacacatgaaaaaatgctcatcatcacttgccatcagagaaatgcaaatcaaaaccacaatgagataccatctcacaccagttagaatggcagtcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcggctctgttcacaatagcaaagacttggaaccaacccaaatgtccatcaatgacagactggattaagaaaatgtggcacatatacaccatggaatactatgcagcctatacaccatggaatactatgcagccataaaaaatgatgagttcatgtcctttgtagggacatggatgaaattggaaatcaacattcttaaagaaaagaattttcaacacagaatttcatatccagccaaactaagcttcataagtgaaggagaaataaaatcctttacacacaagcaaatgctgagagattttgtcaccaccaggcctgccttacaagagctcctgaaggaagcactacacacggaaaggaacaaccagtaccagccactgcaaaaacatgccaaattgtaaagaccatcgatgctaggaagcaactgcatcaactaacgggcaaaataaccagcttacatcataatgacaggatcaaattcacacataacaatattaaccttaaatttaaatgggctaaaggccccaattaaaagacacagactggcaaatatgataaagagtcaagacccatcagtgtgctgtattcaggaaacccgtctcacgtgcagagacacacataggctcaaaataaagggatggaggaagatctaccaagcaaatggaaaaaaaaaaaaaaaggcaggggttgcaatccttgtctctgataaaacagactttaaaccaacaaagatcaaaagagacaaagaaggccattacataatggtaaagggatcaattcaacaagaagagctaactatcctaaatacatatgtgcccaatataggagcacccagattcataaagcaagtgcttagagacctacaaagagatttagactcccacacaataataatgtgagactttaacaccccactgtcaatattccacagatcaacaagacagaagcttaacaaggatacccaggacttgaattcagctctgcaccaggcagacctaatagacatctacagaactctccacccctaatcaacagaatatatgttcttctgagcaccacattgcacttattccaaaattgaccacatagttggaagtaaagcaatcctccgcaaatatgaaagaacagaaatcacaacaaactgtctttcagaccacagtgcaatcaaattggaactcaggattaagaaactcactcaaaactgcacaactacgtggaaagtgaacaacctgctcctgaatgactactgggtaaataatgaaatgaatgtggaaataacgatgttctttgaaaccaatgagaacaaagacacaacgtaccagaatctctgggacacgtttaaagcagtgtgtagagggaaacttatagcactaaatgcccacaagagaaagcaggaaagatccaaaattgacaccctaacatcacaattaaaagaactagagaagcaagggcaaacacattcaaaagatagcagaaggcaagaaataactaaaattagcagaacggaaggagatagagacacacacacaaaaaaacccttcaaaaaatcaatgaatctaggagctggttttttgaaaagatcaacaaaattgatagactgctagcaagactaataaagaagaagacagagaagaatcaaatagatgcaataaaaaataatataggagatatcaccaccaatcccacagaaatacaaactaccatcagagaacactataaacacctctatgcaaataaactagaaaatctggaagaaatggataaattcctggacacatacaccttcccaagactaaaccaggaaaaagttgaattcctgaatacaccaataacaggctctgaaattgaaacaatatttaatagcctaccaaccaaaaaaaagttcaggaccagacagattcacagccgacttctacaaagaggagctgctaccattccttctgaaactattccaatcaatagaaaaagagggtatcctccctaattcattttatgaggccagcatcatcctgataccaatgcctggcagaagcacaacaaaaaagagaattttagatcaatatccctgatgaacatcgatgcagaaatcctcaataacgtactggcaaaccgaatccagcagcacatcaaaaagtttgtccaccatgatcaagttggtttcacccctgggatgtaaggcggttccacatatgcaaattaattaacataatccatcacataaacagaaccaaagacaaaaaccacatgattatctcaatagatgcagaaaagactgacaaaatttaacagtacataatgctaaaaacttaataaactaggtattgatggaacatatctcaaaataataagagctgtttatgacagacccacagccaatatcatactgaatgggcaaaaactggaagcattcccttggaaaactggcacaagacagggatgccctctctcaccactcctattcaacatagtgttggaagttctggccagggcagtcaggcaagagaaagaaataaagggtattcaattaggaaaagaggaagtcaaattgtccctgtttgcagatgacatgattgtatatttagaaaactccattgtctcagaccaaaatctcctcagctaataagcaacttcagcaaagtctcaggatacaaagtcaatgtgcaaaaatcacaagcatttcctatacaccaacaacagacagacagagccaaatcatgtatgaattcccattcacaattgctacaaagagaataaaatacctagaaatccaacttacaaaggatgtgaagtacctcttcaaggagaactacaaaccactgctcaatgaaataaaagaggacacaaacaaatggaagaacattgcatgctcatggataggaagaatcaatatcatgaaaattgccatactgcccaaggtaatttatagattccatgccattcccatcaagctaccaatgactttcttcacagaactgaaaaaaactactttaaagttcatatggaaccaaaaaagagctcacattgccaagacaatcctaagcaaaaagaaaaagctggaggcatcatgctacctgacttcaaactatactacaaggctacagtaaccaaaagagcatagtactgctaccaaaacagagatatagaccaatggaacagaacagagccctcagaaataacaccacacatctacaaccatctgatctttgacaaacctgacaaaaacaagaaatggggaaaggattccctatttaataaatggtgctgggaaaactggctagccatatgtagaaagctgaaactggatcccttccttataccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaccaaaagccaaaattgacaaatgggatctcattaaactaaagagcttctgcacagcaaaagaaactaccatcagagtgaacaggcaacctacagaatgggagaaaattttcacaacctgctcatctgacaaagggctagtatccagaatgtacaaagaactcaaacaactttacaagaaaaaataaaacaaccccatcaaaaagtgggcaacggatatgaacagacacttctcaaaagaagacatttatgcagccaacagacacatgaaaacatgctcatcatcactggtcattagataaatgcaaatcaaaaccacaatgagataccatctcacaccagttagaatggtgatcattaaacaggaaacaacaggtgctggagaggatgtggacaaataggaacacttttacattgttggtggtagtgtaaactagttcaaccattgtggaagatagtgtggcaattcttcaaggatccagaactagaaataccatttgacccagcgattccattactgggtatatacccacggattatacatcatgctactataaagacacgcgtacacgtatttttattggggcactattcacaatagcaaagacttggaaccaagtcgaatttccaccaatgatagactgaattaagaaaatgtaacagatagacaccatggaatactatgcagcaataaaacaggatgagtacatgtcttttgtagggacatggatgaagctggaaaccatcattctgagcaaactatcacaaggacagaaaaccaaacacggcatgttctcactcataggtgggaattgaacgatgagaacacttggacacagggtggggaatatacaccagggcctgtcgtggggtgggggaatgggggagggatagcattagaataaatatctaatgtaaatgacaagttaatgggtgcagcaaaccaacatggcatatgtatacatatgtaacaaacctgcatgttgtgcacatgtaccttagaacttaaagtataataaaaaaaaaacatacaaacctattatacttttcccttcttaaatttatccctttctttgatcttacatttccctgtaggctacatcttgttactgtaattccttttattatagagttactacaataattgtcttttactgcctctacttcctatgatgacattacagttacactttcttccccaccactgtactgaaattaaaaaaataataataaaatggatttcctccatccctatgagactgtactttgggtgtcagatgacaaaaacacagtcacttggcacattttagatactgatgaaatattcattgaatgagttaatatatgtttgaattaaggatttgattttttttaagtcccttgttggcttcaattgtttctttcttgttttttttgttttgttttgttttgtttttttttgagatgtagtttctctcttgttgcccaggctggaatgcaagggcatagtctcggctcactgcaacctctgcctcccggtttcaagtggttcttctgcctcagccttccgagtagctgggattacaggcatgcgccaccatacctggctaattttgtatttttagtagagacggggttgctctatgttggtcaggctggtctcgaactctcgacctcaagtgatccgcccccctcagcctcccaaagtgctgggattataggcataagtcaccgcgcccgactggcttcaattgtttctaaaccacaatggactttcgtaaattttttgaattaaataatactactagctaacaggcaatgaatgtatttccttaattcagtgttcactgtcatctttcatgaacaccttctacataagacgggtccctgcagaagatacaccctatgttgagtgatagtgcaattctatttcattcctgtagcaaatctctcagagacttttctatcttaggaaatatcacagactccttcacagaaggaaaacaagaattaatcttagaaaggttgggcatttcactttttcatagagtaaaataaactgaacattaaatgaagctacactttagatatttttgtcatgtaggctaaaaatttgtaagtaaagaatcttggctgggcgtggtggctcacacctgtaatcccagcactttgggaggccgaggcaggtggatcatggggtcaggagatcgagaccatactggctaacatggtgaaaccctgtctttattaaaaatacaaaaaatcagccaggtgtggtcgcgggcgcctgtagtcccagctacttgggaggctgaggcaggagaatggcgtgaacatgggaggcggagcttgcagtgagccaagattgcaccactgcactccagtctgctccactgagcaagactctgtctttaaaaaaaaaaaaaaaaaaaaaggatcttgactaatgaactaatgataggtatatgctggggacataaatgtgccagtgaacagagccacctcaggcaagggtgcagtattggctttggtcacactgaatcaaagttcagggatcttctgcctcttgttggaatctggctagactttggaacctgcacaatactgacttatccacccactggctggccaagaagctgagacaaagagaaaagaagccacctatacttgcctgaagcaagctgcacttgatcagattgattcatgaactcagagcccacaggcctgagtacaggtggctcaagaagaaagtattagttcttttctgctgctataacagaatacttgaggttgggtgatttataatcagcagagattaattcagctcatggttctggaggctgcagtgcccaagggtgccgataacttctgggcatctgataagggccttcttgctgcatcatcccatggcaaagggtgcaagagtgtgggactgcacacacaagaatgagagagggcaagagggggcttggctttatcagaagtgcctcctaagacaatggcattaatccattcatgagggcagagccctcatggcttaatcacatcttaaaagtctcaccttttaatactgtcataatggcaatgaaattttaacatgactttttgttttaatatgctgagcttttattcatatttttttttaacttttaagttcaagggtagaagtgcagttttgttacataggtaaacttgtgtcatgggggtttgttttacatattattttgtcacccaggtattaagcctagtacccgttatttttcctgatcctcttcctcctcccaccctttgtcctccaccctcccaaaggacccagtgtgtgttatccccctcattgtgtccgtgtgttctcattctttagttcccacttaaaagtgagaacatgtgatatttggttttctgttcctgtgttagttgctaagaatgatggcctctagctccatccatgtccctgcaaaggacatgatcttgttctttttttatggctgcataatagtccatggtgtacatgtaccacattttctttatccagtctaccattgatgggcatttaggttgattccatgtctttgctattgtgaacagtgctgcagtgaacatacatgtacatgtgtctttataatagaatgatctatattctttggggtatatacccagtaatgagatttctgggtcagatggtatttccatctttaggtctttgaggaatcgccacattgtcttccacaatggctgaactatttcacactcccaccaacagtgtatcaacagcgtttaagtattcccttttcttcacaacctcaccagcatctgttattttttgactttttaatagccattctgactggtgtgagatggtatctcattgtggttttgatttgcatttctctaatgatcagtgatgttgacctttttttcatatcaatatgacttctgaaggggacattcaaaccatcacagagatacatgccaagccttcatgaactccacttcaggactgtggccccacttcccatttaacacggcctcatggatactattatacaatcttttcagtctcagggatccagctaagtgattccttctcccatggatggaataagggagattataaaagcaggaaatgggagcattcacaccaatactacctcattttaggggaaagaagaggaaattcccttttgtaaacaaaccatagaggtttccaccaacaacatgcattatgtccagtgctggaagcctgaatccagtgatgccatccatagttgtgggtgttgtaaaatccttttagagcaattaatattcaatgttctgaatttttccagtaaaagtggacatgtttacaaggattcatgtcttcattctttatagtgtgtggcttgtttttcattttgatttgaatgagccatataattcagttatttctgtcctcagagctttgctgaagtgctgcttcatctttgtatcatgtgatataagtgccaattttactaatttatattgagagctctggagaaatctttaactacaggtaatcccagccttttctaggttaaatggggcccatcacaccattacctcccctctcctgagggaggcttatatggtttgcctctgcatccccacccaaatctcatctcaaattgtaatccacacatatatcaagggggagacttggtgggaggtgattagatcctgggggctgtttccccaatgctgttctcttgatagtgaaggagttctcagagatctggttgtttgataaatgtttggcattttccctgcttgttcttgctctctcctgccttccttccccctctccttccaccatgattctaagtttcctgaggcctcccaagccaggtggaatggtgagtcaattaaacctcttttcttcataaattacacagtctcaggtatttctttatagcaatgtgaagatggagtaatatagaggccatccctgtgggtactctggactgagatttgcttttgcctgtcaccctgagcttttgatcttaccttatcctcttattatccttctcttccctgtctaagtgacagaaccaggtcttcacagtacttgaaggcaagtacctatcctctgagtattgatgccttattttactctttagtatcgaatttctgcctgataaagaatgacttggaggtctccatgccagttagccatccatccagtcatgcatccagccaaccacactccccaagtgtctcctgtgtgccaggtgctgggctaagtcctagggatacaaaagtgaattcatcatggtctatccctttggggatctcatgtctactaggggtaggggcaggtaaatgaatcagtaatctcaaggtttttcagtaactctacagatgtccaagatgccatggagaagcagagcaggcagtcactggcactggtggtggtatcaaggaaattttctcatgaggtggcattttatgtgtctggaaaattggagtggtagtgagaagtgacagcgtgctggcagtcctcacagccctcgctcgctctccgcgcctcctctgcctgggctcccactttggcggcacttgagcccttcagcccgccgctgcactgtgggagcccctttctgggctggccaaggccggagccggccccctcagcttgcggggaggtgtggaaggagaggcgcgggcgggaaccggggctgcgcgcagtgcttgcgggccagcgtgagttccgggtgggtgtgggctcggcggaccccgcacttggagcggtcggccggctccaccggcccagggcagtgaggggcttagcacctgggccagcagctgctgtgctcaatttctcgaggggccttagctgccttcccgcggggcagggctcggaacctgcagcccgccatgcctgagcctccccctgttccgtgggctcctgtggggcccgagcctccctgacgagcgccgccccctgctccacggagcctagtcccatcgaccacccaagggctgaggaatgcgggcgcacggcgcgggactggcaggcagctccacctgcagccccggtgcgggatccactgggtgaagccagctgggctcctgagtctggtggggacatggagaacctttatgtctagatcagggattgtaaatacaccaattggcactctgtatctaggtcaaggtttgtaaacacaccaatcggcaccctgtgtctagctcagggtttgcgaatgcaccagtccacactctgtatctagctactctggtggggacttggagaacctttgtgtggacactctgtatctagctaatctggtggggaggtggagaacttttgtgtctagctcagggattgtaaatacaccaatcggctctctgtatctagctgaaggtttgtaaacacaccaatcagcacccagtgtctagctcagggtttgtgaatgcaccaatcaacactctgtatctagctactctggtggggacttggagaacctttgtgtctagctcagggattgtaaacgcaccaatcagcactctgtcaaaacagaccactcggctctaccaatcagcaggttgtgggtggggccagataagagaataaaagtaggctgcccgagccagcagtggcaacccactcgggtccccttccacactgtggaagctttgttctttctctctttgcaataaatcttgctgctgctcactctttgggtccactttgcctttatgagctgtaacactcactgcaaaggtctgcagcttcactcctgaagccagcgagaccacgaacccaccgggaggaacgaacaactccagacgcgccggcttaagagctgtaacactcaccgcgaaggtccgcagcttcactcctgagccagcgagaccacgaacccaccagaaggaagaaactccgaacacatctgaacatcagaaggaacaaactccggacacgccacctttaagaactgtaacactcaccgtgagggtccgcggcttcattcttgaagtcagtgagaccaagaacccagcaattctggacacagtagtttaccagaaaagaggggaaatggcttccaaggcagaagaaacagtgcaggcacagacatggaggcatggaagagtgcagagtgtgtgtgaactgttgggtgtggccagagcatagtggacctgaagcaaggtggagaggagtagttgtgggcaagatagagtttatggggggctagtttctgatggaacttctaactttcctcaaagatggggccaccgattagagactcaacatggcaggagtcactctattcctttcaagagatggttctaattactactcctgccaatgcagtaaataacacttgagggcagtaggagccattttagaatatttgtggctcctatgaagctgtttgtgtgtcggggcaggtggcaagcccatttcttttcttttctaaagtcacataccttgccccttagctatcctcccttccataaaggtttgttgtgaagctggaatgtgatatcagatgtcacagggcagtgtggtttacgaagcctgtagaaatgttcttaccaactgtaagtacaccttggcacctggaggacaagaatattcactcctgcatcactctgttccaactgtgttcacactccttagattcgcagaaggactgttttcagctgctggcccttccaggaatagccctaaagagccagaagggcaaaggagtaacattgaccacatcatggtgatacaaggtaataactttcagaggttttgctgtggaaatgttcctcctttcaatacggcatctgaaagataattggaagtcccccaaaagtgaggtcacccccaacttctcttcctactgctggagaatcagcgattgtcagagctgaaagggatcatagagattttactgtaatgcactcattttatagacaaaaaactgagactcagggatgtgaggtgaatttccttggtcctgcagcattttaatgacagaaatgagaccagaaaccaggtcttctgactcttagtcctgtggtggttctactccttcctgccacttctcctgtttgagttttttggcaatgtgaggacatttagccaatctggatactgacatttgaatgaagctaaccactagaagaatgtcaaggagggaacgatttacataggtaaatttacccaatccattgtccaatcttcagtcatgcaaatgtaggaactggactttgcccaagtcagagacctttggatctaggaacacactgatcaagcccttaagtgactgatgtagataaacgagaataaataagtaataagttcacagttgcctatggtaatagttaagagattggtcaccagggtcagatggacttgacttcaattctgactgtcatctgtaatgaaatttctgccatatgtaactttgggtgagttacttgatctttctcagcctcaattagtatattatgaagattagtaagtatatcatgaggatgaaaggtaataatgcaggtaaagttcctagcatacaataggtcttcagaaaatgaaagttcttactactataatgattgtccattcctctgaattcagatttctctctaggtgatagattatctgccaaagaccataaccccttgaataatcccaggtaattattgccaacttctagatttggaatttttccttttttctgagcttcttccttggattcacacaacctttttccaaccaagatacaataagattaattagatttctgcttctaaattataatcacatttcataatcacaaaccttccttgagaggcatcttaattggaattaagggttttcctgaattcgtcaggtccacatgactggcaatctttagctttttttccatgaatagaggggtgcatatccacaggcaaataaaaaaaatacaggatatgttggttaacaattaactagttaattaataatggctaatgttcctacagtgctttacaacttagaagagtttttcttttcatgcactattgtgcttttttcttccaccaaacttgtaaaataggtttgatttcagttttacacttggggaagccaggattgatgagctttggtcttttccatctcagtagaaggtgtcacaattctccctgtcattcaggacccaaacctagaagtcattcttaatgcttctcttcttcctcttacaccttacatttaatccatcaacaagtactttctgctttgctccaaagtggacccggaatgaggcattcctgcccctcttcactattagtatcgtagttcaaagtagttttatttcttgctggatttgtgtgctagcctcttaaatggtctccctgtttctgtccttccctctgataatccattctccacacagcagccagagtgatattttaaaaatgtaaatcagatcatgttactctcctgcttaaattcctccagtggctccccattgcagctgggaaaaaaataactccttgccatgttcaacaaagtcttgcgtgatctctgtctgacttttattgcttaccatgcccccacgtagtcaccatccaaccacaatgaccttctttttgtccctcagacatttccagtgtatatagcttttgcgttaactctgccttctgtctggcatggcccttctcaaaatattcacatggtctacctctttctctttgttcagatctcagcttcaatgtcatcagagaagagctttcccttaccacccaaacactctcttctactccagcagtattctgtttccctgttgtattttattcttaacactcatgactatccaaaattaatcagtcttgtctggatgctttataggtattaactcgtttaatgcctttaaccagtctagacaggtactactatattcattttactgatgaggaaattaaggaaaggagaggttaagtaagttgctcaaggtcacacagtaagtaatggaatcagagacaggtctgctccagatcctgcacatctgtccatgtagctgcagtctcctggcctgggctgcgctgatacagctgcagttctcagactaagttcaacaagagtcccagtcctagtccagtgatgcctgaagtcacatgtttcattctgggcctcacattcatgaagaccactgacaaaaaggccccagggccccagatgaaaaacataatttaaagccagtgaatttgagaagcagttgagcagttttgggttttctcatcaaattacctgcccaatgtcaaaatattagtaaattatagatctagattttaattgagtgttgtctgacattcccttcctcagtgctgacttgagattactcaagatgacagaagaaaagtgctgcctcagaggttctttcctccctctctgtctttgaaaaagcacagggagaagagggctgaagatgtgactgtccagtaattggaaccatctcggctcctctgaaattctaggagaagaataagtgaacagtatgatatcttgcaaagcttcatgtgccttaatcacattaaaattcacaattcagttttggatttatttttccttgttttttgaaagttattgacttgggacttgcttctggatctcagttggacatctgacctcatgccattattgtcatccatttagaggtcatttatttcagtgttcttgaaaggcagccattcccagtggttggccttctctattgcatgtgacacatcgcagctcttctgcttagcttttcttggtcacacagctatcaggtggtgactttggcctccaatgtggcccttacctctgactttgtagctcctctgcagtactcttcactctggttctgtggagttttgactccgagatacccatgaccttttaagtttcccagcaccagctaacctttctgagaatctgcatcagagggctgcagtggtcagggtggcaggtcaccagttgactaatggcctcctccaaggtttgctggcagacactgcgttgccatgaaccctattgatcccagaagtttgcctgctgcttagacagtctttgcgggcgtgaggaggtagtgagtcatggagccaccacccctgctacccatctgttcttgtggtgaggagaacaaagatgatctctttgtggtatcataaaacctagaaagacattaaaaattccgttaaattttcatacgcttttagctgttgaaatgtacaatctattatgaggggggaaaaacccactgtaattttccccccactgcccttacttcagaggctacttaagggaccaggtaatgattttacgatgtttattaatacttcatgttctgcttccctcccccattcatttatctttaaattgaaagcacagaaactgccagggatctttaaaatccagagtttttgcaatgtcataggttgttctgttatggatattgtatgtagagatctattgttgactcagagctggggatggggttgggggtggtatttatttttaaaatgcactttggagtaatggaaataacatgagttttggagccagatatacatgagtttgaatcctggccctgccatttactacctttgtgaccagtatcaaacaagttacctaacctccgaaggccactcagttcaaccacttgccagattgggaaagtaatacctctctctgagaatttggatgacctcaaacagagacctctcaatgcaggcctcgtgggaacaatcttatcttatccggatatccagataatttttagtttttcttagttgttctgagtaattacttttattttctctgtctctcgtgggtatcatgtggagtaactgtcaagatatccctcacccctttggttgcttgagaattgacagcatattgaagcctcatctatagtagatttataaactatggtataaagctataacctcacctcaatttattttgttcccatgtttggtttatttaatctttgatcccacttacctcattttatatttgcctactagttataagctgtctgaaacattttataacatagcatgtagaaatatgtctggaacatagtaggtactcaatagatatttggtaaatgaatgaataagtaagcattagagatacagatacaatatgtttcagaggataattaaataaaagagggcaagataatgagtttgtgcctttgagatatccaaataaaaacatagagtagacatttggatctatgctaggaaaaaaggctagaaatagagatttggaagtcataagtgtagatgatatttgaagccatagatatgtgtgagagactctagagggagaagagaaatttcagtactttagaggccaggtagaggaagatgtgcctgcaaaggaggctaaggatgtacctgccaagggcagggagataatgaggagattttacaaggggagggaacaatctccaaggatgctgaaaaaggaagggagataaggactggacactgttcatttgatatagtgactcggggaccttagtgaaagtcacttgcttataatagtgaggcagaagataaaagtcgtacagcagccacagctaacactgagcacagatgctgtgccaagtgcttaatgtggactgttacattacaacaacatgagatgtgtagtcatctcaccccattcccattttttacagaggataaaaatgaggcataaagaagttaatcacccaaggtcatatagctgggttcaagccaagacaggtgtcaggactcagagtcacagttgagaaaatgaagccagaaagtttagataactcaagaaatttggtcagagtgtggggggagagagagagagatggggtggtcactaggggaggaagacggttggaaataggtagagtgttccactgtttggttgattgattgttggaagatggagatttgcttgagcatgtctgattgctgataagaagattctagtagtgagtgatgggttgctgatacccagagagaagggagaatcagtactgtgggtccagagaagacaggcaggattagccttggaatacagactttctattttaataggtaggaagaagacaaaaatggtacagctcatgggagcagcatgtgctcggaagtgggaagttaagggatttcccttcatgaggcttctgttttctttgtgaagtaaaaagtgagatgatcttctgacagagtggtagccaagtgagagagtcagaatctgtaaaaaatggaaaaggtttaaaatagaagtacagaggatcggggaaaagatgattagagaaatcttggaggattatcaaacggtacacagaaccctgcttaggggtcgccatgaatttattataaatctgccctgtggtgtgattttctccagcagcactcagcatctggttgtaagcacacaggaaagggttgttcttttgttttattaatcttaatgaatagcagtagtctgttctgcaagtccttgacaccaccctcttttctatatgctgtatctaatctgttaccaagtgctgtcagtcttaggctccaaatacgtctataattcatgaactctttccacctcaaaatgctacctagcctgtgttcccataatctcgcaactggattattcaacaggcttataacacttgtcattgaatggaaacttgcctttttcagtccatcctgaacactgcagccagcatgaactttttataatgaaaatctaatctaatcctgtgacctcccagcataaaccttctcaagtcttcccaatgcttttagggcaaaaaccaaaaacccgaattatggtctcccctccttctggcaccactgttttcattgatctctgacctcagttgccctcttttggttttctgcacacgacacccttctcaccgcaagatctgctctcatggtcttgttttgcttccagtatcgagtccatgttccaggaagaaggacaaggacaaagggcaaaagtatggactttgcttctgttccagtgttaactctgaaacctcactcggtctcttctgcctacatgtcaatggccagaaccgtattacatactactacctgcaagggaagctggggaaaggtccattttttgccagtcacatttcagccttcaataaaatgagagttgtgttatttaaaaagaagaggaggaggggcactaggtaagcaacctggagtcccaccttcaatgaggaagtgttttctaggtgaagagttgagtgaaggagatgctgacagaagtgacagcatgaatacagtttagtgctgagcaatatgatgtgggaagaaggtgctggaacactgagtttgaggcagggaaaagggagggaggaaacagagaagtaggcagggatcaaaaaatcataatgcccttctattccagctgaggaacttaaacttcatcccgtgtgttagcctctaaatgaggtcttatatgccaggtgatgtcaagcaagatggtctactgggtatagacaaaaatgttggtatttttatttatctccatttttatttcattttgtttaaattctatttttaggtatgcatcttgacatacacacatataatttataagttcaatagtacattatatacaatttataagtaatagctatgttgggagtccatctgaagacttttttcttagtgacttgcacagtcaaaatgtttagaaactattgcattaggcatcagggaactgttaaaacattttaaacaaggaaatgatgtgatccaaattgaatatggtccaatttgccttttctttcccctatagagttctttaaatttttaaaaattttagaatgttagtacttagaaagaaacattagggagcatcaaccctgtgtcataagtaagataactgaggcccaggaatattaaataattagaaccattaatttgtggctgagctggagccccatccaacctgggtctcatcttctcccagtggtcctttgtggccctgtgcgagtgctttctctcttcctgaatgcatgtccctattcttcagcaaatactcttctcatcagaattatgacatgtgggaatcaagaggggagtaaaagggcatatttataaaaaacgtggaaaccaagaaatctgttttgtaaaaatgaatcacctatttagcctcagggttctgttgactctttagctgtcaacatggaagtctctaggtaccgattcctgcaggttctgttttcataatgccagacccatcagcagtttaactgagacataccgttgtacaatgtcattattttaggtattgtatttgcaaggccagcggtctaagtaagagattaaactgaacagatttctgacttggtaagacagagactttctaaggggtacactgccccactttatcttaccccagtgtatatgaagaaacacatgtttacccatgggaatgtgtatgtatttggatctatttcacagagtatcttataaaaaccgacatgaaaagaaagtctgatttatagaatcctatttcctgacattgtgaatactagttcaggactttgctaactactttttgaccagtgtgactgatttatttccccatgccatcatcaacccagctatgcaagtacaggaagacagggtatctaataaccagatggtgaacaagatctgtattctcttgggtatactaagctattctgaaaattcagtttataggggtacagactaagggttatatatctccaaacaaatgtgtttgtcaagttgatgatcatgtttaccaagatccttttatcaccagctgagtcctcttttagtggcttaggtcaccctggaattatttcaaaaaccagcctgatgtttagaacctcctgtgggctcgggcttgccagacacaaacctaaaatgaagcctgtagccttcatggtagcaaactgtaacctcaagcacaattatatgaatcatggacaaatgttttcactttcaagcaagtttttgccgcagcaaaaatgaccacttatctaagaggctgcatatttatatatatataaacagtttttggacataagaatcttgactattatttcccacagagaattacagatttatatatgtgtgtctatgtgtatatatatgtgtgtgtgtgtgtgtgtgtctgtgtgtgtatatatacatatgtgtgtgtgtgtgtctgtgtgtatatatatatatatataaacaccatattctgtgtcttttatatatagtatcacttgattattataattaccatgaagtgccattgttcttctcattttataggtgaggaaactgaagctcagagaggtgaaataacatcacaaagctaagaggttgtaaatttggcacttttaaaattatctagttattacaaaagttgatcttcagatcaacaaacttaactgacatttcctttttgggccccattttctactctgtgaactgaggaggattgaattcagtgattctcaaaccagagcatacgtcagaaccacctggggggattcttaaaacactgattcctgggcctgcttagagtttctaaatcagaaattctctggagcgattaagaactggtgtttccaataagttcccaagtggtggttcccagccacactttgagatccattggagtagatgatctctcagtgtcttccagctgttacatcctggagggtcagcaacctgccatacttcattggtgtgtgaccaaaaatactgcttcttcatggagtgactttcctactacttttgccaagtttgttggttagccaggaaaattctcaacatgaatggaggaaaatgctgatgaaaatcactccttcctgtatttattaactcatttgccagactaatatttactgagtataccctttgcagatattgtgctacatactggagatagcacatgtgaagatactcagcccctgcctgcgagatgcctatcaactatggagaaaacagatgattaatttattgttattactaaaagggaagtgctgagacctatgagaataaaatacttctctaggatttgtgattatgacttcaaacttttcctaaacaggactattttctactgtggtcttaagtcataaattgtctattctctgtatctagttcgattctgttcttagctttttgaggtatttctttattgggacaggtcagtaagtggcattttcatttattttttaccaacctaagcatttccttcctgccctagatgaaaacttagctttgttcaaaatttgcattttcatttttagcctatggtgacagtttaaatcaacagcaaaagcagaaacccttgtctaaagcaatttcctcactgttattccaacttcagtgaaatgagaagtcctggggagatgaattcagactgtcttctctactcccaccccttctcctaacagtttggcttcttgaaaaaaaataaaagatgaaggaagcaggggtcttgaagggaagatgtctactgtaaaaaaaatagggaaaggaaatagtgtactgataatggttatcatttgttgagtgtgcattatatgccagggactgtcgccaaacattgtacatgaattagcaggtaaacttccccagtaaccaatgaggtacaggtaccattattatcttccttttacagatatggaaattgaagctcacagagggtagataactgtcccaaagtctcatggttatttgatggaggaacaggaattcaaaagcaggcctgactccaaaatctcatgctttttaccagtaaattagatctccagtcatttcaatccctgcatttttcatagggatggtgctgactcatttggcttcctggttttctgactcatctcactgaacagggccagatccgatatgtcttctgcattctcccttatatcatctttctccctgctcccttttctattatggtccacctactctatcatcttctttccatgggccttaaaggaataccttcttgtggactgtctctgtgatgcagtagaaatctggtaagcttgccagggtgtaaaaagtgcatttgtttaggactgtaatgtttatttgaaagggactttcaatcacagacatgacttttttatgagcctcattatatatccttgtgattggaaaaatgcatcagtaaataatgcctccatgaagagtcactctcacttgcattattttaaaagatttggtaataaaaagtactcagattattgataatccataattaatatgaagtaaataatgtgtgttttcaaataaaattcaccatgataagtgatgagagtatgggcttttatatttctttgtaagtcagagacttataaaagataggttatccatcactaaggaatatgtagacacattaattttagcattcagttttttttctctcttttctaaaaaacatgattctattcttcaaaagaaagagtggttttattatttttccagctctttaaaatggttcaaaaatcttggcctgcagacatctttttaaaaaatcaatttttcaataatttagagtgaatcacacccataggggggatgtgctttcaaaataattaaagtagaggaggcaggattatagatcttgagaaaatgtgcttggaaaatgtcctttgatttgttgtgaaccccaaagctttgaataaaataggataggactggaatcaacttctgaactttctcactagctagtggcatgttaccagtagtccagagaatgctgaatgcccatctaatctacactgtcatcccttttattaacaaaacttaggcttttagggtacatcagggtctttcattatagactacatttcccagctccctttgcagctacacatgttcatctaagttttggccaatgaggtataagcagatgtgtcctgtgggattcctgagacgtctcctttaaggagatcaggcagtggccatcctctttccctcccctgggtcaggtagattggctggtcaggtaggttagcagtgactttggataagggggacagacgccatactccagggatggcagaacagtgagcttttgtggaacttccataccagccttggattcactacctctggactttgtttgtatgagtaggaaatttgtttatttgtttttgctgttgtttttgctttattagaaaatcactgttttgtagatttgtagctacacttaatcataactaataaaaatggtgactcataaggtttgggaaaacaacagttaaattaaggtagtaagtttagctatcattattgagcacctactatttactaggaactgttctaagatctttatttgtaatagctcacataactcattcaacagtctttctaagagacttacccccattttacagatggtcagtcacagagaggttaaataacttgcccaagatcatacagccaagccaggagttaaaatcttcagtctatctcttaaactttctgtaaatcactgtgatgaagtgacttgacaacattctaaaaacaagtaaaactggacctaaactccaacttttccctatgtaggatacctgtctcctagacttgttgctaattatgttagttggcctctggcacatcacttagagcccctgtgcctcagacttaacactaataagaggcatgggacaatacctcaccattgtttagtatccattctgagcctggcactgtgccagacacacagatgtgtgaatgacagcgcacccagagggagaccatgcgttggtcaaggagacaaggcctgaacacttaagaagagccaaggaacagcaagggaaatgcagaaccacaatgtcactacatccaggagggttcttggtgcttgatatgtggctagcaaccagtgaacatccctggaaccaagtggcaatgcatgttaagtgccctgtgagcaggcagaaataaatgttttgaatcaaaagaggaggggagctttggcatctaaaggattcagggacacatggtgagtgctttggttcatgttggttgtgccagtaattgaaggagtcttgtagttggtaagatttggggaggtgatgggaagttaggctcttcccccttctggctttctctgccccagggctaacagggctagttcctggaacaccgtctgtgctcccctgtcttgggtcctacacacagctacctacctgtcagcttgggatgctttcccagcctttcatcctagctaccttcttatcctcctggtctcagaaaaaaatgacatgacctatatggagtctctcctaagtagaccacatcccacttacttgctctactgtgtggtgaaatcccatcaaaatggaggatatggttccaaagtcagtgcatactgtgagcagtgaatcagccaagagaatccttgaaaatccctgagggagctatctccacagtggaaactgataagctatctccagtaagtctaacacattaattccggtatttcttttttccctgttcgagatagctgtcctattttaaagtctaggttgtatgaaaaaaatctaggttacatgtagccaagctataggttatacactccaaggagtctcatgtacatagaccatgatgggagtgacacacccctgaggtttttcagtgtatatagaactgtacatagtggaggtattagggtcagatgtagcaaaaggagatattcacactaaaagaaaatagaaaccgaagccaacccagggaagagctgatttacactccattctcgggttgagctccctgtgtaggatggtgaaataaatcacttgcattatttatattgtttaatttctctctgcatctccttcatttgcttcctgaagcctatgtacagttgactgtgtgtgtctatctctgcaaactacagatcttcacttcctattataacacttatcacatttgaatttttcatggattgtaattatgggttaaatgtgcctgccagattatacattccatgagggcaggggccatgtccatctcattacctgctgtggcccagcacctgcatggtacctggcacacagtctttccaagcagttctgtcctagacattgttgtggctttcttctcacccgccttcaggaagatccacccaacttctttctcagttactcagcattaagatctgtagttgctgaggcactcagttaagcttagggtggagctaaaacctgcctgggctggtgcttctctgatacagaaacccctgaaactgatgattatccagaaatacttgatctctttgggggcctgaggagctttggaccaccttaactcatcacctccttaagctcccctacctctaaatgctcttctcaccgctcccactcccaccccctcccccttgccccaaggctcctcctcagcccaactaactgaggctctttcacaatcctaaaagcatcatctttgttttaattttttcttttatcttcaaaagcatctaaaagtaaaaacaactaaagaaaagccagaaagtgaatgaagcagaaaaacaatttcagcactctgatacagtaccccaaaacaattttagttcactttgcctttttttgtgccattttaacgcagttgaaaccatgccgtatatgccagtgtgtagtctgcagttttaaggtgacattattgcatattcatattttcatgatattctttagaagcataattttaataatgccataatattttattgaatgctgtaatgatatttttaagccttctattaaggttggacacttaaatgtttacctttttttctctagtatgtaaatattatggtacaaatacacaaaaatactgcagggaacctttttattttctgcatctgacagactcgcagaaatggaattactaagtaaaaaatacaaactctttaaaatagatttttatttcaggtgatacttaatgcatattaagtgtaaaaaacttagaaaatacataaaagtatttcatccagcatttacctccaagagatggctaattttttgtatattttctgtctttttgatgtatgtgtatatgtgtgtgtatatatatgtattatgtatatattatatataaatatgtattatgtatatattatatatattatatgtatctataataaaatttatactgtattgatatattcatactatatatgtatcattactttacacaattgaaatactttatatgcatgttgttaaaactcttcaaatatacagcttttaatttactgtgtaacgatttttaaaacaacacttttcttgtatcatttaaattttttctgatttcttctattttgttgtatttgtatacataccttgtcagcattttatgttattccttaggatggattccagtaatggatttaccaagtcaaaaggtataaatttttaaggctcttggtgtatattgtcaagtttctttccaggaagattttgccaaattgcatttccaacagtccataagattataaagcaatggaaaatagcatgtcctttctgttttaatttctatcttattaactcttagtgaggttgagctttttccttatatgttattcatgtatatcttcttttgtgaattgtctagatacttaaaaggctaagaatatttggaggttatttttaaaaaataattttttatttttaattgacgttttatacatatttagggggtacatagtgatgtcacagtacatataatgtgtagtgatcgggtcagtgtaattagcatatccatcatctcaaacatttgtcatttctttgtgctagaaacattcaatatcctcctaggtatttgaaaggatatattattgttaactatagttattctacagtggtatagaatactagaacttattactcgcatctagctgtaattttgtgttttttaataaatctctccctcttcccctcttccctctaccattctctgcctctaatatcctctactttttacttctatgagatcaacattttttagcttcaacatgtgggcaagaatatgcagtgtttaactttctgttcttggcgtatttcacttaatataatgtcctccatttccatccatattgctacaaatgacaggattttgttgtttttttatgtctgaatagtattccattgtgtatgtatatcacattttctttgttcattcatctattattggatacctaggctgattcatatcttggctattgtgaacagtgctgcagtaaatgggagtaaagatatgtctttggtatactgattttgtttcctttggataaatgccccagtggtgggatcagtggatcatatattagttctgtttgtagttttttgaggaacctccatactgttccccataatggctcttctagtttacattcccaccaatagtgtaagagtcctttttctctgcatcttcaccagcatgttaattttttgtcttattttgataatcactatcctaactgggataagatgatatctcattatggttttgatttgcatttccctgatgattagtgatattgaacattttttcatatttttgttgtccatttatatgtcttcttttgagaaatatctgttcagatcatttgccttttttaaaaaatttatttttaggagacgggatttcactgtgttgcctagactgtagtgcagtggcacagtcatagctcactgcagccttgaactcctgggctcaagtgatcttcccacctcagcttcccaagtagctgagactacagatgcacaccaccatacccacctaattaaaaaaaatttttttggacagggtcttgctatattgcccaggcaggtcttaaactcctggcctcaagcaatcctccagtgtcagcctcctaagtctctgagattacaggcgtgagtcaccatttgccaatatttaaatcaggttggttgtttttttcctgtaccaatggttgaattctctgtgtattctggatattaatgtcttgaccaatgaatagtttgcaagtattttctcccattctataggttgaattttcactgtgttgattgtttcctttgctgtgcagaagcttgttagtttgacataattccctttttaaaaattttttcttttgttgcctgtgctttttagatcttattcataaaatattttccctggccaatatcctgaagcatttcccctatgttttcttctagtagttttatagttgcaggtcttgtgtttaggtctttgatccattttgagttgttttttgcatagagtaagagttgggagtctaacttcattcttctgcacatagatatccagttttctgagcaccatttattgacaagactgtcctttcaaagcccagtgaatgctgttggtgcttttttcaaaaatcagttggctgtagataggtggattaaagtctgtgttctctgttcttttccattggtctgtgtgtctgtttttctgccaatactgtgctgttactgttttggttactaaagctttgtaatatactttgaagtctgaaaatgtgatgcctccagcctgcttgcttgcttgcttgcttcctttcctttcctttcctttcctttcctttcctttcctttccttccttccttccttccttccttccttccttccttccttccttccttccttccttccttccttccttccctccttccctccttccttccttccttccttccttcctttctctctttctctctttttttctttcttctttcttttttgcttaatattgctttggcattgtgttttttgtggttccatacaaattttaaggcttttttctatttctgtgaagaatgtcattggtattttgatagggattacgttgagtgtgtaggttgctttgggtagtatggtcatttaataatattaattattctgatgcatgagcatggaatgtctttccatttatttttatcctctttagtttctctcatttgtggttttccttgtagagatctttactaccttggttacattattgtatttaattatttttgtagctattgtaaatgggattgccttcttgctttgtttttcatctagtttgttgttcatgtataaaaatgctactgatttttcatgtcaattttgtatcctgaaaatttactgaatttgttgatcaattctaagagtttttttggtagaatgtttaggtttctctatatatgtgaccatgtcatctacaaacagggataatttgacttccttctttccagtttagctgttcttttttttttttcttgcctagttgctctggcttattcaaaggttgttgacacatacatagatacctattttaaaagagtggcatgtgagaaaaatacaggaaatagagcccaataagatatgaatatttgaatttgctgatccattctttcatataggactataagatttaactcttaaaacttcaaaatttttctgtatgtactttccatcttgtaaagttataatagacgcgtgtcgttcttattggagtcaatgaattgggctctgtcatttgttgagatatcatccttctggctctggagttctgtaagaaaatgacaatatatttagggtgataaagctaatatctcaagtctcaattgtttgagagccagttatcagattacctttcacttctgttcctatcattttgttaataactattgttcatttatttatgtacttattgtctggtaccccactataatgcgtccatcaagagagcttacatctctctcagtagtctgtttccttcatttcctccaaatttccattaactttttaatctgtttgcttatttgggtttctgtctttcatattaggggctctcttcagatgataaggtgatccttggctgtctgtttcatgcttgagaatggggtactaaaaagatgactgggaactctatacatgcataaggcttatcaacagtggtttgtacttgtacggtgatctggatggcttgtttagaaggggaaatcctctgccagtatttttggatttttttctattagtttaattaacatccccagagcaaaactttcaatctttcaatatctaattgcagaaataaagcctggctgctggagttcaaggggctagcataggaaagagactagatgactccagtagatattatgaaaactttcactaaatcctcctttttcactttaacttttttactttcagctgcctggtatccactatctagatgccttctgtttttcctttccaggtaataaacctcgagtcttttgccaagttgacaaaagggatggtcacaccagtgtcaagtcagtactgagtctgcctttttattaaacaggctttcagccagttttactattttcagtccctctttactctcacttctagagatatcatctgccaccaaattcctaagcactttggggttctataaggcaaattgagttactttttagcttttgtcacaatcaattaaggcttcaggttgcttcaaattgttaaattggttaccatttatctttttactttttaactttcatgattttgttgctgctattattttctgtcatatttttgtcttgatgggtttgtatattttaaaaaaatacctcttccatgtcatactcattaggatggctactattaccaaacaaaacacacacacacacacacacacacacacacacacaaaacagaaagtaagtgttggtgaagatgtggagaaattggaaaccttgtgcagtgttggtgggaatgtaaaatggtgtggctgctgtaaaacatggtggtagttcctcaaaaagttacaaacaatattaccatatgatccagcatttcatttctggccatatacccaaaagaatggaaagcaaggactcaaatacatgtttgttcacccacgttaataaaagcatcattcacaatagctaaaatgtggaagcaaaccaagtgttcattagtggcagaactgataaaatgtgatatatacacataacagaatatgattcagcattaaaaagggagggaattatgacacatactatagcatggatgaatcttgaagatactatgttaaatgaaataaggcagtcacaaaaggaccaatactgtatgatccttcttatatgggatacatagagtagtcagattcatagagatagaaagtagaatgatagttaccagggatttgggggaagggggaaaggagaagttagtgtttaatggatatagagtttcagttttgcaagatgaaaaatgttctagaaatgggtggttgtaatgatttcatgatgtgtgaatgtacttaatacaactgaattgtatgcataaaaacagttaagatagtaaatgttatcttacatatattttaccacaattaaaaaatttttaaaaacaatgaaaaataattccactttacatttattttattctcttcttgggggagatagagactaattaatgtattcaatgtgttgcttaaaattaaatctattatttcttagtttacagctaagatgagcctttttagggctaaatcacttgccctggtcacagatctagtcattggcagcctagggtttgattcagttctgggaggaaggcagggtttgtatctgctgtgatacatagatcagttcgattcattctttcattagccagcattagaacacctttttcattccagcactcttgaaggtagcagtaagcaagacagtaaggttacatcacattaccatgtgagatggagaaaccagacagtaagcaagtatatacataaacaagacaaatgcaaatgtggctaattgttatgatggaaataaagtgctggctgaaatgtgggtagggaaggcttctctaaggaggagacttcagagttgtgacatcaatgtggagatggcctaatcagtgtgaacatgtgggcaggagtgttcctggcagaagcaacagcaggagcagaggcccagggctgggaataaggttggcatgtttgagaagatagaaaagaccagtttagcagaatgtactgaggaaggggaaggacaagtgatggggtaagaggtgtaaaaaatgcagaaccttgtgagccttggagtaaagcagccaaagctttcctaggtatacagaaagccactagaggggtttcaaagggaaatgatgattttactttttaacattctgttggctttcactttgtatctactgtatagcagatggtaggttgtagataccagaaatgcaatatgtaatactgttgcccacaaggaaattatggtctggtgaggaagaaagagcagagagtgccagaaaaatatagcagcatattccacagtgtacactttggggtactagaggtgatttttaggaaacaaaaattctttatagtagaacaatttatattcctttgggtatatacctactaatgggattgctgggtaaaatggttctttgagaaagaagttctctaagttctttgagaaatcaccaaagtgctttccacaatggctgaatgaatttacattcacaccactagtgtataggcattcccttttctccacaacctcaccagtatctgttatcttctgactttttaatgatagccattctgactgatgtgagatggtatctcattgtgattttgattttgatttctctaatgattaacactttttcatatgtttgttggttgtatgtcttcttttgaaaagtgttcatgttatttccccattttttaatggggttatttttcgcttgttaatttgcttaaattccttaaatattctgggtattaatcctttgttggatgcatagtttgcaaatattttctcctattctgtaggttgactgtttactctattgatagtttcttttgctgtgtggaagctttttagtttaattaggccccatttgtcaatttttgcttttgttgcaattgcttttgacatcttcatcgtgaaatcttagccagagcctatgtctagaatggtatttcctaggttttcttctagggtttttatagttttaggttttatatctaagtctttaatctatcttgaattgatttttatatatggagtattgattttatatatgatttttatatatggtatacaattaggtatataatacctaattgtatttcctaggttttcttctagggtttttatagttttaggttttacatctaagtctttaatctatcttgaattgatttttatatgtggtataaggaaggggtccagtttcaatcttctgcatatggctagttatcccagcaccatttattgaattggggggaggggtctttccttattgcttgtttgtgtcaactttgttgaagatcagattgttgtaggtgtgtggctttatttctgtgctctctattcttttccatggatctatgtgtctgttattgtactagtgtcatactgttttagttactgtagccttggaatatagtttgaagtcaggtaatgtggtgcctccagctttgttctttgtgcttaggattgctttgtctattcgggctcttttttggttccatatgaattttagaatagttttttctagttctgtgaaaaatgtcattggcagtttgatgggaatagcattgaatctgtaaattactttgggcagtatggccattttaataatattgattcctcctttccatgagcatggaatgtttttccatttatttgtgtcatctctgatttctttcagcagtgttttgtaattctcgttgtagagatctttcacctctctggttagctgtattcctagatatttttattttttgtgtcactattcaaaatagcaaagacatgaaatcaacctagatgcccatcaacagtggaccggataaagaaaatatggcacatgtataccctggaatactacacagccattaaaaagaataagattttgtcctctgcagcaacatgaatggagctggaggccattatcctaagcaaactaatgcaggaacagaaaaccacatactgcatattctcactggtaagtgggagctaaacaccaagtacatatgaacacaaaggagagaacagtagacactggggcctacttaagggtagaggttgggaagagggtgaggatcgaaaaactacctgtagagtgctatgcttatcagctgggtgatgaaataatctgcacaccaaactaatgtgacacgcagtttacctgtgtaacaagcctgcacatgtacccctgagcctaaaataaaagttaaaaaaaaataaaatagatgaacaaataaataaataaaatgtggttactagattgattaaaaaaatgtctacaatcaaatcaggttggggattcatatgtgatatttccttagagattctcagtgcacaccagcatattaaagtcccaattgttacatcacagaaacctgtgtactttgttcaactttacatttcctaaatttatttgcacaaatagcttctttcaaataataccttttaacatctttttaaactcctctgggaaacactgatttaaggcaacatgacaattatatgttaggtgttatggcaataatgaggggggcctaactaccacaactctgggtgtgaaacaggtaagcattcaggattgccttcctggagtaggtgacccctgaattgcttccagaaggagtagagaggttagccttgtgaagaatagagaagggtatttcatagagaaagaactgccaaaacacagatatgtagacccaaacatcccacatcatcatccttggaaaatagatttacaaatttccagcaggaagaggaaaaaaagtgcttgaagtgtgctggtttctcaccttagtggaaataattgcttaaaaaaacagccagaggctggacacggtggctcatgcctataatcccagcactttgcgaggccgaggcagcagatcagctgaggtcaggagtttgagaccagcctggccaacatggcaaaaccccatctctactaaaaaatacaaaaattagccaggcgtggtggcaggcacctgtaatcctagctactcaggaggctgaggcaggagaatagtttgaagccaggaggcagaggttgcagtaagccgagatcatgccactacactccagcctgggcgacagagccagactccgtctcaaacaaacaaagaaacaaaaaaaaccagagtagaatgcaattctcctcatctggatttcagcaagaattgcccatttctgttcagccgtaggcctccatcctctgttgccagtctgttcttctgactctcacctgtctcctttctgcacacagaaggccagagagaatgaacaattcttccccatgtcagttggctcacccttcctggaagtgtggatttcctgttagtacctgcaactctgtcggcgctgctatttctgtcttcgcgttgtttcagaatactctcacactgctgccccatttttccgtacgcagtcttccaggcccttttttgcacctgatttttgccaggcagcataattagaggatgttacatttccctgaaagagcatattctcatggacaacaggacacaagggagtaagaaagcttcaaagatgctggagggtctccctcctgtaccccaacctgtgccacttggtataacaggattctacatgagttagcttttctttattgttattaggagattaataaaaattgacctcatttatttagtgcttactatgtaccagacactgtaccaagaatttattatcattcaactttcacaaccctaaaatatgtgtattttacaaatgaggagaagtaggctggcgagtagcttgcccaaagtcattcaactcagaagagaggccatcgtttaatcttagattgtacttgtaaaattcacacatccaatacataatgcctttaaatgttctcattgttaacatttattttctttggattctgtgcctatttctgcttatgtctccggattacctgggagcttttaaaaataagaatcctagggttccactttataacattgaccagaagtcaagaatggggcccaggaattgctattttcagaagctccctaggtgactctaatgcagggctcttcataccttggtgtgcgtcaaaatcacctggtgagggaggatggctgggctccacaccacagtttctgcttcagtaggtctagggtggggactgagaatgcacacttctaacaagttcccaaatgctgttcatgctgccatcctagcacttgagcatttttcccaatatgtgtatgatccccctcccccaccaactgggtgacgtagatagaactttaagtgtcattaagttatgtcatgttttgaatctttctctgctcgatttccacgtcaacatgagtgagggcttcagggattttactccatcattttggctaaatgccaacttggcaaattccactcctcccccggagggactgcaaatgccagtgtcctccttcattcaggagtgaggtcattgtctgtgtggttaaaagtggacactttctgctgcttctgcttttgcactgtagtagaagtttcaaggagctctattttacagttccaaattaccatccctcccctctttaatgcttccaagatggatagtctctcaccataggttaatgtttagattttgatctctatttctcagccccccaaatctggatgatcctctggtgccagagctgttgcatgtatcacccctggacactttcttctctgcttgaaccagagaataattatatatagtagttcccccttgtccatggaaaataccttccaagacccccagtggatgcctaaaaacatgggtagtactgaaccctatgtatactatgtttgttttttttttttttttgatctggtaactgagaggattactaagcggacgacagggaggtagtgcctacagcatggatttgctggacaaagggatgattcacatcccaggtgggaccaagctagataacgtgagaattcatcacactattcagaatggtgtgcaatttaaaacttatgaattgtttatttctggaattttccatttaatatttttgtactagagttgaccatgagaaattgaaaccatggaaagcgaaactgcagataaggggagactgctgtgctagagtgctatagaggatttcatttggaaaaaaaaagttttggtcctggaaaaaaagtttaagaacatagtcgtattccatttcttcatatgtttgagatatttctggctttggtgaaacataggctaggaaaagaacctaacatcttattagtgtaactgaacaacagtaacagcagacttagcctttcttccttatgtgcaacattacctgtgacctgactcttgaaacatagctgctattaaagtacaagtgagtcatgcatagcagcttctccttgcccagttaatttctctgtaaaatctttactctcttttattcatgtatatatatgtatgtgtgtgtgtgtaaatatatacatatatatgtttgtatttccctttaaggatttcaaacacaaagaccctagtcatttgattgtctctgtactgtcgaattttgcctacaaccctgactgtagagacacattgttacctgttttccatattctgtctagtaaatgcttggttgtcaggacaacggcatagaaggtggaagctcattgataaccacgtgaattctttaaacaaatatgatcagagcaaattccagggtatgcttgaaagtagatttaaggaagagcaaaggtttcagacatatccttccttttataaacttgatattcatctttaaggatcagcaacagttggagttactcataattttatttaaaatcctgaataaagatatcaccttagttttatggtacgtttgtcattccagcttgttaggcatgagtgtgttgttactgacagagcccctggaggacaggcagacactgtggttctccatggtctctcagtaccaggcacagagcaagcacccaatacatattataggaataaatgatctcaaatcttcacagtgcctcttatagatggcttttatgatatatatctgcagagaaactgaattcagggattttaagtgccttttttgcaaggcccttaaagtttgggaaagtaggtgcatggaattagaactcagattatcctgacttctaagatcacactcttcattgtagcacactgccttcttgccaaaaaaaaaaaaaaaaaaaaaaaggaagaaacatgtaaaaagacagaccatttctaagatgaaatgtgtgcttttcaaaacaatagcagaaaaccttcttcaaaggtaaaatagttggaaatagaagaagaaataatatgtaatttagcgttcgttgaggataagcaattaatcctgccctccaggggtgaatttatgtctagcctatttgcacatgaaagtacaagttgggcttcatttctatgcaagtaagacatctggttgggaagtgaaaaattttgtcagttacctgaatcatgtttggtctacatgatagaaaagcccctgatgtcttcagatcaccagaagacatttggcattgtatagttaacaccagatccactgactgagtggttcacctgagagttgctgcttgacatcctgtagattcacccattgttaggaggctgttaccattttgtaagtcagcagtttgcaaacagtagtccagacgagaaaccaacgctggcccttgacaaagtgttcactggtgtgtgatgcaataaatacatgaggtcataaaaggaagtgtatttaccttaaaaaagaacatcctttattttgagatcctctgcttcctatgtttttagtgatacaattttgtgtcaaataaatcctcattgtaagatttggttttaattagtaaatgagacaggataaaaaattgagaaacctatataaatccctagttttctttatgtgatctttgtatttgattgtgaaaaaaaaaagcaaaattgtagaaaccactgctttaaaccttgtaatatttttagcacaatgacacctaaagtattttcatgtatttcccaagttttccttttcctagaagtggggtaactctccatggtagaactgtttgcatgggtcttgaaagcattggacatcttaacagtcaagtattttgctgacaaaataatgaattttccttttgaaacaagcgttttgttcttaaaataactctaaagagaacaccttctgcacttttaaagcatttccctctgaaggcatgccgtggagacatgaccatagggagaaactttttgtgctagaaaactgaattccaccactgtgaattttttaacagctttcacaggttctgcagtttgctctcatgaccccaaaagcatatatctccacatgctgtaacatcaaggatctctcctcaagctttgtaagctcggccagaatgagctgagtaccctctgtgtgtcaggcgatgtccaatacactgggaatagggagtcataataaccataattttatctgacttttgtctagcatttgtcatgtggcagacaacatgctaaaacacttatttgcattatcttgcttgattcttataaccactctgggagaaaaataacattattatagcctttttacaggtgaggaaaccgttgcagggaagttaaatcacttgcccaaggtcacaagccctgtgagtgataaagccaccaccatccaagcctgtccaccccctaacctgaactcccaagtgctatgctaaaccacctgcctcttatggatatattatctacaaaaagagctctgccctcaaggcgattataatctaaattagaagagggaagcacaagggaaaaagccattatgtagagcagaatgatgtaattccaaaaaacatgctgttggattgtagaggaaagagtgattaattatgatctacccagggaaggctttttgcatgtggccttaggctaggtgagaacaaaatagggcaccagcaattatctagagaattgggtcactgtgggtgccaaagtggatgatgatttcaagctaaaaagactatgctctgaatagttcagaattggccgcccacactcctggaatctgttgaatttttgccaactcccttgttctctttgtgacttattgccctggcttagatgagcttcctactccaggtgggggaagatgcaggatggtgctgccatagcagggagtgctgacaacgtggaagaagccttccttgagtcaggagctctggattcaatctagactctgctcccacaactggttgactccagggaagccacctccttctctgggttcagttttctctactgtaaaatgtatacactgaagttgatggtctgtatgggccattcaaaatcccgtgtctctgtttttggaacagagaaggaatcagaggagaggactggaagaagctaaaagattcagcatgttcggatttcatgactcttgtggttttgttcctagacaggacctaccaggggagcctcctgcaaatgaggtggtcttccttttctactcatcacattctatgcctgccctctctaacctacatggtatagtaggaagacgccataccatggagtcagagaatcttgggctaaaatcctgaccatgtcccattacatagtgactttgaacaaattatgtaatctttctgtgcttgtatttctacaactgtagaataataggttgcaatatcatagactcttcatgtagagaatctaattctattactataaaatctaattctaataccattggtttggtgttagcaatgaaggtgatagcaactgaaaagtaagaagagcagtgactaaaagctcataggttttgataaatgggcactattactattataatatttattgtgttaaaatacaaattatgtacagcactcctctgaacactgacctacaatagttaccagttgcttgttggacttcttgaaccagacttgaccaggcaaagagaatttgagaacctctatttcactaaaaaggtggtatctacaatatcttgccactgtagcatctgctatgtgtaatgagatgcttgggcctgctggtggtcacctattttctaggtatacgcattggcttttgtggtgtcgccatatatatatatatatatatatataaaatatgtattatatatataatatatatacatgatatagatataattaaatgttatattcaattaaaataaatataattttaaattaaatataaggaacatgagagttagcaggaatcatgggtgaaaaaaatatgtataataacaccacaaatgcatatatataggtttttgcccatgattcctggttaactcccatagcccttattataacattggggcacttgaggcctcaggcaacagtctctctcagtgaccccctctggtccttcttcacctgcccaaggtaggatgctaatttgattatggatcagaagaccctcattccagagagggtcctgccccatagcctagtggaaagaatgctacacagagaggccaaaaaaagtctgagcagatagtccttgctggatttagatcatatgctttttgtccaatcatatttttacatggttgtcaatcatgcctgtgtaaaaaagcctccataaaaacccaagagtacagggtttggagagctttttgattgctgaatacatggatgttcctggagggtggagtgcccagggaaggcatggaagctctgcgccccttcccccttaccttgccatgtgcatctgttcatctgtatcctttgtaatagtatttataataaaccaataaacgtgtttccctgagttatgtgagctgctctagcaaattaatcaaacccaaagacagggttgtgagaaccccaacttgaagccagtagttcagaagttgtggaagttggacttgccactggtgtctggtgcgtggggttgggggcattcttggggactgagccttcaatctgtgagatctgatgcaatctccaagtagataatgtcagaattgaactaaatgacatccagctggcgtctgctacagaattaagtgcttgcttggtggttgggagaaactcctacacatttagtaacagaagtcaccttctatgtggatgattgctgtggtgtaagaccagaggaaaaacatgatttcagagtttttccctcaacagccttgagatactccattttaataagatagagagatgaaagtgtattactggtgggattatgttagaaaacacatttcttgtcccagtagcattcaagatcaagagttaaacttaatacagtctctcctctttactctcccaactgatattcagcttcctgtgtgagtgtatgtttaatgtttttgtctaaattaattgatctttgtcttatgatctctcgtcttaaaaaaactaagttcagctaaatgaacattgctgagaacttatgttctagacactgctgacgttgtgctgaggggaaatgaatatagaggtaaataaaataatttgaactattctctgtctagtgggaaagagagatcgaggtataaataggggaaaaaataaaacacaacgtaagggtcataatttttaagttggattaaaaatatgtgtgtgtttctttattaaacacctcttataggccagactatcgggccagggatataacattatataaaactcagtccaaattgcataggtgtctacaagatgtaataactacaagatggcataagaagaggtattggatgggaatagtgtcgactagaaagtaagctacttgagcgtaggggccttaactatcttgttccttaatgcatttttagcattagaacagtgcttggctcgtatcaggtactcattaaacatttctgtagtaagtgatgaggctatcataaagttttgtttccccacccctaaaccagattgtaggttcagtctgaaaggactccaggaccctctctgctggtaagacatggtgccactttgtactctcccagccaatctgattggcctcttgactttggcaaaactgagctgggggctggcccccagtgccaagcacagaggaagcagggtcacatgccacccatgcccaaagctctttctgacatttccatgggcctggaaccaactctcctcctgggtttcatctcattatatgtgggaagacaaaagaacactgaaccttccagttaattcaacaccccgcccccacttaccccttcctggagaggataacagttctgttgaccattataatgcattttctgtctcccagcagtccacatagtcattaatttctgctgctgacatcaggaaagaggattatgtgtgtgtctgaaactgttcccaaagtgctcattagtcatagataattgaaaaactggtaggggaagatttggtgtaataggagcccccgcctgtgaagagggactgcaaccaccagataattgtagattccagcttttgaccactcagactgaatctgcccatccaaatgggaattcagcagacttgagcctaagagctctcagagtgatagtgtttttacatacccaggtgagggtgtgtacaccgagacagagacagccaaatcaagagaataggtgaactgcccttgggtctctttcctgccttcagactgtggagcagtgtttggaaaaagtgtccagtattctcctttattttgtttttatttcaacgtaagattgttttgatcacaaaagacatacaaggtcatgggatataagaaacacaaacattagagaagagtaccctacactggatcccaacccatgctgtgacaaaattctagggtttttctggaagtttatgtgcttacatttttatatccttttctttaaaaaaaaaaatcacatgatcatactaagaatactattctgcatcttgccattttttctgaatttatcttggagttccaaatctataccttaattcaagttcattcattttaatggcaaggtgggattctgaccagatttaagggggaaaaacatcttttaaaatattatacaagaggctgggcatggtggcttatgcctgtaatcccagcattttgggaggccaaggtgggtggatcacttgaggtcaggagttcgagaccagtctggccaacatggcgaaaccctgtctctcctaaaaatacaaaaattagccagccgtgctggcgtgtgcccgtagtcccagcaacttgagaagccgaggcatgagaatcgcttgaacctgggaggcagaggttgtagtgagctgagattgtgccactgcactccatcctgggcaacagagcgagactctgtctcaaaaaaaaaattacacaagaaatgtagaccaattagaaattagagaaaaaagaaaaaaaggaaagaaaaaagaaatcactcataattcctccacccagagaaaacctattttctgtatttttttcccctaggaatgtatttttacaaatagttcatctactttcattgttgttgttcttacagctgttaaaagaaaacctttaggcaaattaaatttaacagtttaactgtgcaaagaatgattcatgaattgggcaggtccccaaccagaataggttcagagagacttttgctcagccacatggttgaagagaaattacggacagaaaaagggaagtgaggtacagaaaaatggaagtaaagtacagaaacagctggattgggtacagctctgcatcggccttatttgaacagagtttgaacagttggccgcctgtgggtggttgaagtatgtcttctgtgattggctgagactcagcttctagttacaagagtaggttacagtgtgtttacaaatccagttaagttacagtcactgtgtatgaagaaacctttaggctgaagttacaaacggacacctttaagttaaacttaatttaacaaaaggaagtcatatactgcatgttttgcagcctctatttttcacttggtttgactgttttaaatataaaaattattccccaagcttttctttacactgtgtgtttatcttcttttttatttatttatttttttgagacggagtctcattcttgttgcccaggatggagtgcagtggcgcaatctcggcttactgcaacctctgccttcctgggttcaagcgattctcctgcttcagcctcccaagcagctgggattacaggcaactgcaaccatgcttggctaatttttttttttttttttttttttgtatttttagtagagacggggtttcatcatgttggccaggctggtctcaaactcctgactttgtgatctgcctgcctcggcctcccaaagtgctggggattacaggcatgagcaaccacgcccggccacatttatcttcttaaaaacccaacctgagcacttacagtcgtgcccctctgggcaattcctttttgcctggccacgcctgaagccctccgctgcctcttgtcccgtctgttccagttctctgttcctccttgttcccctttttgcgacatactaaatgcctcaaacacaccatgcccctcagggctccctacaggaaactcactttttgctctgctgtcatccctttccccggagcatgccagcactgaaaccaccaatctccaacttgcctttccacacaggcttgaaagtcatcttcaccttgaagactgtattcactctactagccaccctaactggaccctccacagttctctgggaacaccatgtacacatttcacctttctagcattttctacatggccctaagagtcttagtttttcatcatctttgtcccaaaccacaatatgagacctcagcacctagatcttagcacatggtagatggaaatctatgcaggcaatcattagttctattgtttctgaaatgtttgttaaaatgcatgaatgaatgcttgaatgaagcctagaaagaactgcaaatgctcaggcagtgaagtcttgatttctgggaaaagcaatgctgtgaataatttaattttatggtgaaagaaaagccaaacaaggattatattgggaaaagttgtcaggaggcactaatgtttgcctctgacagctctagtgccctcagtgtacctctggctgataaacttagagtgtgattttgaaggggtgatttctcagggattctcacctatttctatcatcctctctcatgccaagctgtttcattttggtctctaaataaacaaagctccttcctgcttggagtccagatagcctattcctgaaggctgtggttccaaatgaaagatgggatatttgtccttgtatatatttattttcatccctaaccactggattgaggagaaggctggttcactgctgtaggttgggttttccagaagcaaaggctgagacagatttggggggataaggtgtttattagggatggttggctgtgaaagaaggaagagagagaaggactgggtagagggaaaagagctgaactgaggtgcattcctgcagcaccttggtgaactcagcagagtctctggagtgagtggtgtctatcagagcccttctgcctctgctttgcaaagtcaccaggtactggctgtcctgggaggtgcatcaccttgggaaggcagctctctgcaactgaggcaggccctggaacatctggcagctgtctgctgactttactccatccttaagggggagtttgagccatggtatctcagtctctaccatgcttcctatatccacgcaaccactgtgacctgttatttcttgttccatggaatcccttctgtctgcctctgtttctacatctccgttaccaatatctcagtgaagatccttatattctctctctttctttgattactgaaatagattcacactattttccctaaccccagtctatcctctgctataatactgccagagagtgcttaaaaaagcacaagtttaatcgctttcctcctggcttaatgctcctttagtggtttacagtgggcttcatgattaagttcaaacacttaagtatggattacaaggccctgcatccactgccccatctgcctccccagcttcctctgtccttcaacacccaccccctaccagttcacaccccagcctatgttccaatttacctagcccttttgatagttcccttaggggccccttctcccttttttctgtccttgctcaagacgcatcctctgctgatgaagctccctgtggtcctatagcctataattagacccagatctcctgtctgcatgcccaggactctctctgcctcgcagtggtctgcagcctcatgttctgagcctagaggacatagaatcaaattaagctcctttaccagctaaggtttcttcctaaattactatagagaaaacttggaagagtgccccaccctgctaatcctgtctagaaccttttttataaaaattacaccttttatgtttgtggagattgggggtgaaggtggaacagaatttccattttgaccttcctatgaaaaccatttttaaaaaatctcaatttagtaggcaagatttctaaacggtgctcctttttctttttcttttttctttttttttttttttaacatacataatgcttgttctaaaaatacttctcttgatcctttcatccattcagaacccatttttaaacaacttttactccaaaaggtaatgtaatgaataagagcagaggtgtggatatcagtcagagtagaacccatggcctgtcttcagctcttaggctgtctctagggtgtttatttttcttctgtaaaccacaattttcccatctgtctgtaaaatgggggtagtatgggtcctattgtacccttcacagagggttaatatgaaaatgaaatgagaaaatgcatgctatgtccttagtgcagtccctagcatgaaagtgctcagcaaactggagtgcagtctctcctgtgttagatactagccatagtgacataattaagatattgtccagaaccgtattatacaaagccaaggacactgctctcttccaggtttctgctactttggcatttgaaacagaataagattttcctgttctctgccccatcctttgagcatcttatacttatcctccagaccatcagtgtccaatagaaatataatatgagccacatatgtaatcttaaattttttagtagccatgctgaagaaagtgatactaatttttaatgtatcttatttaacttagtatattcaaattattattttaacatggaattgatataaaaattattgaggtattttacattcatttttccagatgaaatctttgatatctggtgtgtattttccgcttaacacctctcaattcagacgctagatttttgttggaaatacttgatttagatttcttaaattaatctagaaaaagtagattcgcatacccaagttgttccgaacatacttaaaagtttttcagtaactgaatttaatatcagtttttaagttgaagttaaaactaaataaaactaaataaaatgaagaatttagtccctgagttactctagccatacttcaagtgctcagcccacatgtgactagtggctgccatattggacagcagagttcttctagaagtcactgcagaggtttcagtcttactcttcttagctaaacttgttttcatattcaattgtagatagaagctcttaaaatggataaaaatggtgtcgtcaaagtgctttggttccatttagaggaggttggttaagctgttcactctctgacccctctcccaacctccaccctcacctctacccccagaggtcctggagcacctctgcccagtccttgagctccatggaacaattaacaagtggcatcttagcactcaaaaattgctgattatgcacccagattctatcttggggctcaaaggggtcttaatatatctatgagtcaactcctagcccctccctgcagtgcagaaatactatagaatccttgggggatgagagagggctcgggctctgtttaacacctaggagcagatggatcatttcattctattctgtcttacgtggttctctgggttcttatcttgtcttcctaactaggttgggggcaaggactgcttttcacagccccacagcacccacacaaagcaagacaatcaattcttaactgaaggcctgactgcaagaattcaaggtcacttgaaaaatcagggtcactgcattgcacaactccaaagaacatcattcaaattgtattatatgattgtgcaagtggcagccttgtaaaatttgcaaaggtttagactggaatattttttccagctgagaaaaactttttaactaattatttgttggtacaaagtacacctttttcctcttatcctctgccaggaagcaactgaaagagtaagttttcttgacttaggaatatacgttcattagagagggtgtatggatgtgtgaacatgtgggtttacgtgcgtttaagtaggttagtagatctgctgtgttaggaagcccatttggaatggtttgagcatttaaaccttgtatttaagaggctactgtgtttatattccttttgaaatttcccattttcagaatctttatctggtttgaatgatgctttagagttccttgtttgtaaagctccacaaagcatgacccataggtaccaagcacgtacactaaagtcactggatgagcaaagggactcttgatgactgcatggtttttatctttgcaaatgcagaggagggaggagagagcaaagagtttctcttaaaaaaaaccctctgtttacttttgtgtttttcaaactgatggtgtttgttttttctcatgtctacccaggaaaccaagtgctacctcctggagcttctcttggaaatgggctcacaccagaggcagcaagagaccttggccttctccctgggattgcggtcgcagcttcactcattgatgcccatgcaggaggactaggtaatctcttatttgttgcctacagccaaaaccgtattcaaatggaatattccctagaaccgaagacactccttttctgtttttaaagcaaaggtcaaggactttggtgtttcaggatataataatgaaaagcctttttacagctaggcatttggatagaattacagaacttttcattaatgataaaatttatttataattgtattaatttctttatacatggcaatagaaaaaaatgtatttgaataactttctgcatagttcttttgtttactgaaaattcaaaaaagatatgttaatttcttgccacacttagctctactgtttttttgtaaggtactccaaaacccttataagtctcttagatttattttaataatatatttggcttatgtcctgtatccagttccttggctgcagtcttgattttatcttgtacataactctcaagtctttcattcatgtattcatttgttcattcataaaacacccgttgaacacttaccatgtccaggcatggtgctagaagacagtgaacttaaaacaaaaccaaataaaaccaaagtctcttccccagcttttaatgggaaaacacacagggaaacaaagaattacagtaaagaatgatgacttcctcatccttattgcaggttgtgtgtgttttttgcaggggaagttgttctggttctcagcatctctcatctcaactgtagccatatatttttttcctagcctttcattctaacaatgttttgttttaaactatgatttataattcatgagatcaatttagcaggacatgaccactgaatttgcacaacagaatggaacagaattgaatagaacaaagtggaaaacatcagagtacatttcacaaagtaagggaaggcactgctttgtggagctgtgtttccattctgtgtgtgtatactttcagacacttccatactctgcccatgcatttacacctctgtgacttggcacacatgttctttgtccagaatgattggtcctccacttctccagctggctaactcctcctctaactgcaagacccatatcagatgctttctgctctgcatagccttccatgaaacactcaggtgtatttagaaattctctaaattatgctttttttcagcacactatttgaagaaatgatcatattgcattgtaatttcaaatatatctgcatgtcatttccattagagtgtgaactccttgagaacaggaacattatgttatctgtcctgtatccttcatgccaagccctatgtctggttcctatagctgcttattaagtttattaaatgaatagtcacattaaggcaagaataaggtgaaatggctttaaacagtagagtgaagattaatctgttttcttatgcaacggattattaaatggtgccttgttctacatactacatggatttccagagcaggatcgctctcatcaatctatggacatgtctgtcctgttcatctctctgtcctcaggatctaaaacagtgcctaagaattagtaaacaactcataatatatgtaggttggttgaatgctatgtaacgtagttctgattacaggcaaggttgtttctctccaaatacttttcagtgtgagcaatgtgtgcttttgattggaatgttaagattttggtttttacatacaagcacagagagaacttgaggtctaggcagacatggagtgtttctgtcccctagcaatcctgacattccagatcatgtgtgaggccacaaaagctttctctgtcatgctttttaaattatccctggggtgacagtgtcaatcatccacccctacctgggtgacaatcacttggctgggaccggcatatgctgaaagaaagagaactgctgcttgaagagccgcaggcactacagtttccttgtcagtttcccagacttccctcagggacgtgccaaaacacaccttctcacttctgcccaggactcactatgtcctccaggaggggagactgtcaatgaccctcacctttttcctaaacagagatgttcagtggcagaagttttacccttagaagctttggcttaagccttttgttccccgtaaaatgcaaatgcttgtaagtgatatggtttggctgtgtccccattcaaatctccacagagttgtatctcccagaattcccacatgttgtgggagggacccagggggaggtaattgaatcatggaggccggtctttcccatgctattctcgtgatagtgaataagtctcacgagatccgataggtttatcaggggtttccgcttttgcttcttccttattctttcttgctgccaccatgtaagaagtgccttttgctcttcgccatgattatgagacctccccagccatgtggaactgtaagtcaaattaaacctccttttcttccttgtctcgggtatgtctttatcagcagcataaaaacagactaatacagtaaattggtaccagtagagtggggcattgctgaaaagatacttgaaaatgtggacacaactttggtactgggtaacaagctcatagagggaagagacttgccttgtctctgatgagactttggactgtggacttctgggttaattctgaaatgagttaagactttggaggactgttgggaaagcagctgggagggaggctgtaccctgcaaagccacagaggcagcgctgcccaagaccatgggaacccacctcttgcatcagtgtgacttggatatgagacctggagtcaaaggaggtcattttggagctttaaaatttgattgccttgctggattttggacttgcctgggccctgaaactcctttgttttggccaatttctcctggaatggctgtatgtacctaatacctgtacccgcattgtatctaggaagtaactgacttgttttttattttacaggctcatgggtggaagggacttgacttgtctcagatgagactttggactgtggacttttggattaattctgaaatgagtaaagactttgggggacttttgggagggcatgattggttttgaaatgtgaggacctgagattgggaggggccaggggcggaatgataatgatttggctgtgtctctattcaaatctcaactaacttatatctcccagaattcccacatgttgtgggagggacttagggggagggaattgaatcataagggccagtctttcccatgctgttctcgtgatagtaagtctcacaagatctgatgggtttatcaggcttttctgcgtttgcttcttcctcattctttcttgctgccaccatgtaagaagtgccttttgccctccaccatgattatgagacctcccagccgtgtggaactgtaagtcaaattaaacatcctattcttcccagtctcaggtttgtctttatcagcagcataaaaatggactaatgcagtaagttagtaactttcccccatatttttgttagtggaaagatagaatagtttttttttgttttaatggaaagatagaataagaatcttggattctttaaggcctgaacttagatgccagcagtggctgggaagggcacaggaaggtgatagtccatgatgacgggttgatacagacttacttaatatatgttgactatgttttatccttattatgccttcttatgccttcttatgcctctttctttacccttcaccttacagccaatccaagagttggatatctcaaaaaaattaggaggcctgggtgcaaatgtttcctttcatttctacctttcctatacccctattaggatgtggaggtgaacagatgcctgaaaatcttgaaaaggttgtccatgggtccaactctatattaactaaatataattgagtgaatgcaacctgtcagtgattggtctaggcactggagattattagcagtgaacaagtcaggcaaagtccattcgttttggaaagaaaattctcattgttctcccctgcctgcatgtttgtagcttaatagtataggtttgggacagctaatccctgagacatattgtgatgctatgacaagggcactcaaaatggaattttaagttctggatttagattgtgtttctgcctacaaatatggtgcttcgcagaacttttgtctcctgttatgcagtgagagagtgagagacaacagaatgcaggattcactactttgtgattctgtataggttgaggtcagtaatagcctcaagaactggctaaatgaaccctgtgttaagagatttctgaatgtcaagtacagacacagctttggatttggaattgccacccaggaagaggccatccaggcctctcaccaacaaaccctgacaactgtagtcacttcaaatgctgacctggcatggcctgcttgaaaccccacattctgactagtatgaggggtcagcactctgctttagagaaatacccctggactttcattcccaagggaggcctgggatgggaggataaagatcaaagaagcaagcaaaactcaacccatgcttttcccagttctggaaaaagaggaggaagggctttgtgggaataaaaatcaatgataaaagaacattttgttcttaaggtgctggttagtaagttctccagcagacagtcagaagataggagtagctttgtttgcactttgtgggggtggttctggccagggctcctgctgctgatatttttctagcttataaaaataacattaacttttttccaggtcttttcttggctccagcaccccaactgccctgaaaggcaataacaacctgatttctgtctcaggcccttctcttctcagttgctctttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactatgcccggctaattttttgtatttttagtagagacggggtttcaccgttttagccgggatggtctcgatctcctgacctcgtgatccgcccgcctcggcctcccaatcagttgctcttatctggcagacagactcctgattatccatcaaatcttgaatcctgttctcctctgggaagccctccctgacttcccaagttgacttaagcactctctttttcccccactgtgtcttgcgcttgcaggtttgtgtgtgccacattgcctcatctactaatttataaactctttgggcaacctgttgtttcatactcccactgcagcagcctgcagagtgctttacatatggaggacccttaacacatgcgtatttagtgaatgagtgaatgaatgaatggcattccctccatgaggaacggatattacaactgagagagagagtaacctctcattcaaaggcaattgtccctatacaatagttatacttggcttatttctgcaggagcaaaagtttgggttcttctagatgtttggaaatctgtctcctttttgccctcatcacattaccaagtttcggccaagagcaagctttgttccttggtttagcacaactatttgattaccaatattggattatttggcagatgttgaactggcttaaattgctcatctgggccagatattgaattggtttaaactgctcatttcaattgcagagccaggccaaaatgaggattttgaatttcttttctttttaaatggaagaatttattgagccagtcttgcaaaaagggcctttggttcatgccctagaacaacacatagtttgttccagtaaacaataaaacatgccaataacatttctcaccattatcagtgttctagaagacaggataaaggctgcgatctaaagcctgcgactttagataatgtgatttggggggaacatttatttataagtagtatatatactaaatgtagcatgatggataaagaaatatacttattggcaatagtccattgcgtttgtaaacttttgatttatgaagcatgatatggtttggatctgtgtcctcacccaaatctcatgcaaattgtaatccccagtgttggaggggtccctagtgggaggggattgtatcatggtggtggatttctcatgaatggtttcgcatcatccccttggtgctgttctcatgatagtgcatgagttcccttcagatctggttgtttaatagtgtgttgcaccaccccactctctctcttgcttctgctccggccatgtgaagtgcctgcttccccatcaccttttgccatgatcgtaagtttcctgaggcctccccagaagccgagcagacaccatcatgcttcctacacagcctgcagaaccttgagccaattaaaactctgtcttctataaactgttcagtttcaggtattcctttatagcaatgcgagaatggactaatacaaaacacatctatgttcattatagaatttgctccttatagcaactttgtagtgaagttaggacaggtatgtgttccctcattttgcacagcaaacagctgaggctcagtgtattataaactcaagaatagatatttatcttacacttagttcttaaggcaactttatacatactattattctatttgtcagatgagacagttgaggctcacaagactacctaacattctgagctacacagttaaatgagagatgcgtgacttaagcccatgctttgtgcacacttatcactgtgttataaagaatggcctacctatttaaacatgatccactctgctctttaatttgaccctaaaaatgtgagcaagtaacaaattttgaaaaaggaaagtctttaatatttattgacgacccactttactagttcatggggttagacagtgactatgagagagaagtggacttctgggaatttgtattctagtaaagaaaatagacaagtaaataaacagttacggttacttgtgccgtgtatggaaggctttggaaaaacataaaatgggcctaaaattgagacttaaacaattattaaaggattcctagagggagtgatgtccagtaatctaattacgacactgctttccctgttattgcttcctggtaaagtggaatttatatattttttgcgacttttaaacttcaactaggcttcatttctaataataaaataataacattgttaattagaacaaatacaaccaccactctgactggtactactatgatgaccatttcttacatgtgtcctatgtgccaagtactctacctgatactgctcagactttatatcttgctcctcacgataagcctacaaggtagaggttgtttccccattctgcatgagggaattgaaggcagaaagaataatgtttccacaatcacataactaatctcatagcaagatttgaaattgagtctgcctccaaggttcatatatcttttctctaggccagtggttctcaaccaggggtgatttgacccctcaggggacatttggcaatgtctggggacagttttgtttattgcttctggggaaagggaaatggcactggcctgtggtgggtagaggccagggatgctgccaaacaccttacaatgcccaggccaaccccctgcaacaaagaattatccagcttcaaatgtcaaatgtcagtagcactgaaggtgagaaaccctattctctcctggaacacctccagtgatattatttctcttcatcaattcagcttatttctatagaagccaaaaagcagcccacaataagggttttgctgatacattagtactttgttgaaatgtgttttgtgaaattgactcttcagtaaaagtagttgtgagattaagaaaataatagaagtgaagcctgaggagtagggaggacaggatggtttctagctcatctatttcagagtcaagccacacgggacaacttggccgtctttcagcacatcatgcacattccacctcctttcctttgttactcatccatcagcactcagtctaaatgttactttgtggaaacatctccaaatttaatccattcttagaaaagcaccaatcactctctatgctgtatctgtgaaatactttacaactatttcagttttttcaccaaatcatgttcacgtttgtatgcccatcatccagcatgaaatccacatagctggtcttcactaaatcaatgtaattatttaattactattattagtaattaagataataaatataagagggttttgaaaaatccagaataagaattggtaaatataggtgagggagactttaagaaaatatagattcccatgccctaccctgctgaggatgcctggaatcttgttctaagtgtggaaaatgtcacctggtacccagaggagacagcctggggggatgagttggcactgaggacactggggtcagaagcagtattgatgtgtttctgccaagtaggcagatcagaccagagcagaaccgtgctgcgcaggagccaggccaggcgctggccaaaagctgggggcaggagggagcttgtccaaaatgagagagaatatggatccaaagaggcagacggtctgcaagaaattgggggtggggggggattagaaatgcagataaagtcatgccgtggaatctggaaggagaaaaccgtgccagtccctgagcagatagagcaaggacaactctgggagttcctggatgtgaatcacagagggcagaggaagaacgtattcatgggattgcaagtttattgttttaagttgaggttcggtttaatgcgacccactactgcctgagacctcggcagttcatgagccgtggcaacagctcatgtgatggagggaggggcagagagcatacgtggggggaaggataactgagtttcctgttcccaggctccaaggctttcttggagtgctgtgattctctggactgcagaaggctggccttagctgagagaccagactttgactctgtggaagaaaaccgagagaatccagggcctggtgctattgccagctccccatgtgtccccagtttttaaatcttgtgccacacgtcagtgtatatggctgtgaacctgccatgaaaccataatattttgagtttaatacatacactcctgtttggataatgagtaatcataggctttagaactaaaaggctgctcaaagattctgtataccaaattcttcaatttgcagatgagaaaactgaggcccagacaatggtgaatcatccaaagttaccccagcatattactttcagagtcaaatttagaatctgagtgacctagttcatcagccagggtccccgccccattgtactacactgtctccagattaggaaaagggaatgactcctgatttgttattccattttataccttatatcccatttaatggccacaggcagcttcactggtggttattaaataggtaatttagttttcctgagccacacttgagtaaatctctttgttttgttgtcacaatctacaaaaagctccaaagaatctcctccagagctggaaataataaaaacacctgctattcgagttccttccaaagagctcaaagcagttatttttatttcacctaccaatcgttgaatacctatgctgtgccaagtgttttgctaggtacttgactattcactattgtgagctcacaaccacactgtgagctacaattatttttggactttaacatacaaggatgaaggtttaagaacctgccaaaggttacattttaataaattataaagttgggttcctggacccaccgattgcagagcctatgagctctcccgtgttgacctggctagtgaatctatttgtgtgtaggtatgtttgtgcctttacttacgttagcccatacttacaccaatgcatatttgtatctatagtggaagatagagcttctgcttaatatccttctggacgtttgtagatctattttatggatgagaaagttgaggcccagggtggagaagtgactctaataaagtgtatttaaagcagcacaggagtctgggttccatcaatcatggggaataaggccaggcttattagatcagggtaggaatgggatgcgtagctattggggttgtgtggtggagagataaacaatattaatgttgacgttaattttgtttactaaatttgttaattaatgcttacaatctcaatctcaaagattaatcttaatctttttgtagtgacttgctgtttttaaactacccttggaatagggaaggtatttttacctcccacgaatggttgggaaaactgaccttcgaggaggtgaagggatttgcctaaggttacaggaccaggaagactggatccaagactcaaacccttatttgtgtgcctctgtcttcacatcagctttagtgcaacccttgcatcaaacaatggaaaagtagtacctagtaaatggagcaaggtgtcttattctgtgcccagagcctctcattttaaacaagctctgatcatctcatctactacagaactgtatctggtattctggggccatttttaaacagaaggtttcacttattctctcctgtattagtatatggccgagaaaattagctgagctgttattttcctttgctgaactggggaacaaaaacaaaaaaacacacagtaatccagccactggttctgacactgccaagcacctgttaggaggacttcctactccaagttcaaaaggtacggactgctagaaaagtgtgtgtttgggggcccagagtctaagattgcacttgcgtcactggctgcaagagtaggatcaggtccactgtttttcatggcacaaaaactcaacagatagtgcttcacatccatatactgtttctaagcactaatgtttactttgggtcttgcacatcagcagctgatggtgggaaaatacacatctctagttattgccccaaggcggcagcctcacatctaaactgctggcttcttccttattatctctccacaggcctggttcatttccttgttttcagttttctcttagctgtgcattcatatcagtcattgtaaagagcaaagagaaataattttaaaaattttccatatgggcatcttgagcattgcctcagtacactctgtagctagtatagatatctggggaaactaagaaggaaaatttctttgaatatagaaaaatcatactagtctccagttatatcattcaacagcagtccccccagcccacctttccatacctctaatctgtatctgtgctttgtactatgactctgatgtaagagtttggctctctgaagatggtaaaaatttaaatgcttgaggtaaacacagtaagatagttaaaaacacactactggttccatcagctgtctctttgcccttggaagtcatctgacactgatggcagcagtgacccatctggagcagccactgcgaagatgctggctgcagtagaggaatgcactctgcagagctggctggggccagaacaggtgggagccctgtcccctaccaagttggcagggtgggagccccatgctcccaggcacatctgcagccgcccagctgcggctctggacctgggcatccctacgctctcaggggcccaggaagccccccttcctttgcagacttggaaatgcttgctcctactccctggcctcttcccattgctggtgcctgctctggagtggggcagagttgtggctgagcccagtgctgtcacaatccagccaggtgtacatgcacttgaggtggtgctgacacgctagcctcctgccaccttggccctctctggaccttgggcgccaacgagcatggcaggagctgagggcagctcggctcaggcctgcaggtgcctcagtaggaacagactgggtggcgggttgatggcaggaggaagcagacaggctcctgggcagaaaggagcgggtccctggcgaaaccccaccttcaagccagggacagtccgaagcctggtggctggactgccagttccaagtggagtctgtggcccagagtgagaacttgtgttgctttttctgggtccacccatggctacccatggaccaatcagtactcatttcctcccttctgagcccgtaaaaatccctggacccagtcagacacggacagactcaggactaccagctgcaggaaggagctacccactttgggtttctccacccattgggatgacctgcctgcagaaaggagctacccacttcgggtctcctctccactgagagctggacactcatctagacgacctgcctgcagaaaagagctacccactttgggtcttctgagagctattctgtcactcaatgaagcttctctccaccttgctcaccctgcagttgtctgtgtatctcattcttccaggttgtaggataagaactcaggacccactgaatggcaggactgaaagagctgtaatacaaacaaggctggaaacacatccctccggctcactcgctactttgtgggcaatgaggagagaagagctgtggcccttcatggagcccagacctaggggctccccaagccaggggtgtgacactgtctttaaggctttgaggttcatggcatctccaagcctccaggtgcccgtgttcccctcatccagatgcgggtgcccatagcagaagccccatgcagcacatcagatccagctgcagccttgcgtggagctggcacctgtgccagcacctgtagctgcctcccctgccacagcagcttgcttgtctggttgtgtgcagtggccggactctgcacttgctcacccacacacccctcactgctccacgcctgggtcacccttggtaggtgtgggatccaggatggtggcgtgagctgagcccagcctgctgggccaagtgggtggaatgagcccagcaggcacgagcaatactcaggcagaagatgccaccagccacagaggtttccggctggcaaagtgacaccccgaggatcccatgacagtacttcatgcctcagttcccccatctgagaaatgggaataatagtacctcttgcatagatttgagtaataaatgagcttttatttgtaaagcacttagaataatgtctggccatactctgtgtgtgtttagctatgattaatgtgattgcagtaaagttacattatgaatagtagcagtgagcaagagaaaatcaaagatttattacttgatttacaggtagatgacgtcttccttctgtgtgtcaggcattgttataggtatgttagatacagtggtaaacaaagccaagctccttctcttatagagcttctatcctactggggacgttcataaactcccatttaaacatatgtatttataggtatatgtaagtatacatatatgtattgtatgtgtgcataactgtgtgtctctgtatatgtgcatatttataagtgtcttcatacacatgtgtttatgcatggatctggtatttatacatgtatgtgtattacatgtgtatatctgtatgtagttgtgcatgcatatgcatccatgcctgtgtctgaatgcgtgtgtgtatgtgtatatactgtgcatgcacatgtttgcatgcccctatttgtatgtctgtttatgtgtacatttatgtgtgtgtctgatttgtgatgtgtttatgtgtatgtgtgtatattctaatgttcatgagtgtatatgcatgtgtccgtatatatgtatgtgtatatgtgagtggatatgcatgcatgtgtttgcatagggtactgctgagtgttatgaagaatagtcctgattaaagtgatggaaagttccaggaggtgctactggtatacagaggtcaggaaagttcagtctagaatggggacatttgaggaaacataccttaatgaagagaggaaatatttcattgtgtaaaaagcaaggcagagattttttcaatcagcaaatatatgttgagcacatactttgcctcaagcatgtgctgggcactgggaataccaggatgaagatgacccagtcccttctctagatgactcagcagctggtggaaatgggagatctgtattcagaaaaatcctaatacaacttgcatactgcttttccaggcggtgtaaaaatgttacaagagtatagggaatggatcagccagctcttccaggacaagttaggaggtgaaaactcctagaaagtgaaaacttggataagccttttaagaagcagtagtagaatgtgcagaggctcagggacgttaaaatgcccttcataatcaaggaacattttggtgtggccacctcgccattcaaatgtgcgagaggggcagcgagaggcagccgggaagacggagcctgtgtagcacactctgactggaatcagactgcctgggttcaaacccctgttttgccacttgttagtaaagagcttacctgctctgtgcctcagatttcccttctgcaaatggggatgggaatagtgcctcacagggttattttagagatgccttctcctgacacattgtaagcactcaacaagtgttagctactcccagttggaagctagaatgtaaaaggccttaaattcccagccaaagagattgaatgctaaaattaatttcaagcaaacctatctgttcaaatagctttctcagcactgattttgatgtgaaaaatatctggaatattcttcgttatcaagcatgtgccttggtagtgtaattacagtttttaatactaatggatgatcttccattaaagtagtaaaaagataccatctcattttaagcttagagcaaaagcttacttaagtgaaattaagcagatatttattttgtcaggctctggggaggattccgaaattatttgctccctactagtgcctagcactttatctttgcaaccgcacttaccctgtagagtcatagttgcacaggaaactgtattcctgcatctctaccttcagtgtttcacgatcactgtttctcatctgccaggcctgagggtgggcagtgctgatttcactgtctcatacccactcttctttctgccagtgtcttttgtgagagcaattttatctctgcccctttctcttcaccccattgtctcttctccagtcttcaaacccaaacaaaaaacatacaaagtttgctcatattcactgcagtctgagctgctgaatgttcttccagagccccttaggatttctgcacccatacttgtaaatgtttgcatcttcattttgttggtggtgatgacaaattaccccacataacttgcctctgttcctgttttagttagaaattactgtttactggagacagaatggaaaatgtatgaaggggcaacatgagaaaataggttattttgattacttccaatcatccatcgttaatcgaattcataatatagataaccaaataaaaagattatttcaatttaaacttagaatgacttataggtttttttaatctgatttccattcttattacttcttgcagcagttttcaaacttgagtctgcataggcattcatggagctagttaaaatgcggatggctgggtccccaccaccacaactcattctgatcagtggctttaactggggcctaaatatctgcactgtatccagcccacacatgagcctgatgaacttcaccagtggtaccttaaaagatagcaagaggggcagactaattagactcaacgttgtttaccatcaaaaactgtctgtacataatccagaaagagcaaagttgaatccaggctaattgaaagactgcattttaaattttttgtttcaaaagtagagcaataaagagtttttccaatgtgttatacttcccatgagctggatactacctgtttacctagatgccacttaatgtggacagcaacttttatggctgtgcacattctcaccacccccatttaaagagaggaaggagactcgcttagactcaggcagctagtgtggttgaacagagagaaccttggtctgtctggccccagcttgctctcttttaccattatatagcttcacccaagccagcgttaacagctgtagatgattttcttctaatgttctaaaacctgaagacatggggcatcttttaaccaaatgctcagctctagggaaagctaagcctcttctattttgttgaaagataaagtgttaggctgtcgatctgtattgttacaggtccctgggctggatttagcctcaggagttaaaagtatatcagccttgtgactcaccaccatgaaaccctcagatgggagtctcctaccagtatcaataatatgaatgaaaactttatatgccttctggattgaggcctctcacagctcaaagttgtaaagaaaaacccacgcaattggattttgtgaaatatattaaatatgcccagtaatgtggctcttcaaaggaatttatatactgtctgctttactgtggtgtatcattatagctcagccaaatgcgtggcctaataatttgtttcccttatgcatatccatcattaaatgtaacatgcagacaataactatttaaacacctaaatagatgattatatagctgtctgtcccacttagactgtgaactttttatgaacaatggaatctagtcatcttcatctctgtgtctcttagctcagtaaatgaatgaatatatgcatgaatgaatacatgcgtgaatgaatgggtttgcttaacatgctaagcactagactagttactgtggcaaatacagtgatacaaagaaatagaggcagatggattgagttctacaggaattttaaaaagggaagaatcactttcagttgaaacagtaaggcaaagaaaagacaaaaatactaatatttattgagggaccttcctgatagaaatatgctagagagtctacatgtataatcttcacattgactccagcagcttgctcaaggtcacacagctggcagtgagaaccccctgaggttagctaccatggtccttctgggaagtgggaagggatagcctttgaatgaatctgggagaataggtgtattctccactggaagcaatgaaacgtagagtattctggatggagagaataacataaatggaggcactgagatgaggtcgtggaatggtaagcatttcagtttggctgaaatctatgatatctctaagggattcctggaagaagaggatataatgatcaaataggtggagatagattgggagtctgtcccatctgagtaccgttttggagtttgtgcttcctctttctccctggaggcattggcaaatcattgaaggtgatctcaagccagagattcattttaagcatggctttatatacttttatacacaatagttgggggaaaaggcaaagaggtttcctgaaataggttttggcagtggggcttgaaaagaagatagggagtttgacaactttttaaaacaaatccatgcattaggcacaagttatttaaaatttttgatgttctttatattcttctagctctttctatttacatagctattactaaattaaatgtataaaagtatttttcctttttaatttgaaatagatttcatctcatatttggcagaagataataataacttgttaacttcaaggcagtcagggtaattcatccagtctcaaactgggcattcatttaaatctattgtcttagatggagatatctagtatactcactcatttaaagtagagccgtaaatcctgaagttaaataagcaaaacaaaaggcctcccaaagctgagaaaacacttgccatagagtgcacatactgtaggaaagtacaaggattattctccggctgtcacccagcactgctaacttagaattatagataaaatatgctgtaattttaataattaatagctgactatgcaaaaatattattttctcctagcttcaaccaacaggtaacatatctgcctttcatgtcaggtactgtgctaggtactaaagatataaatatgaacaaattatagtctctgtcctcaaagagctcccattctgattggacaaacaggcaagtaagccatccgagtatgatgtggaaagtgtctgataaaagcatgtctgggctattacaggagtctaacctcactttacctgagcaagttagtaaaattccctccccttcccccaaaaatgattggtttgacacttaaagatgaattggagggagaaataggaatttatcagatggacaagacggctaggcaggaaggagggtgagaaggagagggaagcagagggaggtagtatgcaccaagatccagaagcatgagggtacccctttggctgcagaataccgagtatactatagtgtagagtatgctgaaatagaagtgtgagagatatatgtggggacaaagtttttgagggccttgaacatcatttaaaagagattggaatttttatccttaaggtactagcttgtaaacagaaactttagaggcagtgaggttaatggaccagaagacgggactgttgtaagagaccttgaaggccagaactgacgcagttccaaggcagtatcaatggaacaagaggggacattaaaaaattaaaaataggctgatgaacagtgatggggtcctttaatgcatgggcttaaagtgctacatatatagctctctgaagcaagagtgcactggacaatgatggcatggcactatttaacagaagtaagcagagtctatgtgtcaggaggattgagtgtaagtctcaaatctgcccttaccagttatgtaacttctacaagtcacctctttaaacctcacttttttatataggtgtgaagatcaagattcatgctttttcttctaatatatccacttttatatgccaaaattttcctactattgaagtggtattgttggaataaatgtgatcacaaatagaatgtatttaattcattaatttattcacttgccatttattgaatttttttttctggcaacaatgggctgtcctcttggtcccccaaaataaaaagctggtgaaaattaaatgtatccacatattcaactcacaaggcaccagagagctactaaaggacttgaggggccaagatcaaaagagaagcctacagagctgggttcaacatttccacccttttatacgctgagcatttactgacttgctgagatttggactcaacatttccaccattttataatacactatgagcatttgctgagttgaaacctgcaactcagaggccaagaagctaaacaccagtttgggcagtctgcaggctggaagtatatatatttgagtttggacatcattgaagagggagaatactagtaaatcctctaggtgttatttgggaccccgaaagtcagtgtaaactaaaaatagacaaactttacaaaggccaaagcctgggtttgaattaaattaacatctgattaaattcagatcatctatccctacttgagctaactgcaagaagcaaggttatatcctttctagaggtaggtaacataatcagaagctcaagttataactaaaaggtttcatatgtaatgtctgcattgagtagaaaataagcatgtaaaatatgaataatttcaaaaatcaagagtaaaaacaaagccacagaaaagtccatatgctggtggtatttgacatgaactctaacatatctgtgattaatatggtcaacaaattataggagaagatggagaattcagcagagatctgggaagtagaaaaagaagtggggattctagaattgaaactaataactgagattaagaattgactaaatggagtaaagtcaacagcatacaatataattgaaaagagaattagagaactgaaacatagatctgaaaaatctatttatactacagccagtatacaaaaggatggaaaatacatgaaatacacaaacaagtatgagatatatggagcatggtaaagaggtctaacagaggtgtagttggagtccaagaatgagagaagagagataataaatcatacatagaagctatatttgaagagatattggccaaaagtttttcaaaacttataaaagaactcaagtgagttattttaacttttgaataatcaattaatgcaattccatattaaaaggatgcaagagaaaaattaacagttgtttacaaatgcttttgatacaacttagcacatattcatgatttttttaaaaatcatggcaaactacgagtagaaaggaacttattttgattaaggatatcaacaaagaaaaaaacataatgcaaatatcatacttaatggtgaaatattacaatgttccaattcttaccacgtttattccacagggcctatctagtgcaacaagtcaagaaaaataaatggaaaatataagaattagaaagaaagaaagctaacatcatagatgatacaattatacacatatagaatgtcaaaagaatctatagataaaatattaaaattaataagtaatttagcaaggttgctattgcagaaagtcaatacaaaactctattttatttctctaatccagaggcaaccatttagaaaataaaaattttagggaggagccaagatggccgaataggaacagctcccgtctacagctcccagcttgagcgacacagcagacggtgatttctgcatttccgtctgaggtacggggttcatctcactagggagtgccagtcagtgggcgcaggacagtgggtgccgcgcaccatgcacgagctgaagcagggcaaggcattgcctcactcgggaagtgcaaggggtcagggagttccctttcctagtcaaagaaaggggtgacagcacctggaaaatcgggtgactcccacccgaatattgcgcttttccgacgggcttaaaaaacagcacaccagattatatcccgcacctggctcggagggtcctacgcccacggagtctcactgattgctagcacagcagtctgagatcaaactgcaaggctgcagcgaggctgggggaggggcgcccgccattgcccaggcttgcttaggtaagcaaagcagccgggaagctcgaactgggtggagcccaccacagctcaaggaggcctgcctgcctctgtaggctccacctctgggggcagggaacagacaaaaagacagcagtaacctctgcagacttaaatgtccctgtctgacagctttgaagagagcagtggttctcccagcacgcagctggagacctgagaacgggcagactgcctccttaagtgggtccctgacccctgaaccccgagcagcctaactgagaggcaccccccagcaggggcagactgacacctcacacagacctgcagctgagggtcctgtctgttagaaggaaaactaacaaacagaaaggacatccacaccaaaatcccatctgtacatcaccatcatcaaagaccaaaagtagataaaaccacaaagatggggaaaaaacagagcagaaaaactggaaactctgaaacgcagagcgcctctcctcctccaaaggaacggagttcctcaccagcaacggaacaaagctggacggagaatgactttgaagagctgagagaagaaggcttcagacgatcaaattactccgagctacgggaggacattcaaaccaaaggcaaagaagttgaaaactttgaaaaacatttagaagaatgtataattagaataaccaatacagagaagtgcttaaaggagctgatggagctgaaaaccaaggctcgagaactacgtgaagaatgcagaagcctcaggagccgatgcgatcacctagaagaaagggtatcagcgatggaagatgagatgaatgaaatgaagtgagaagggaagattagagaaaaaagaataaaaagaaacgaacaaagcctccaagaaatatgggactatgtgaaaagaccaaatctacgtctgattggtgtacctgaaagtgacggggagaatggaaccaagttgaaaaacactctgcaggatattatccaggagaactcccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtagggttatcctcaaagggaagcccatcagactaacagcggatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcttgaaggaagtgctaaacatggaaaggaaaaaccagtaccagccactgcaaaatcatgccaaaatgtaaagaccatcgagactaggaagaaactgcatcaactaacgagcaaaatcaccagctaacatcataatgacaggaacaaattcacacataacaatattaactttaaatgtaaatggactaaatgctccaattaaaagacacagactggcaaattggataaagagtcaagacccatcagtgtgctgtattcaggaaacccatctcacctgcagagacacacatagactcaaaataaaaggatggaggaagatctacctagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatgtgcacccaatacaggagcacccagattcataaagcaagtcctgagtgacctacaaagagacttagactcccacacattaataatgggagactttaacacctcactgtcaacattagacagatcaacgagagagaaagtcaacaaggatacccaggaattgaactcagctctgcaccaaggagacctaatagacatctacagaactctccaccccaaatcaacagaatatacatttttttcagcaccacaccacacctattccaaaattgaccacatagttggaagcaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatcttctttgaaaccaacgagaacaaagacacaacataccagaatctctgggatgcattcaaagcagtgtgtagagggaaatttatagcactaaatgcccacaagagaaagcaggaaagatccaaaattgacaccgtaacatcacaattaaaagaactagaaaagcaagagcaaacacattcaaaagctagcagaaggcaagaaataactaaaatcacagcagaactgaaggaaatcaagacacaaaaaacccttcaaaaaattaatgaatccaggagctggttttttgaaaggatcaacaaaattgatagacctctagcaagagtaataaggaaaaaaataagaatcaaatagatgcaataaaaaatgataaaggggatatcaccaccgatcccacagaaatacaaactaccatcagagaatactacaaacacctctctgcaaataaactagaaaatctagaagaaatggataaattcctcgacacatacactttcccaagactaaaccaggaagaagttgaatctctgaatagaccaataacaggctctgaaattgtgtcaataatcaatagcttaccaaccaaaaaaagtccaggaccagatggattcacagccgaattctaccagaggtacaaggagtaagtggtaccattccttctgaaactattccaatcaatagaaaaagaaggtatcctccctaactcattttatgaggccagcatcatcctgataccaaagccaggcagagacacaaccaaaaaagagaattttagaccaatatccttgatgaacactgatgcaaaaatcctcggtaaaatactggcaaaccgaatccagcagcacatcaaaaagcttatccagcagcacatcaaaaagcttatccaccatgatcaagtgggcttcatccctgggatgcaaggctggttcaatataggtaaatcaaaaaatataatccagcatatacagaaccaaagacaaaaaccacatgattatctcaatagatgcaggcctttgacaaaattcaacaacccttcatgctaaaaactctcaataaattagatattgatgggacatatttcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggtaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttatacaccaataacagacaaacagagatccaaatcatgagtgaactcccattcacaattgcttcaaagagaataaaatagctaggaatccaacttacaagggatgtgaaggacctcttcaaggagaactacaaaccactgctcaaggaaataaaagaggacacaaacaaatggaagaacattccatgctcgtggataggaagaatcaatatcatgaaaatggccatactgcccaaggtaatttacagattcaatgccatccccatcaagctaccaatgactttcttcacagaattggaaaaaactactttaaacttcatatggaaccaaaaagagcccgcatcaccaagtcaatcctaaaccaaaagaacaaagctggaggcatcacgctacctgacttcaagctatactacaagggtacagtaaccaaaacagcatggtactggtaccaaaacagaaatatagatcaatggaacagaacagagccctcagaaataacgccgcatatctacaactatctgatctttgacaaacctgagaaaaacaagcaatggggaaaggattccctatttaataaatggtgctgggaaaactggctagccatatggagaaagctgaaactagattccttccttacaccttatacaaaaatcaattcaagatggattaaagacttaaacgttagacctaaaaccataaaaatcctagaggaaaacctaggcattaccattcagaacataggcatgggcaaggacttcatgtctaaaacaccaaaagcaatggcaacaaaagccaaaattgacaaatgggatctcattaaactaaagagcttctgcacagcaaaagaaactaccatcagactgaacaggcaacctacaaaatgggagaaaattttcacaacctgctcatctgacaaagggctaatatccagaatctacaatgaactcaaacaaatttacgagaaaaaaacaaccccatgaaaaagtgggcgagggacataaacagacacttctcaaaagaagacatttatgcagccaaaacacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttgaaccattgtggaagtcagcgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaaggatgagttcatgtcctttgttagggacatggatgaaattggaaatcatcattctcagtaaactatagcaagaacaaaaaaccaaataccgcatattctcactcataggtgggaattgaacaatgagaacacatggacacaggaaggggaacatcacactttggggactgttgtggggtggggggaggggggagggatagcattgggagatatacctaatgctagatgaggagttagtacgtgcagcgcaccaacatggcacgtatatgcatatgtaactaacctgcacattgtgcacatgtaccctaaaacttaaagtataataataataaaataaataaaaatgtttaaatagcatgatttacaataaaataaaaatattaagtacctaggaaggaagatgtgtaagacatctatgcagaaaggtataaaacattgagagtaactaaagaagtcataaataaatcgagggatatatgatgttcattgattggaaaacagtattataaatgtgacagtttcttcccggttgttctatagattcagtgtacttcagttcagcattctagcagatttgtgtgtaagaggatggaaattggtagacatcctaaaacttagatggaaaggatcaataataagacagtcttgaaaaagaacaaagttgggaaaactccataatgccagatagcagaacatattacgaagtaattaagaatggtattgagggaaggacagacaacccagaggaaaacagattaaggagcccagaaacaaactcacacatgtatggacagttaatttgtggcaaagatgccgttgccagagctgtaaggaagcaatgtatttttcagtgaaatagtaccctgccgattggttatcactatggcagaaattgaattttggcccttctccttatactatgcatacaaatacattccaaacagattaaaaacttaagtatgaaatttaaaaaaataaagttcctaaaagacaaggtcttcatgactttgagatagacaattttcctaaataggacattaatgtaagtacaaccataaagaaaaggattggtaaataagactatgttaaaataagaaacttcttttcatcaaaagcttccattaaaagagtgaaaatgcaagccacaaagtggaaggaaatagttgcaatgcatataacaaaagatgtgtatccagagtatgtaaagaatgtctacacattaatgagaaaagaacaattattttgacagaacaatggttaaatgtgtataaatgtgtgcatatatacatttgagcagctttgcagaaaagaggatatacaaatggacaataagatacgaaaaattgtccagccttgttagtcattaggaaagtccaaattaaaaccatactatgatatcactacacaccctgcaggttggctaaaatcaaacggtttgataatgccaagtattgatggggatatcaaacacctgaaatgctcaagcattgatgtggaaatatgaccacactttgggaaagagtttggcagtatcatgataggctatgattcagcagtcctattcttagacatatatccaacagaaatgtgtaccagaaaaaatacgtatatagtaatacatgtaaaaccattatttgcaataggcaaaaactgcaaacccccagttcccatcaataatagaattcatcaatgtttggtatattcgtggagtaaaggattttatggcaacaaaaatgtacaaaatattgctacatgcagcagtgtggttgaatctcacaaacatgggtgactgaagctggcacaaagaaaatacaccgaatggtttaaaaattaagcaaatcctgtggtgtagacatctggacagtggttatctctggcaaggcatggtatttggaaaaggacatgaggtttatttcttgatctggataggtgtgtttactttgtaagactccactaaattctatacttaaaatctgtagctttttaatgtaggttatacttcattgataaggtttattaaaaatatcaaaggctctgggccgccctgtgctaggcactgggaatgcagacatgagtatgaaataacctggctctgaagaacggagaggaggaggtgagtggtaattaataaacaattagagaaggagtttgttagaagtgaagtcagggtgtgtcactttatatgtcagcacacaaaggagcaactcccaactcaacacacttcctgcctgtattaggtgcttcataaatgttaaattctactcccaccttgctatactcataatcatgagtaatcaagtaagggaaaaattatgttatgaatcctcttttttagtgcacaatccatgttagtgatagtggtggcaagtaggcttttttatttgtctgtttgtttgtttgttttttgatgtctttaacagtgagccttcctcaaacaatgtattagatagaattgcaacttcctcagctgaaattatttcatcagtgattactttctccatggaatgttaatacattgagtttctcttgtatatataaccagggattctgagcctctttcatctctgccttgggccacacagccccatagaaagatgatggaagggagaagaagggaagaacacctgccagcctgccagaatttcggctatagattggcaagcagacagctgaatggagggaggatatggacaatgaaaaggaccatctaacttgagggcacagtgcccaccgacagcacagcaggtgctgccaggcctgtacagagctggaaatcctggcaagatggtagctgctccatcttgtctggcctagttactgcctctggcccatgctgaagggagtctggggagttaccattccaaagaactcacaagaaaacagaactgacttggatatattccaggtttgcctagtggtacttcaaaatggtagattgaatgttattttaaaagtcattttaaaattatttcctttgaaatacagaatttaataggagaaaaatcagaaggagaatgaaaaataatatggatatgcagaatatatccgaaagaaatgtgtacttcaatgtaccaaaaatatgtacagggatacagataacaccatttcaacagcttaatggttagaaagaagtatgatttctggagccagactacctaagtttatattccatgctgtcacctactgtctttgtgatcatgtgtcagttactgaacgtgctgagtctaaatatttcatctccaaaatgggcatcatcatagcagttgtaagaattaaataagttaatttacctaaaacactcaaaacagcacctgtcctgcgtaaatactacacaactactagctgctgctgatgataacagctaagccatttttgtggctgagagtcagcagccacagccagggtggaggagatccttgtaatcataaggtcagaggaaagagggcctcagtaaagaaggcttcttaggcccatacagcgggaattacttcttgccaaaaggcttgtttgtcctctcttgaagccatgattagtctgcctctgccatgtcgttggctcctcaggagattacaagctctctgaggacagagattacattttttttcaagtattatttccccagcagtgctgagcacagtacctgatgtaaagttgtgctctgtaaatgtttactgaattgaatccttctaaacagaggagggagatactattaatcagggctgaacgtgtgacagcactgttctttcaagccaagactatatgtatgttctttactttttttttttttttttttttttttttttttgagatggagtttcactcttgttgcccaggctggagtgcgatggcacgatcttggctcactgcaacctccgcctcccgggttcaagcatttctgtctcagcgtcccgagtacctgggattacaggcatgcaccaccacgcccggctaattttgtatttttagtagagatggggtttctccatgttggtcaggctggtctcgagctcccaatctcaggtgatctgcctgccttggcctcccaaagtgccgggattacaggcatgagccaacacacctggctttttttacttttaaatcatcatttcccttttagagatgggatgtcagaggcccaaaaaactcagttcatttgcgtgaggtcatgtaaatggtgatatctggaagtgtctccctcaaagtcagtgccctccctcacaggcactcattccctaaggcacctaggatgggcacagagaaaggagaaccaagcttggctggggctgctgtccagagaaggtgggcaggtgtcaagagcaggtgcagaggtggagaggagagctaaatcttgtcctcagtagaagcagagatgtcatttcaactgcaggttttgaaaaatgtcagtgcatacttcatgagattttctgaattcatttttactctcatcttctacactatttatctaagctgttgttctctttgaaactatgtcagccacatgtcattcattgtgccacaaccctgggctttttatcctgcttagggttttgttttgttttgcttgttttttctccccagctgctctgcctatcacttaattctctgagccctctggcctgagtcttatccggtggtgtgggtcaccttacaatcccgtttctagtctcctgggagtagtggtggcaggcgagggatagaatcaacatccaggttcagaatctatttgtcttttttggtcttattgtccgaagcttgagtcaaggataaattaatcagtctagaggtgggagagccctctaaccctccccagggaaaatcctagcctttatagaaacttggcctggttttggctctcagatttaattccaagctgtgaagaatctgtcaatgttcaactaaccctgacaaaacctttggaagtttctgttgcaaccgaaactcttatcacaggaggtggtactgagcttggcatcagaggttggagagagaagagagctagcctgctaattaatattttttttccttaaatttcaggcttttttttttagtttaaatgttctaaagaacctgtcctgtcacttcccatctgtttcctggtgttttcctcaagcatctcactggtttgttttatgtttttgaggggattatctggggtgctgattactttccctaccttcaaggagcctttgaataattttataaatgagaccatttgtctaggggcaagagaaggttgctgaaggcaacctagtcctgctttctcccaagagaaattgtacactaacatttgtttagtagtgcctatatcccaagtacaaggctcttgccttatacctaggatgagcaactattccagtttgccccaagataagctggggggtttccttgggtcctggaccttaaatagagtgtagacgaggagagttatcttttcttctgtctatcctaggttcatagctggggcccttttaacaaaagatagattaacaagagagaagcatacacatttatgtaatatgttttatgtgatatgggaggtatcatacagaaatgtagacccagaggaacagttaaacatgagtatttttatgttaggcttgatgaagagtagacagacatggaaaaatatgatagggcaagaagggcatgatttaatggtaataaactggggaacttagcaaagcctgttagtgcagtttcatccgtgtgatccttcatctccagatacaaggatggtgctttcctttgagtacagggagggcacctctcacatgagggtcttatgacctgcttcaggggacagtcagaaaatcctaggtttaatgacctgctttaggggagaatggtgggggaaaggtaagagtgacctctatgcctctatgattttctcagataccttcagcttaaactattcaaaatactaacatgccatattttgggatagcatgtcctgaaccccatcaagtgcagataccaggaaaaatgaccctgtaaaggaaatgccattatttccaccttacaagtgagaaaagtgagtttcgaagaggtgtgttcacttacagaagtttgcacaggaaactggtggtgagaaagaatcaaatatacatctgtcagacttcagacccagaactttacactaaccaacttcttcagaatgcagagttccatctccttcagactgtgtagctcaacagttttgtaccatctggctatttttctctactgtgtatttgactttgtctcttttgtctcagggtgtacttgaaagcctttacctccccatcttccttccctgatggctgatatacttctgcctcacctgctttaggagcccctgcctccaaccatccaaactaggtcaggggctggggctccttccttctgttagactattcagatctgagtcactggtcattcgcatagtgtcttataaatgtctgcctgtgtatttttccaccactgctagactgggatcttgtagaatacaaggaaacaactttcatctttagatttctagcacccagcatagttcctggcttataattggggatcagtaaatagctgttgaattaatcaatttataaattttcaggaagcatttgtgtgccttcgagtcacagtatttgatctatttaaggacttattccataagatgcatttgtgatgcttaggccagttctcttaatttttttttctatttttaatttttacaaagtaatttttgtgagttaacttggctgtttggattagatttcaacctgatactttaccatgcctaatgtctgagaatgagaaattgtcttttctgaagtcatagatgataatgtccaagtaatctagaggctgtgttgaagttaggaagaaaggaatttctgacatcaagtttttgctttgtcttcactgtggatttttctagttttctctaagtctcaaatttccaagctatacatattagcctacctttgagatttgatctttctgggtaggaaggagaaacaggagtgagacccagttatcagaaggtctgttctttgttctctccactcctcgcaatacaaccagcctcttgaattggtttctgattgctctaagtcatggaggagtgtggcatgaagacagaaatgatgaatgccatcccaagttaaactgcagtatgcatggtgctacatgtaattgtggcttttcatgaaataagcagattttggtttattcttaatgtttaaaatgctagcctgggttatacctactacctggtacctcattttccttattcctttgggcccgcaattattttgtcatcagttgtatagtcaaggacagaaaacagatgttccaatcaatctaagtaaacccaaataactctggcaaagcacacaccgtgctgaaatcaaatgaactgttatgccaagccttgctattaacaccaaagattggaagttgttggtagtaacatcaaaaatggtgaaaatatattgagtaaactgtcccagacattgttcccctcagttaatctccatgatagccctataagccacattctatcatcattccaattttatagatcaggagactgagacataggaaacttaagtgatttgacctacttgccagacttgaaaccaagcagtcgagttccagtgcccttgctttgaaccattacgccctaactagttcatatatctagtaaatgtctgtttacatctcatgtagaaaaagaccttccctattatcttgctctgcagagggtgggagggttggggtggggagggggcagtggcagtgtcaaggtgtgtaaaatttctctgttgacttaaagcataggatgatgatgatgatgatgatgatgatgatgatgatgatgatgattattattattattatttgagacggagtctggctctgtttcccagtgcaatggcgcgatctcggctcactgcaatctccggctcagtgcaagctctgcttcccaggttcacgccattctcctgcctcagcctcccaagtagctgggactataggtgccgccaccacgcccggctaattttttgtatttttagtagagacagggtttcactgtgttagccaggatggtctcgatctcctgacctcgtgatccaccctccttggcctcccaaagtgctgggattacaggcgtgagctaccacacccagtgcagtaaaagtaaacctactttaggatttagttggggtaagttctagaccacatttctttcaaggtcaaagcaatacttcatgaaacattgggattacctttttgacttttttttttttttttttttgagatggagtctcgctctgtggcccaggcttgaatgcagtggcgcgatctcgattcactgcatcctccacctcctgcattcaagcaattctcctgcctcagccccctgagcagcttggactacaggcgcgtgccaccatgcctagctaatttttatatttgtagtaaagacggggtttcaccatattagccaggctggtcttgaactcctgacctcatgatccacctgcctcggcctcccaaagtgctgagattacgggcataagccaccatgcccggccacctttttgactgttttactccccttcatttgctaggcttgaggttaaccctttgggtttgctttagtggcattttgacagtaagtcctgaaagagatctgagttcagctatcctattgtctaggaatagttggagttcttgtaagtagttgaaaagaaaggaactagcttctgtgaactccacgagataatgtaggataaggtagaattagagtcaggtagatctgggtgtgatatagtcccaccccgaggtcccccacaatttagtagtgtgggaccttgtagaagttgcttggaaaactttactctccttttctctatttgtaaatcaaagtgataataactaccttgcagtatcactgtgggaatcaaatatgataatatttgcaaagtgtcaagcacaaagcaatctcccaataatcaaggatcttagaacctttagtctttaccagtgatttttgacaaggtatgttgtgaggctccagtaattacattattacccatgagttgtcactcaaaaccaatcaatatttttcacctttattcatatttaagacacggagcctttgtccgtgattaaatgtgctattgttacctagaaaatgtcttgtgctttactagtatgtgacttctgccacacacattcatttattcattcattcattcatcaacaataacaacaaaaaatagtgagctactgcagtgtgaagacttgccctggcctccgtttgcttatagtgtagtagagggatttgtttgtgttgtctgtgcagacacataaactaaagttacagtgacagaatctgtagagagtcagaagatgggctacaaaggaaggaggcttggtcggttctgctggtctggggtgttttggggatgtggggagatgtgatcaggaaaggcttctgatgctgcaactgagtcttcaaaatggagttggtgttccccaggattgttatgggatgaggtgtattggtggaaaggatatcctaggcagagggagcaaagtaaacaaatgcttagtggcaaggaccaccaaatcacattcaggaataaggagaaaaggtcccaaccatatggaaccctgctcatgccaggcaattctgcaggtcgtggatggcgtatctcccatttattgagtactggtgtgttccacctaaatctcatttaattctcacagcaactttgtgggtgagtattgctatccaaattcttcagatatggaaattgaagttctaaggggtcaaggcatctttgcccaaggggatgaaagagggattcaagtctaactctgaagaagtagataaacaacaaaaacagcaataacaataataaaagtaataaaaacagcaaaggttcatatagtactaggcatgttttaacctgtaccgttcaatataatatccactagctatatgttgctacttaaatgtgaattaattaggatagaataaaaaattcagtcctcagttgtactagccacattttcagggctcaattgccacatgtgtctggtatctattgtatcagacagtgcaaatatagaacatttccatcatcacagaatgctcttattagcactgttatgggtactttacacctatattaacatatataatttttataatctgtgaggaggatactattcatattgtagagatgtggaaattgaggcataaggaagataagaaacataaagaagataagaaatcacatgatgaatgagtccttatttttaagcactgtgccataatactaactcaatatattgtgttctgtttaacataaatgaatgttagtcaaaataatggacttcagtgtctgcgtgtatgtagtctggtgttaagtcttctgcagagaacacgtctttgatatgattcttatccttccagaagcatacagttgtcaatttgcatgtataaagctggtggtcactagagagtcttctctggagcccttcctctccaggaactccagaaacctcccagccagctttggcaagaaactcactggatgggattcatcagtcagttcattcatccaaatgactgaatcaagagtctcaaacagatgtagtcttaaataatgttcaaaacccttcttatcctttttgatacttcagagaaggtgcctgaggttattaaaagagaatctttttcaagatgccaacacatcagactcaaagactgaaaatcctagttgagtccaacttctacctctaagttactaaataaactcgactaaattacttcacctttctgaaattcaatttcttcaactgtgaactggaaataaaatacacatatcacaggattttctaaggactaattgaaggttacagtgtttgaggatactttgcaagctataaagtactttatatggctataaagtgggagataattataacacaaatgcgagaactcaggatgtttttcttctatataaccttgtaagctttcaaaactgccacagcgtgataaattataggaaaatgtactcttaatcataacatttgcaaagtctcttttttattttacataaatatagtagggactcaatgcttgggtggaagtattgttggttggatgaatgggagagatgaagggagacagcatattaaataagagagctgttcatgaagttttaaatgttccttttttaacattctttttaaacattgcttgatatgaactatgtgtgttacatggagggttgggagacatttaattcattgagttagcctgtttttctgctatttgttttttagttcaacaaacatttattgagcaactgccatcagttgggcattgtgcaagtttcagggaaaacacagttgatgatgtcactgtttttttatgcctgtttcttcatctgctaatttttctccttaaacattttgaggattgcagaataaactgacactggtatggtcatatgaagggccccagcggtaccgagggctgcacttgtgtcaaattgtttcctgatgtacacatgcagcctgtgagttctctgtggatggcaaaatatgtttctccggaaagaagaaagctcctcccaccttttcttgcttttccctgcttatctctgaacctcttttctcggggatagcccatcaaagcactgtgtggccaaaggaaaaataagatgtcagctctccgactcatgtggtcttgcagtgaacatcagctatgcatggctgctgaattggggtggacattaggcagagtgtagagaacctcttgaggggaaatgaggccagtcctgcccaatatatataattttaggtaaggagatacctcagcttgtattttaggagaagcactgtgtatatactgagaatggctgaggaaggacctccatttgtaattcatttctctcattgtggggatgagagaaccagttcaaacttttaggccatttgtggcagaattggggctgaaactcttgtttttctaactcttagcccatggctctcactgagtttcatggtgaactagcacttccaagtatgttttcattatgtaagacaattataacatcataaagtgaggagtatagaaagaacataagctttggagtcagacagaacaaggtcaaatcctggcactgcttcttaaatccatgtggccttgggcaagttacctgaacactctgctctgttcttctacttctgcatctattaagaggaagaaagaatgtttaccttttatggatgttgcaaagattaaatgagagaacattcaaggagctcagcacagtacccagcctatctttgatgttgatatgtttactagaaaggaagaatccagttgtctcttgagagggggttcagatgatgatgatggtgatgatggtggtggtggagagagtgatggtagtgatgatggtgacagagctaccattaaacatctctttttaagcatttctgcaatatcacaacaaccatgtgatgttgtgattttcctcattttatagcagatccttctgtctccaaattccatccttttctcataatagcacactagttctcaggttctaagtctagatatagcagcagtgaatctgccaacccaagaagaaacaaataaatatttcctacacatttctttttccttcattttaattcccttttcgtattgactgaccctgtaacattaactttgcctgtactttatgtttatgcaaccagtaaatgtgggtgattctcaggaattccttgaacctatttatgatactgtggagcagcgtggccaactccttttctgtcaaggatctcagaatcaatatatttaagatcccaagattttgagatgtacagataagtgaacattggttgcctggctattggatttttatcttagagaaaaacctgtgagtcttggtggggaagaaccagcactttggaatcagattacctgaatgtgaatcacagcccagttccttgtgagctgcatgaccctggtgaagttactactcatttctaagcttcgattttcttatccataaaatgaggataatactaataccaatgacattagtttgttgtaagaataaaatgagacatgtatagaaagagcatgtaaaaagagctcagttaaaatgagctcatatcttgggttattcctgtacaaaagcctttgtgccctgaatggagaatcgtgtcactcaggattcactcagcaaaacacaaaccactctaattgtttaaaaaaccagtaacttaatacccaaaaatggcgatcctgatgatggaggagctgagaagggctacattccctgtgaagcaaatcagagatcagtgaaatggaagcagctaccatccccaggctggagggactaaggagggaggagggaggtggtgttctcatagtctgagggcaggggacaccagccgatgctggagccatggcagccctgtcaacagagcccgagtggtggaggggaagcagctgctgcctggcacagaagagaagtagataggctcttgcttccccttgcctgcaggggtagccccacaatactgagcagagcagcggacttgatctgaaaacacataggccaaggattcttgcaggctaaagtctcagacttctattgcctggttgtggatatgtaactactgtgataactaacacagaaagtttggaagagtcttacttccccctgttgctagacctctgaacaatagcagagattcacaggttgctgtgccccagaaggtagaatttggaaaaagcagtggaaaaccctcgaaagctgtaagaggcctgtctctggcctttttctcacattactttctagcaagtatctgagcagccagtgccttcagtatctggggatttgtggtctgatgagacattcccaccctgccgtttacctggctaacttctgcagaattgagtatagactgaacttccttgggcccctataggtgggttagctgcctttgtggcccctcctgtgatacactgatttccctgcactgaaatactccatttaggcttccatctccttcccaccagactgtgagcagggacttgtcttcttcatccttgcatccccaagcatttgtactcttacttcctgtattgagctagctactgtggtaggtcctgggctatgcatgtaagtaagagtgccagctactagcaacttttattatagaagggaggcagatgggatatatgatgttttaaaattacccatgtcttttgtgctagggaagtccattgcatgagactatttaacagggagaatcgtctgtcctagagggtcagggaagccctataattaggagtcggcctgacagcgaggttgggggaatggcattccaggcagagggaagagcaaatgtgaaggtcttgaggtgggaaacagcattaaggattagagattgagagcaaacgtggcattgcctgggagctgatgaggtcagcaggacctgttctctcctgtgtccaagtctctgcgtcctgcctgagcactttccacccccagctttgtgttgtagtcctgcaagtctgcgtgtttgtggcttccacatcacacctagtatatatcgttttgtgcatagaaggggcttattggatatttgaacaaatgaatacaattccaggccctaaagagtctttctagctttcttgtcatatttataactttagttgccctgcaagtatcaaggaatacgagctctatggggaagaagcctgaatttataccatttatgggaaaccctctgctatttggcattctgttactaggaactcgctctcagtcattctctccttcacaattggagttctgcgataagtagtagtaagaatggtgacctagggatgccagaaagattcagtcatcagaccatcctttgcttttgcttctttgggactgagatgtgatgtgttaaaccagattccatttggctccgctccttcttagcagtgaccttgggcaagtcagttaacctctgcagaccttagtttctcctctgatgtctaacattaataatatctatgatagtgttaaaatgagaccatgtatgcaaatatgtagcatagtgcctggtatttagtgagcagaaaataactgatagctgctgcttttattatgacaatcacaattactgccattattataacgttgggtgccatacattgaccagaacaaagcaaaatctgagcaggcttccgaggtttcctatgcaggcaagtatgccctttgggtttctccttgagactgccctacacacaggacccttcctccatgttgtttgactattaaaaagaagatttgttaatgcttgtttttagctttctctccctctttttttatgtgttaaagaggatttgtttttgttttcctttctcacaggagtgattggggcagatgtgagagggcacggcctcatctgtgaggggcagccagtgacgtcacggctggctgtcatctgtggaacgtcttcttgtcacatgggggtgagtccactgagcacaaaggcaaggccaccacacagcaggaggtagcctggaaggagaccctgagtgctggcttcttcaccctttcacttctttcctcttttccctgcctgccccttgtgctttgtctagccagaagcccagctccccactctacctcccttgcttaacatttgctggatctttttccaggggccaaattcttagtaagcatgaaaaggattgagtgctccctttgacgtcaccctggccagagagcccaggcatgaatggtgacatctgatcctaaggtgacaaagtctagctcccccagactgatctgtccctaatgggtagcggggtcttctcggcaaagagtgtctgttttccttggccagggaactctctctcaatcaatataaatccatctccctgggagcgtcctgatgatctatagaattagcctgcgtatcatgacttcaaaagaacactgataagcaattttcactttgttaatttttctccatgaattagtgaaaaggctttctccaagattgcagttaaaatttagtgcctgccctaaaatttatatcttctttaaatgcatgagtctgaaagcattccattccgataagtacccatttctaccatatttttatttaaaagtcattactctgttaaacttaaatcgacgactctttggaattttcccagataagtataatagagggcagagtgggggaggagcagggagatgagcagagattagagcgggacacagcccagggcagaaccaaagcagctatggaggaaattaagtgggatgtgagactgttttgcaactgtagggacccctgagcctttttaccatcagatattctagttcagttgatataaatacatgtacttacttatcaatccctgctcttgtgctaaactgtggatataagaatgacatcggctcagtgggatgagatgaagttataacaggtattagaatataatgtgaggccccccaatgtagatacaaattgaactcatgatactaagcatctgttatgtgccaagcaatatgcgaggtattcttgcacatggcatcccattttctatggctgagggagccagcccgagtggtttccagtcccacttcctcagtttactaagtgtgggcctttgggcaaggtacttaaactctctgggtcccagattcctcatctacaatatgtagagagtgacagcacctgtcagagtgctgcaagaattaaatgaggtgatactaagtgctccacatgcagtaagcacatcacaagggctcactcttaatcactaggactgttgttgttactgagcagaaagcaaacagtggctgactctgcctgggagggtgcagggtgatagaatcttcttgaggtgacatttgtgctggactttaaggaaatagatttccttctgtttgggctctgggcagtcttgaatggaatttttctaagtttaaaaattgcagcatatttggccagacacagtggctcacgcctgtaatcccagcactttgggaggccgaggtgggtggatcacctgaggtcaagagttcaagaccagcctggccaacatggtgaaaccccgtctctactacaaatacaaaaaattagccgggcgtggtggcaggcacctgtaattccagctgcttgggaggctgaggcaggagaattgcttgaacccagaaggcagaggttgcagcaagccgagatagtgccattgcactccagcctgggcaacaagagcgacactccatctcaaaaataataataataatttcagcatatttcttctgctcagcagcccttttgtaaggctcagctgtccctgaagggagagatctgcagaggcctgaggcctctttaagccagaaggcaccagcccaggagccagcccttctttcccttgatatgagtctacacttgttagattgtcttcactgaatactgatttaatcctgtttaaattatctcttattttcacagggatacatctaatcaggcttctcctgggagatctgaatctcaggcatttttaccccactcaattcagatttctgaacagaagcaaatctaaatggatgcaagtgtctctgtgatggcctgcttcttagtcttactgtctcttaatggagatgaggctggctttccctacccatttaatgtacacatttgggacctaaagcgtagaaaagtccagtaattttcccaaagtcacaaagctttgaagttcttgagctaagaactgaaatctaactctgattccaaagctcatactcctccttgcctccctgaattgtgcatgaagatgatgtacccatagaggaatggtgagaacatgggcttttacattgtccagaggcaagcttgaacatctgctcatgcatgttttggccctctgacctgagtgagctacttaacttctctaagcttcagattcttcatccatcaaattggggataatgatgccagtctcacagggttgttgagtaacatgcattatgtaggtttgtacctagcacacagcagacactcaaaaatggtggagattgttattaaactttcctagtgatgtaaacggctcacatgaagcaactgtttgggctttaacgagtttgatgggcagctgcagttggttgcgatgaatgagggccataaaaggccagtttatgatggctgtgttgtgctggaaataaagtccccacccccatcctgctttgtacttgggagtgggaagggaccctctgggccaaggggattaatcatcagctttaatgttatgtcatgagggtgagactgtggtcatgctggcatgggaaagtgcctttgatctcctcaggtgctgggaacccagcaacaataacacctttgtgaggtctaggagaggtgcaggtctgaggaaacactcccagggagactcaaggaccccctttgttgtggttctggcaaataaaaccgccactgtgaggaaaaattaaccaaacagaacacagggaccaaagggtgatgcgggcttttcaaaaagtggttttcagcatgatctgaaggatcctctttcttcctgtctgcttacttctgatgtttccaatttagtagattgagacaaaattcccaggaacgttttgtgcttgatccaggttgcctctttctagatcacccaaaaagaataaatgaatgaacgaatgaccacataagtgagtattggtaaatacttagaagcttcgtacctccaggttcctgttgcttccaggaatctggagaaaaagcctgaggttgaacataagacatgttaataaggcctttgatattttagaagatacaagcatgggctgcacatttatcttccttgtgggtgatttaattaacaggggaaaaatgccattctttttttaactccatgaaagcagagctgcttgttcagagttaattactaccaagtcaccaaaaccccagataatacacagcaggggttagccagaggttgaaaagtcatggggtaagatggagctgatccttgccattgtactgacatccttttcttgagctgtcaggttgggttgtaacttggcaacttgtcttccagttagcatgtcagatggggacaggaccctgggggggtcggggtagggagaaacactgaggaggtaagatttgagcagaacaatacctgaagagagctgggaactacatctgcatcttaaatcgctcagaactgaagttttttcagtcttaatattgagatagtggttctctatcattgaagggatgtggagactcaaagacataggctcatacgctgcccccaccacttactgtgtgaatttaggcaggatgcttcatctttcagtgcctcagtttctgcatctgttaaatgtgagtgatagtatttacccataaagttttgttcaggttcaaattaggccatctttgtaaatgacttggcactgtacctggcacaaaataccaaatatgatattgttattaaaaatgagttgttaatcacatgaacaatccatgtggttatggactagaattagagacatcagtatgaactcatattgggggaacccacccccaatatttcaacgtaggttctttctattttccgtaagtgtcagccggctgagaaataaagagaaagagtacaacgagaggaattttacagctgggctgctgggggtgacatcacatatcagtaggaccatgatgcccacctgagccttaaatccagcaagttttattaaggatttcaaaaggggagggggtgcaagaacagggagtaggtcacaagatcacatgcttcaaaggcaaaaaggagaacagagatcacatacttctgaggaaacagtacaagggcaaattcagaactactgataagtgtctatgttcagctgtgcatgtattgtcttgataaacatcttaaacaacagaaaacagggttcaagagcagagaaccgatctgacctcaaatttaccagggtgggttttttccccaccctaataagcctagggtactgcaggagaccagggcatatttcagtccttatctcaacctcataagacagacactcccagagtggcttttatagacctccccccaggaatgcattccttccccagggtattaattattaatattctttgctgggaaaataatttagcgatatcttccctacctgcacatctgttttaggctgtctgcaagaagaaaaatatggctctttttgcccgaccccacaggcagtcagaccttatggttgtcttcctatgttccctaaaatcactgttattctgttctttttccaggtgcactgatttcatattgttcaaacacacatcttttacaatcaatttgtacagttaacacaatagtggtcctgaggtgaagtacattctcagcttatgaagataacagggttaagagattaaagtaaagacaggcataagaaattattaaagtattaattttgggaactgataaatgtccatattaaaatgaaatcttcacaatttatgttcagagattgaagtaaagattggcgtaagaaattataaaagtattatttgggaactgatatatgtccatattaaaatgaaatcttcacaatttatgttcctctgctgcagctccagccagtcccactgtttgaggtccctgacttcctgaaacaaactcatatttagtttaacatagatgcagatggatgcatatagaaatagttatggatatatatacatatacaggttagtaaacacatatttatttcctggctctgttagctgagatggtctagaaataaggatacctcaagagctagtttttacaagcacatagtgtccagatcatggtatctaataccattatccaatacaaagaaccaggactccttggagaaatagttgattttaggattggaataggaaatatacaagatgagcttggagcatttgcagtgccagaaagttaggaagttctcaacaaaaaagatgagaatatgtcacagggagccaactgtgggagctcccactagccaaaactggaacaatttaagcagtaaaatgaagtattatgaattataactcaaagtataacataaatatccataagaccatactgacataaattattttgaataaataaatcaatgaaaagaagagagacatctcccatgcagaaagattccaaataatttatataaatgttccaccatcaaggaggtggagcataactttccactccttaagtgtgggctgcacatagcgatttccttccacaaaatatggtatggaaaacgggggaagagtaattttacattggagaaatatgagaaacagcatccacgtgacaaggtcaacatcaacaatgataagtcatgttgatagtacgtacccttgatatgatgtaatgaaaatgacactttgtctctgttgtgttcatcccccaatcctataagcccagtctaattaccaggaaaacaccaaacagatcttagttaagggacatcctataaaatacttgaccagtatttctcaaagctgtcatccaggtcatcaaaaaacagggaaagtcagagaaactatcacagccaagaggaacctaaagagccatgataactaaatgtaatatggtatcctggatgggatcctggagcagagaaagaacattaggtaaaatctaaggaaatctgaataaagtatggtcttcagttcatgataatatatcagtgtcattcactgtgacatatatacttgacaagatagtaatgataggggaaatgtaactggatgtgaggtatatatgatctttacaaccatcttatattgtaaaactattctaaaatttaaaatttatttttaaaatattcattaactattcactcataaagaaaacttttttttttaatttacctggctaagtgctaaaagtcttcataagataaaatgtcatgcctgccttcaaagagctcaggcacattgagaaagacagacagaaaaaggagatactacaatacaaaatggtaactactatagttaatgcatggctggagtgtggtggaagtaggaagaaggggctgtcccaagtcttgggtagatgaggaggttttcctataggaagagatatttgcaggatcatggcttccccgcccccactgagacactgttcctgccagcccaatttctgtagtaggccctttcctcagtcttctccactttgtttttctttgctgtgtccacaaagcctcacagctgacttcccctgaggcctgagcaggatgtgggtgtgtatgagccctttgggagggcaccacagggagacagcacagtcatgtattatgaactgatggtcttctgttactagctgagaagagtgggcaagtgggaccagtttctctgtcatggtctctttaacaagtgacattggcagaagttaccagaggggtggagtgggatgggattccacacggtacagtagaccactgttacacctaacaatgaaagtgctgaggtgctgctcagaaggtgcctcgcttcctctttgtttaccaggacctgttgtcgtcagccctctaggaaccagcattctcaggacactctctgtgtcaagactagctctcagactgcatgttttgaaaacaaagtatatgctaggcattgattcggcgaggagagggttgatgtggttcagtggacaatgagagacagactgtgcactcaagaagctcaaggtagcttgtttttcaagacatttgagaaacatagaaacattatgctggactgagtatgtttaatatctctgaacccaggcagtagcaccctttcctcaatcctcatgaggagataagcagtaatactacttgctaccatctgttgaccacggaccatgtactaagcaccttactaaaactttgtatcatgtaaatagctcaacaatcctaccaagtaggcaccatactgtccctcattttacaagttaggagactgaggcaaagagtggttaagtgggtcacacaatgtgtaggaatgcaacactttgagccctctggaagactgaccagagagtccttcctcctccctttcagctgtatagcttccctcaaaggcctagaggaaagggagaacagactcaattaaaagggccaaacatgagcaaatgtttgaacagacatttcaccaaaggagaaatttgaatgaaaagcactggtcattagggaaatgcaaattaaaaccacagtaagattctctactactcctactcatcttagaatggctgaagatgtgaggaactgtagctctcacacaccactggtgggaatgtaaaatgatgcaaccattttggaaaatggtttagcagttacaaagttaacatattcctactacgtgatctagccattccactcttacaaaagcatgtattcatacaaaaatttgtacagtaatgttcataccaacaaataaagctttgtaatagtccagcactggaaacaaccgagatatctttcaagagtgaatagatcaactcttggtgtatcaagagaacaaaatactactaagcagtaaaagggaatgaaccataatataaggtacaacatggattaatcacacaaaataattatgctgagtgacagaagccattaattcttccaggcaacttgcagtcttttgtggaaaagtgggctcaggccagctgataggtagattccccctaaaggcttttgttcctggccttctgagatgctttgtttcacctgactttgccatgttcctggtggactttcagaaacatgaggccagatatccctgcccagcttttatagaaatggaatgtctggatcacagggtagatgtaagttttaagaaactgccaaactgttttccaaagtcactgtaccagaaacgaatgcaaactttcttgaataaaaaatagttccattatttaaattcttgcaaaagcaaactaatatatagtgacaaaaagcagatcagtagttgcctggaatcatgaaatgggcacaacaagggccaggaaagtaggatcaaaaaggggcacaaggaaagatttgggtatgtttatcttgattgtggtaataacttcactgatctatgctatgtcaaaactttccaaatcagacatcttaaatatgtacagtttattgaaagctattagctcaataatgctttttaaaaacagaaaaaagatcgattttgtatctggagactttactgaagttgcttatacacctaaggaattttaaggctgagatgatggggttttctaaatatacaattatgtcatctgcaaaccgagataatttgacttcctctcttcttatttgaataccctttatttctttctcttgcctgattgccctggccagaacttccaatagtatgttgaataggagtggtgagagagggcatccttgtcttgtgccggttttcaaagggaatgcttccagcttttgcccactcactatgatattggctgcgggtttgtcataaatagctcttcttgttttgagatatgttcattcaatacctagtttatggattgtttttagcatgaaggggtgttgaattttattggaggccttttctgcatctattgagataatcatgtggtttttgtcattggttctgtttatgtgacgggttacaccaataatagagagtcaaatcatgagtgaactcccattcacaattgctacaaagagaataaaatacctaggtatacaacttacaggggatatgaaggacctcttcaaggagaactacaaaccactgctcaaggaaataagagaggacacaaacaaatggaaaaacattccatgctcatggataggaagaatcaatatcgtgaaaatggccatactgctcaaaataatttatagattcaatgctattcccatcaaactaccattgactttcttcacacaattagaaaaaactactttaaatttcatatggaaccaaaaaagagcctgtatagccaagacaatcctaagccaaaagaacaaagctagaggcatcatgctccctgacttcaaactctactacaaggctacagtaaccaaaacagtatggtactggtaccaaaacagatatgtagacccatggaacagaagagaggcctcagaaataacaccacacatctacaaccatctgatcattgacaaacctgacaaaaacaaggaatggggaaagattccctatttaataaatggtgttgggaaaactggctagccatatgcagaaaactgaaactggaccccttccttacaccttatacaaaaattaactcaagatggattaaagatttaaacataagacctgaaaccgtaaaaaacctagaagaaaacctaggcagtaccattcaggatgtaggcatggacaaagacttcatgactaaaacaccaaaagcaatggcaacaaaagccaaaatagacaaatgggatctaattaaactaaagagcatctgcacagtcaaaaaagctgtcatcagagtgaacgggcaacctacaaattgggagaaaaattttgcagtatctccatctaacaactgttcagaaatcagttagagagcctctggccttagtgtctttgggctctaaccacagaaaagccacccttcagaccatgctacgtttttagagctgtgttctctgggtgatgtctataacagcactttacagcttcctcagaacaccaaagaaaacgttccccagaggcaaagggtgtggcctgggcctggggggcccatgtttcatccaggaccatgaggcactgcacagtgtttgtttgttagaggagcagaggatgctcaaaatcattagtcgttagggaaatgcaagtgaaagacacagtgagatccactccacacttactagaatggctgaagttgtggtgataatgtggggaactggaactcacatgccactggcaggaatgtcaaatgatgcaacgactttggaaaacattttagcagtttcataaaacctactctaccctgtgatccagacattccatttctataaaagccaggcagggatatctggccccatgtttctggaaacccactaggaacacggcaaagtcaggtgaaacaaggcatctcagaaggtcaggaacaaaagcctttagggggaatctatctatcagatggcctgagcccagttttccacaaaagactgcaagttgcctggaagaatggtgtaagttcttcctctagaagtagaggacgaaaatggtgcagctgtgttttagctccctcctgattggcagcatgggttcttctcccaagggtacaagggaatggggtgggatgggggtggtatatgggagtggaaagttctggaggactgccttgattagcagcaatgacaataacagctaatatttattatatgtttatcatggtctatttggatttttttaaccctcataataaccttatacagttgtcagaattatcttaccaatttatggggactgaaactgaggctcagagagacaagtgacttatccaaggctgtctagctagtaagtcctttctttttttttaagacagagtcttgtcgcactcttgctcaggctggggtgcaggtgcgccatctcggctcactgcaagctctgcctcccgggttcacgccagtctcctgcctcagcctcctgagtagctgggactataggcacccgccaccatgcccggctaattttttgtatttttagtagagacggggtttcaccgcgttagccaggatggtctcgatctcctgacattgtgatccacccgcctaagcctcccaaagtgctgggattacaggcgtgagccaccgcgcctggccgtaagtcttacagataggtttgccactcaggcagttggattccagagctcagactctcaacaataagcagaatgatgagacacaggctgtgggatgggttgaccataaacacacgtgttttgtgggaatgaggtagagtgattacacagcagatctttcccagagcctgatgagaactgcacagttaaggctggatcacagctagaccgcagtgctttcattttccctttttcccagtcttccaaatcacttcctttcaagaagccaccagcctaatgataacaataaaaataaacaacatcacttgtcaccatcatcccctgggaagagagtatttatgagactccctatttaatcttcccctgttccctgctgcgctgtggtcaagtaccaaatttggcaatgtgaagacatgcggctgacttcccaactcatgaagatgtttttctatttgtttggagagcatgatgaaaaccacattgattttttttttccttttcctatttaccacacatctgttgtgtgggtgattctgatattgtggctgctgagggttacctggcagtaaccctcagtaagaggagagggtttgtccttttccagaagtttggtgtggatgaaatagatgatgaggcagtcatggtggagccctaaccaagcattgggtcccgtgccaagtgcctgcatgcatgagctcatttagttctacatacatttagttcagaggctttagtatttatgccttgtttttctcttagtttttcatcctcttctcctattctgtttgtgtgttccaaatgtctgttttttcatacattacatttttatatcttttgaaagtactcttaagagctgtcagaagtttgaggtagtttctactctttcacttaaccaatggttagagccccaggagaaataacagtgagatcaaagaactcagaagaaccaatgggaagctttttgagcaatcagcactgaaggaatgaaattgaaagtccctacgtaattaaccatcagtggctccctactgccaatagaaaaaaaaaagttcagatgagacaatgagtggaccttctggctgtgttcttatgggtttgggatatattgcattagaataaaaccgaagtcttaaatcctaaatgaaagttactgtcagttatactgacagtgatactgtcatgtatgttgtaaatctttttgttgaaagataatttacataccatgaaatttatccccttgtatttttaaaacatctagagaactgagtatagtgatgtttgagaaagaggagacttactgcccattttttaggttacattatgggatgatactagtgtgtggtctttattacttagggagataacagaaggatatcatacaatagtacattgccatttacttgtatgtacctgacacataataggtgtccgttaaataatagatatatacatgagcataaggacagacagaaaaataccagttagcaactgtaaaggtttgttggagaagaaatcgtgccatacctatttgatttctgttctctgatggagtgaaaggctgggcagagaaagggagatacagcatataaaccaccaagttattggtcaggccttaggttctttccttgattaactgacccttcccacatgccacagcagcattggttaagtcagtcacacaattttatctgtgcacaaccgagttgtccactgaattatacctcaaagcaggccaaaaatatatatatatatgtaaaactgattgaaaagcattaagaacaactaattgccaatttgtatttgggctgtttagttgatcgttgtagccttgtgtggcaccaggcaaagactaagccacaattctgttggttgaggaaatatttaactggaagatgcttttgaatgaatgatcagctacccaggtactatttgacatacagcagtcttggggcttccatgacttattctcctatcatctgtttgcatgataaaattacaggtttccatgtaatctttagcagatgtatttgctatgatcttggaagacagggcatagcttctctggaattaagggaatggcccaggaaaaagaagaggtgcccacagataaaatggtcagttatttttatatatgtgtgcattcttctgtggtgtgcagaacaccaaattgcttggacctgtttattcccacagactcacagtcaaactggtcctgaatattaaatctgatggtttcattctcctgataaaaatcctttgtcgataaaaaatcctttgtcaagtctcctgaatgctagctaggcatacgagatccagcattattgcccctgtctacctctgataccattccgtgctatccctcaccattcatcctgtgttctagcaggtgcatctgcacacgcttgtttgaattctatggaaccagagatgtttgagcatagagaatgaccagattttaggcagttaatactgtatatatacaatataatgcataacactgccagtgaagtttggagcagcacctgtaatcgtgcatactaatatctctacagtaaaacatatgaatattcacaccaaacaggttaagtcagctttaaatggcttgatccattcagatcagattttaccatcaaatgaattgtgaaaagacttttggtatttgaaatgctttgggttgaagaagtgtggtagacctgtacttgcttttcttgaaaagagcctgtgctctcttattcatctggcctttgggcatgttgttttccctgcctggaatggccacatctccctctgcctgttgagtagcatcattactagaatcatcattgcatatactgaggatttactatgttgttactcccagcaaattctatggtcgggggggcgggggggggtgttcttattgtattacatccccccagtgtttagatgaggaaactgaagcttggagaggtcacagagctaggaagaggtagagctgaggttgaaccaaaaagtatggagacaacaaaccttgggttcttagttactacactgtccgtgtgtgcgtcttccccaaaggtccagttcaggtgtcaccttcctaaggccctcttcccttcctccaccacgtttaatagattatgactcctctgggccttcacagctgtttatgcatagctgtggtgcactgcttctcattctctgtctttcccatgagcctaaactccttgagtagttggggaaaaatgtctacttcagtgttctatctctagggcatacagtaggtagtcaacacatagtttataattaagttagtttaaagtgatacggtaacagataacaatttgtatcatcattaaaataaatagtaaacaccaaatcacaagttcaaggatataaaatttggatttacaaaagaaaaaaatactcagaaaaaaaaaggctgctcatttttatgcatggtatgtaaagaagaggaatttggggacaacagttcaagaatgggcaaggaacacatttatacttaaaaattatgacagctaggatttattaaatacttcacatgtgacagtttctctgctaggcattctgtgtataaactttctaatcctcacaacaaatatgtaaggctaattgtcgaatccctgaatggacaaaaattatagctatataagaaagagaaagatatggtaaccatgtcttagatcagaataaaaagaacaaaaggtaatgatcctaatatattcagatttaacataaattaagcatcattagaggacagtcacataaaattgcacaatagaatatatttccacatctgagagatgatggaattgaggtcaaagagattacaggctagtatgtggtattttatacccattccttgaattatgttaacatggtaccagaagtatatcttgctgtcctcctcagaactgggtgcagttttgagctctgcttttgtaaaaagctgttagaacctgaaagaaccacataacacagctgtaatattcaagagaaagtgggtcccacgaacaaagattgagattgttcagagaaatggggtggttctgattgcttaatagaaacctcacaggttggctctattattttcttgtttatggaagtttttgtgaccgtaagagctaacttttccttggtgctttagagtttattaaacgtcttatggaatttgatgctcagaataactaagtgaatcagtcagagcagatgttttctttttttcaaatgagactcaaagaaattaagtgatttgttcagtgtcccacagctaataaatgatagggccaagactcagatatgtatctgagcagacccctgagccatgtccactgcaatcttgcaatccttggttcatcttcatttactcaaattgaaggatcctgcggctggtgaatgtctggttcattgcagaagagttcctggttccttgtctctaatttccattgtgactgtgaattctccattgagctgcaagccagtgactgtcaattaatgtgcacaaaatatacctgggtaactgttttaaaaatgcaattcctcaggcccctctcccacagggtctgattctctaagtcttgctggaagggatatatgagaatctgtaattttaacatgtgcccaggtgattctaatggaaaactttcaaaaaaactgctttaagctctttcagagtagcaattatatctttacttcattgtttccgtagtgcctagcagagcaccttgtacatagacagtactctaaatttacacttgatgaatataagagtgaagtaaataaatgtaaaattaatgtaaaatgaaggaaaacaagtttgagaatcagtcagttcctgccagatttggagcacactgaggaatccctttatctccatcctttcaaataaaatatctcttggtaggtctgggtaagacatactgagaagtcatgacttggacaaagtacctggtagaatctgccaacaattagagattgtggaattcttattttctcatggaaagcaggatggagtgaaacagtgagagatcctgtttgtagttctgtgcagacaaacccagaaaccagaacgcagacacaccaggacgcaacaggaaaccacaaaggcctgagatctttcaatgtaaataggaagtcagagtttacttccgaacccacagtgccaagctgaagtgcagtgtttaatccagctctctacccagcccttccttgagcctgggcacagatgaaagatgatgatgccacctgggtaaaagcattcaaaaatgtttgttctgatcaggtcttggagtgagcttcttttgtttgtgctagtgaataatttgggacacaggtgcactttgcatttgaaagcgttaattggtctccttggttttccctgccatgatatttgaagccacatcttcctccacaaagtaattttaatccatatacattcaaaaagcacttgtcatggacagccgtctttcatataccccatctgtggacccctgggtccaggtgcagagtagtggaacattggtgatgcttaatatgtactctgtgttcattgcattgacatctgtaatctcatttgattactactattacactgggaaataattaataggatacgatcatcaccattttgaaataaggaaaatgtagtctggtagaaaacacatggatgttaaagttaggcagatctgtgttcatgtccaaaagacttaagctttcttaccagactgctttattttatgtagccagttgtttagagcattcactctgtgccaggtactggagagaaaatggtgagcagtagacctagactgtacagtgtagtggaggagatgaatactcagcaaacaattacaaaaatgtataattacagaccttgataagtgctttgctttcataccctgctgggggaagtataaattgggcagtcactttggaaaacagtgaggcattgtctgatcaatttgactgtgcacatgccctgtactctaccaattccattcctaggtaggaagctggagaaacaattgtacttgtgtaccagtaagtgcccagagacaagtaagtacaagagtattcatagcattattttttataatagctacaaatttgaatcaactcaaatttcatcaataatagcatgaataactaagttgtattatattcatacagtggtagacatacttaaaatgtaggaactacagctacatatgacaacatagatggatcaaacaattttaagtggaagaaacaagacatgaaagagatacatacagaattatttcattcatagaaaattcaaaaagaagcaaaaaagacaatgtcttttaaaaaatgcctacaaaagcactaagcttagaaaagacaagcaagggaataattaccacaaatatcaggacactggtgaattagatggcttggaattgcaggttgttgaggttaaaagatgctttcaggaagagcttgagggaactagcatttgcttctgaaggatacatgagtacttaacagtttttttaatgttcacataagttttatacactcctctgtatgtatgatatgtaagtgctagaaagcagagaagctatcagaacatagagccaagtgccatataatttgggtggtctagaaggcaaggcagtgatgtttgagctgggagattttgattaggtaactaagcagagagcctgacggggagggagtagggttgtgcatggcagtggtcaagagaaaaaatttgttcagaaagagagtacagaagaataagcagaaggaaattggcagctttggtgtggggcaagagagaagaatgctacaagtaaaggctggagaagcaaaaaggggtagcatatgctgggcttgtaagccttctgagggattttagtcttttatgtaagagaaactgaaaggttttaagcacagtggataagataattgaattacaaaggatggaaataattccagtttggagaacaaattggcaagagacctgagtggtactaggatactaggaaaccagaagaagactgggagtctgtgtgagagatgatatcatactaacttgtctcagattatggtgggggagatgagatgtcgatatattggaaagatgtttagaagataaaatcagcagcacttccttggtgtgaaaactgttgaggctgcagggcaaacacaatagaggcttattaggtatctcacccaaactcctaagatgagctgctccccagtgagtagagatatctggagagagagcagtagtcgttcaggcattccttggacagactggattcactagagagaaacatttttggtttgcactgtcagctttgtttttaggttgttttaaatattttacccttgtctcttatgaaaggtcttctcaagaagtagccatgtggacacgatattgctttggtagtaattctgccaaaaatgcctgacttgaatctgatcatgaggaaatatcagaaacccaaattgagggagattctataaaataacttgcctctagtcttcaaaaatgccaaggtcataaaagaaaaactacaggaagatcaaaggagacgaaagagacatgatatctgaaggacatgtgtgatgctgaattgaattggagaaacttttttaaaagttttattgtaaaggacatttagtggataatagatgacattctaataagatcagtagattagataatagaattgtatctatgtatacttcctgataattgtattatggatatataagagaatatccttgttattataaaatacacactgaattattgaatattttggagtaaaaggacattatgtctgccactttcaaatggttcagaaaaactacatacatatacacatatgtgtgtgtgtatatatatgttcatatatatacacacatgtatgttcatatatatatgtttatgaacaatatgtgaacaatatgtttatgtaaaacattgggaaaatctaggtgaatattatacaataattctttgttctatttttacaactatttcataagtgttaaatcatttgtaataaaacattttaaaagtgttttttaatagaaggaagtagtcatgtgaaggccatgcttatatttggcataaccatgagttaatataccactcattgtgccccatataaaatcccacttgagaatttattttagaatttaccatttggaaaagtgttgttcaatctcaaatggtgtattttcatctttccagtaataaaagctatataatggattacatttttcttctggccctggaagccaaggaaactcagagttaaaaatttaacactcaagctaaactgttgagccttctactacatagcatatttccattcttctttttgctgtaattgtcttgcattactgtttctagtcactctgtactatattatctgtgtatgtatgtttgtgggagtggtagataaaatatctcaaactctttgtattagtttcctatggctgctattgtagcaagttgccatacacttggtggcttaaaacaacacacatatattttcttatggttctcgagactagaagttcaaaaccagtttcactcagccaagatcaagtgtcaacagggccgtactccctctggaggttccaggggaaaacctgttccttgcttcttccagcatctggtggctgctggcattccttggcttgtggccacatcattccagccttgccttctgtggtttcattgcctcctcctcatctgtggtcacatctgcctctccctgtctcttacaagaacagttatgattgcatttaggccaactcaaataatccaagattgtctcctcatgtcaggatccttaatcacatttgtgggtcctttttttttctttcttttttatttttttgccatatgagtaacattcataggttccagggatttgaacatggtgatcttttcaggagccattattcagcctaccataccctttatggaaagaagtgacatttaaatgtgttttttaaggtacataaaaataaagtattaatttatttggaaaatataaagtacttctgcactctgtgtatagtgaaggaacaaagataaaagaaatcaaatttctgtttagtgatttttcattgcttttatgaattacattgaattttctattatatttcctatttggttatttctggaatagagaaatatatttgactttttttagaaagtaaattatttgttaatatgaatgaataatacctgtgagatttccaatgaaaagaagcaaagttttatacatcaaatttgcttccaaatgctaatatactaaaatcagtgctagttatgtttaatataggttgctgagaaaaatagttatcttttatggtttttaaaaagtgtatgttaatttatttttatcgtttatttcttactgacaaatgcaaattgtatatatttatggggttcaatgtgaattttgatatactatatattgtaaaatgattaaatcaagcttattgacatattcattacctcacatacttttttgtggtgagaacatttaaaatctactctcttagtaattttcaaatatacaatacatttttattaactatagtcaccatgctgtgcaacagatcttcaaaacttattcctcctgtctaacccaagcttagtacaatttggccaacatctctgctttaccccttggcaaccccaccctaataaccaacattctactctctacttctatgagttcaactttattaagctttacatataagtgaaatcgtgcagtatttatccctctgtgtgtggtttattttacttagcataatgttctccaggatcgtctgtgtcactgcaaatgacagaatttccttcttttttaagactgaatagtattttgttttgaatctatggcacattttcttgatctgttgatggacatttaggttgatttcatatcttggcaattgtgaataatggtgcagtgaacatgagagtgcagacatctcttcaacatattgtttgcatttcgtttagatacacccagaagtagaattgcctgatcacatggtaatttgtcatttttttgaggaaactccatactgttttacaaaatgcctgtactagtttacattcccacagatttttaaaaagttaatcttctacccactaaccttgctaaactttcttatttttttaaaatgtgcatgtattatatatgctctgcatgcattataaatgttacagtaatttttaggtacaacactaaatattctcatatggtttggatggtcagtgaaggcttctgtaaggaagtgatatctgtgatattttggttaggaaaaaagtggtccaaacatagaggacagtatgagctatatatacaagatcatatcatctgcaaattttgcttctctcttcccttctttatatcttcttttgctgttaatttttgtctaattgtgtttgctagggcctctggtattatgctgaacagttgtggtgataaaaagcattctcacatgcacacatatgtttattgcagcactgtttacaatagcaaagatttggaaccaacccaaatgcccctcaatgatagactggataaggaaaatgtggcacatatttaccatggaatactatgcagccataaaaaagaatgagttcatgtcctttgcagggacatggatgaatctgggagccatcattctcagcaaactaacacaggaacagaaaaacaaacactgcatgttctcactcataagcaggagttgaacagtgagaacacatggacacagggaggggaacatcacacactgaggccagtcggggggtagggggaaaggggaagggagagcattaggacaaatgcctaatgcatgcagggcttaaagcctagatgacgggttgataggtgcagcaaaccaccatggcacatgtatacttatgtaacaaacctgcacgttctgcacacgtatcccagaacttaaagtaaaataataaataagcattctcatcttatttctaatcttagagggaatgtatataaaatttttccagtgagagtgatatttgctagagattacagacagacagacagacagacagacacacacacacacacacacacacacacacacacacatttccttatgaaattgagtaaatgatcttccaaagcattcagggcaaatagcagcccatgttttaataaccctaagaattattttatatgatagtcccattccatggccatggagctctgtcactatactgtgaacttctctatggcaggaactattcattcaccattgtatccttactctgaacttctctagggcaggaaactgttcacttgccattggatactcagtatctagcacaatgcctgtaagttaggcattcactatccattcaatgaatgaatggatggatgaacgatagttaatatctgtttcattctcaaagctagcaaattctttttaagcatgagccaaaaatatcactactttccattttctttattcaatgagttgagctcattttgccgccatccttacctcctcccagcacctggtacagtcagtagtcatttgacatatgaaggaataaatgaatgagtcaatcacagagcattctgctgccagttgatagactttgcccctaaagattctgaactttatttgaactgaagccaggtggttaaagatgatttaatcaggacaaaaataaaattctactctctttaatggaataattgcttattgcattttcttcttaaagttggccattcatctccttaaagttggccactgtctttcaatttatatatgttgtccatgaattattgaaagtgattattctgaattaagccaaaattattcacaaagaattgtcttggtgtgtgactagagggttcagaattccagtattacttggagagaggggttgggtatagtggtaaacttaaagtttacctgcaaaaaaacagtgttgaatgcctgagtatggcaaatccaaaaagtaagtatttggatttattggtgaataagggagagaggttggttatcaaaaaaagagcagttaagtaggaatatgttagtagttttaaatactttatgatggctctaatcatatatgtacttcctatttcaaaaggtatttcatttcataagttagagtaacacccaatattagaatttcagtgtccagaaattgattaccttctcctgacttggaactctctgctcaaaagcctttgatgactcttcgttgcctggagagtaaaaatttatttagccctagccagcgctgtccacctgcactcctaccatacacactctctgtttcagccacatgtaacagaatgttaccatagggctcttcctatcttggaggtttcgaacaggccccagagcccagaccacctatgcagagcttgctaaaagattgtgaaacttgtgctaaacgtcaccctgaggatataaaagaggtggaagaagtcagaggtcaagactaaggaaagaggctgaggttgatgattgtatctgagagagtagagcaaaaagtgaagacaaggaaaaggtgtgtgggtccagcacaagggagccagctggggatatcttaaaaggaatcccatccataaggttcaactagaggagcagaatgatcccagagcaggacttgatcacctgaaggccaggactgaaagggagttgtgggcagaccactggacggagagatagccagctttggacaggcaccacaccctgaggacataatgaagccagataacaacgtatatgcatcaagtgagaccttccccaggcaccttgacccctgtatggaggaaccccaaaacacccagctgtccagcaggaaaaagtagaaggaggagagagagaagccagcaagtccccttcttgaagtgtgtatacgctaagcctgaaatatactgtagctgcagaagggagaattttcaattagccaaaatgggagttttaattattataatagagtgtacatatttactgctagaagctggcctgaggacttttataattgaagagtgtaggaatacagtggatccccctgaaatttcatcccaggaatgaggaagaacagttcgtggaacaaatttaccaaggagaagagaatagagctgttttttcctgcacacccataatggtactacagatccttcaataaaccagaacacacacaaggctggggttgtcctctcgtccctctcctacatcagcaaatctgtctctacgtaatcatgtaagactacagcttgctttaatagctcccatcttaagaatgggagggggagagcgaggtagaagaaaaaccttgaccttatatttcgccctcctgttcccccatttattgtctttgccacacagcttctcaagtgctgtataatcccattcctcccctcccactctctcttgagcccaatcagacatttgtacaaacttctccatgaaaataacccttgaccatttgtttcgggctcctgtgaccagggtctgtgttcctaaatccagtagtcctcattcagatcgttctgttggcagcattgggcacagctgcgccctcccttctcaaaacccctcacttgcatgtagttgactctttggtcccattgtctaattgctctccatcaccagtttctaaattttggaaggcgttaagcctctgcccaagacctcttccctgcccatttccccttgcttcttcagtgacctcattaagactcaaagctttaagacaccatctgtagagtatgacctccaaacatatatctccagcctgaccctgatatcctaatatatttaatcacctactcagcatttcttcttggctttctaatagatacctaaaatttagcatgtcaaaagcctaattcctctcagcccccaggaaatctcctctcactgtctttcctagaacatgaaagaacaattctattcatacacttgcctatgtcaaaacaccttgaaaacatccttcatccctctctttttctcatattgtgctccagtaaatgctgtcagttctactgatggaatccaccaatgtggaccacctagttcaagcagttgtgctccctctcttggtttattgacacagtctcctgactgtctccctgtttttaccactgggccctggattctgttctcacagcagccagggtggcctcttgaaaacttgcctcagattatgtcattcctctgctcaaaacctttcaataattttgcatttcactgagaattaaagccaatgtccttaaaaataaaagatctgttcctcttacttttcagctctcatcttctgtcccctttctcactgttcacaccactgcagctgccctgattctttgctgttcatgtaagatagcaagcacacctctgccacagggcctttgtacttgctcttatctctccacctgcatcactcttaactgcatgcttcactcactcactcccttccagtctctgctgtaatgtaacctcatcattaaggtctatccagaccaccctatattaaaataacaacacttgccttcactcactgcttaacctctctatccttctttatttttctacacacagttatcgtcctacgctccactggactgtaagttccatgaagacagaactttgttttttcaccactgaatccccagccccttcaaagtgccttgcatgtaatagactctcacaaatagttctcaaatggagggtgcttcctaacttgctttagcctttccacatgctgttctttctggcaagagttgcttccctttaccccccgccttgttacaccccagccccaagtgagcctgttagaatcctgtgcatcctctcagactccagtttcatacaacctcctctgtgacaccgcgtgagtcagatttaattcctctttccccagaactcaaagttttcagttttattttgctttaatcaagtttgtacccttaaccactacattgtgtgtctttcagactcttgttctttcttgattttaaggctttagagatgacaaattcagcaaccgcaggtccttctcatgttgtagaattgtaaagtagctgttttttaactgcatgcaactgtatgaatcctaaacctagaattttcaatccctctattctaccgcatgtattttcatttctccttctttttctactacttcctcttcatcacaaaaaaagtcccaagcacatattatatgttattcattttcttcaaacatctttcacttaatagtttagagaaaagcccatctattccattgagtgacctttcctatgactatagaaagtggtcagtttttctgtcccttggcctgtttagcagttgaaatgcacctgacagtttgtattacaaagctaaatggtggtggccagtaaggagtttgataaacttttcatgtaatttatacataggggaaatgacactggctgttgagcacatgaagtcattttctttcttccctgaaatgctttgggggagaagaccaatcagtcatcttagtgctgcacctccatagtgagatctgcattaggtttttgaccaagaagacagtaatattttatgacaaaacttggaaaagttaaaaattcacagatgaacaaatgctttttctcattatttatctttttattctttcctatttttattccctgagaccatttgcatgaggggaaatttaatcaggatccctagttgagaacatttctattggagaaaatggaacctggatatcaaattatctcacaacttcttctgagtgacatacactgaattttatcttaaatagcttgtttagaagctattggtcaccagcttaaatagcaccttttcattataacattgcttctgttgttgcattcataacattttatttgctaaaaatgtattaactgtgtctctcccatcagttcttgagctttggagggctgtggctgtggcttattcatctctccatacccaaagactagcatataatagacatacagtaaaaatggaaagactatattgagctgcagtctaccctgtccaattaaaagtcagtggacatttgttgaataactgctatgtgccaggtattttgaaatatttggtgttatttaatctttatagtgaccctaaaatgcattgttatcccttagttatagatgagagaaagtacataagtggtttacccagctagtaagtagcagacctgtctttgaatgtaacccatgtaaagcaaaattttctgtcctttctcctttattagagcttaagtgatctttcagggaccgatatgtttagctatcaactctgtaataacatgaaaaatatttatttagctgtgatcatctatttgataaattgtcagagtgataaacccaaaaggagctttaaagatcattcagcctgtaatcccaaggtggaaagatcacttgaggccaggagtttgagaccagcctgggcaacatagtgagacccttctctcttaaaaagaaaaaaaagctggatgtggtggtggtgggtacctgtagtcccagctacttgggaggctaaggcaggaggatcacttgaacccaggaatttgaggctgcagtgagccatgatcatgcccactgcattccagcctgagaacagagcaagaacttgtctcaaaaaaacccccagaaatcatccaattcagtattctaatttcagatgcaaaaattgagtcccagaagggaaaaggtcttggccattatttcttctgtcagttggaatcatgttattcttctccttttgcactgtccttacagtaattacttttaaatccttagcaagtctgattatcccctgcatggtatggcctgtgatgacctctccagcctcacgttgcactactacccctcacagtttctgtccttcatctgtggcatagaacacactctattctctgcttcctgtccctctgcctatagcacccttccctctactccttctcctaagtcctacttacccttcacatttagctcaggcatctaatatcctctcgctggaagctttcagactagattaggtggtgtatctatgtgcatccatggtacatacctgtcatggtgcgtatccttctgtgtttgttgttagttaactggcttatgtcttccttgctgtgaattccttgaggacagatattgcggagcattcatttctatatcaccacggcctcataaagctcctcacacaaagtcagctttcaggaaattttgaaagaaataatcactcacttggattcaggtctgaagtgaggcaaacattagagatgtgatggtgttgaatactcatcgtttttgatattttgaaggctctcccatgcttgaggatccaaaggagtttaccattttgtaatgccacagatgtgtactggtgtctgtaatgctcaggtcccatccttgagcttcaccaggaacatcagtaggaagatctggcacaggctatgtggagagcctcctcaccccatgctgatgatctcatagtatctggtcactgccactaaggaaaaataaatgcctgcaggtccttttataccatgatgtaactaactataggaagtgtccctatgcaacatctttcatcttacctgaatcaaagcttcaatgaatgaagttctcttcggcccatcatcctgcaagaaactggtaggatgatggcattgggaagctataagggtgattctgacttctctgaaatgacatacattccttgtcaatattatgtcagcggaaaacttgctagccttagaaataaaaataaaggtcttatttttacattgacactttcaatctaggtaaacttgaataattcatttgatatttcagaggcttcatttcttcatctaagaacatgaggatcttttctatttatggaggtatcttgaggattggttgaagtagtgagcatgaaaggtctctagaaaaccttggttgtttagacatgttttagggacattgaaatggactgcgcatggaggaagcttcatggggggcacacctgaggggcatttcctcaatgggagagcacctttgcccttcacaacattcacacacccctcctgggtattggtgccaggctagtgccctgatctgagtccacctctgaacagtcaccctcaccaagataccccgagccaggagagccagtggagcacatctaagccaaagatgtcaaagagagtgaggagtgagaggtccaaattcaactggagaccctcaagatgagacctgttttgaatgagagagagatgaccgtgcagggtggaagcaggtctgatgcagctgacagctaaccactgctgctcggaagtgtcgacggctcaccacttatgtgttggcttttgttcctggactactcaggtggtttaaaagaccaggtgaaattgaggcaataatgaatagcttaccaaccaaaaaaagtccaggaccggatggattcacagccgaattctaccagaggtacaaggaggaattggtaccattccttctgaaactattccagccaatagaaaaagagggaatcctccctaactcattttatgaggccagcaacatcctgataccaaagcctggcagagacacaacaacaaaaaaaaagagaattttagaccaatatccctgatgaacatcgatgcaaaaatcctcaataaaatactggcaaaccgaattcagcagcacatcaaaaagcttatccaccatgatcaagtgggcttcatccctgggatgcaaggcttgttcagcatacacaaatcaataaacataatccagcatataaacagaacaaacaacaaaaaccatatgattatctcaatagatgcagaaaaggcctttgacaaaattcaacaacgcttcatgctaaaaactctcaataaattaggtattgatgggacgtatctcaaaataataagacctatctatgacaaacccacagccaatatcatactgaatgggcaaaaactggaagcattccctttgaaaactggcacaagacaaggatgccctctctcaccactgctattcaacgtagtgttggaagttctggccagggcaatcaggcaggagaaggaaataaagggtattcaattaggaaaagaggaagtcaaattgtccctgtttgcagatgacatgaatgtatatctagaaaaccccatcatctcagcccaaaatctccttaagctgataggcaacttcagcaaagtttcaggatacaaaatcaatgtgcaaaaatcacaagcattcttatacaccagtacagacaaagagagagccaaatcttgagtgaactcccattcacaattgcttcaaagagaataaaatagctaggaatccaacttacaagggacgtgaaggacctcatcaaggagaactacaaaccactgctcaatgaaataaaagaggataccaataaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagctcatatggaatcaaaaaagagcccacattgccaagtcaatcctaagccaaaagaacaaagctagaggcatcacgctacctgacttcaaactatactaccaggctacaggaaccaaaatagcatggtactggtaccaaaacagagatgcagaccaatggaacagaacagagccctcagaaataataccacacatctacaaccatctgatctttgacaaacctgacagaaacaagaaatggggaaaggattccctgtttaataaatggtgctgggaaaactggctagccatatggagaaagctgaaactggatcccttccttacaccctatacaaaaattaattcaaaatggattaaagacttaaatgttagacctgaaactataaaaatcctagaagaaaacctaggcatcaccattcaggacataggcatgggcaaggacttcatgtctaaaacaccaaaagcaatggcaacaaaagccaaaattgacaaatgggatctcattaaactaaagagcttctgcacagcaaaagaaactaccatcagggtgaacaggcaacctacagaatgggagaaaatattcacaacctactcatctgacaaagggctaatatccagaatctacaaagaactcaaacaaatttgcaagaaaaaaaccccatcaacaattgggtgaaggatatgaacagacacttctcaaaagaagacatttatgcagccaaaaggcacatgaaaaaatgctcatcatcactggccatcagaaaaatgcaaatcaaaaccacaatgagataccatctcacaccagttagaatgccaatcattaaacaggaaacaacagatgctggagaggatgtggagaaataggaacacttttacactgttgttgggactgtaaactagttgaaccattgtggaagtcagtgtggcgattcctcagggatctagaactagaaataccatttgacccagccatcccatcactgggtatatacgcaaaggattataaatcatgctactataaagacacatgcacacatatgtttattgtggcactattcacaatagcaaagacttggaaccaagccagatatccaacaatgatagactggattaagaaaatgtggcaaatatacaccatggaatactatgcagccataaaaaatgagttcatgtcctttgtagggacatggatgaagctggaaaccatcattcttagtaagctatcgcaaggacaaaaaaccaaacaccacatgttctcactcataggtgggaattgaacaatgagaacacatggacacaggaaggggaacatcacacaccggggcctgtggtggggtcgggggagtggggagggatagcattaggagatatacctaatgttaaatgacgagttaatggatgcagcacaccaacatggcacatgtatacatatgtaacaaacctgcacattgtgcacatgtaccctaaaacttaaagtataataataaaaaataaaagaccacgtgaaatgagcaggcttgggcaattcaaagcctggaaaaaaagtggtagagagggggatttggggaagagtagatagacagaatgaggtgacacattgaaggacttcttagagaaatgcatttgaggaagaagcagccaagatggccgaataggaacagctctggtctacagctcccagcgtgagtgacgcagaagacgggtgatttctgcatttccatctgaggtaccgggttcatctcactagggagtgccagacagtgggcgcaggacagtgggtgcagcgcaccgtgcacgagctgaagcagggcaaggcattgcctcactcaggaagcacaaggggtcagggagttccctttcctagtcaaagaaaggggtgacagatggcacctggaaaatcgggtcactcccgccctaatactgtgcttttccaatgggcttaaaaaatggcacaccaggagattatatcccgcacctggcttggagggtcctgcacccacggagtctcactgattgctagcacagcagtctgagatcaaactgcaaggcggcagcaaggctgggggaggggcgcccgccattgcccaggcttgcttaggtaagcaaagcagcctggaagctcgaactgggtggagcccaccacagctcaaggaggcctgcctgcctctgtaggctccacctctgggggcagggaacagacaaacaaaaagacagcagtaacccctgccgacttaaatgtccctgtctgacagctttgaagagagcagtggttctcccagcacgcaactggagatctgagaacgggcagactgcctcctcaagtgggtccctgacccctgacccccaagcagcctaactgggaggcaccccccagtaggggcagactgacacctcacacggccgggtactcctctgagacaaaacttccagaggaacgatcagacagctgcattcgcggttcacgataatcccctgttctgcagccactgttgctgttacccaggcaaacagggtctggagtggacctctagcaaactccaacagacctgcagctgagggtcctgtctgttagaaggaaaactaacaaacagaaaggacatccacaccaaaaacccatctgtacgtcgccatcatcaaagaccaaaagtagataaaaccacaaagatggggaaaaaacagagcagaaaaactggaaactctaaaaagcagagcacctctcctcctccaaaggatcgcagttcctcaccagcaatggaacaaagctggacagagattgactttgacgagttgagagaaggcttcagaccatcaaactattccaagctacagaaggaaattcaaaccaaaggcaaagaagttgaaaactttgaaaaaaattcagatgaatgtataactagaataaccaatacaaagaagtgcttaaaggagctgatggagctgaaagccaaggctcgagaactacgtgaagaatgcagaagcctcaggagccgatgtgatcaactggaagaaagggtatcagggatggaagatgaagcgaatgaaatgaagcgagaagggaagtttggagaaaaaagaataaaaagaaacgaacaaagcctccaagaaatatgggactatgtgaaaagaccaaatctacgtctgattggtgtacctgaaagtgacggagagaatggaaccaagttgaaaaacactctgcaggatattatccaggagaacttccccaatctagcaaggcaggccaacgttcagattcaggaaatacagagaacgccacaaagatactcctcgagaagagcaactccaagacacataattgtcagattcaccaaagtcgaaggaaaaaatattaagggcagccagagagaaagggcgggttacccacaaagggaagcccatcagactaacagcagatctcttggcagaaaccctacaagccagaagagagtgggggccaatatttaacattcttaaagaaaagaattttcaatccagaatttcatatccagccaaactaagcttcaaaagtgaaggagaaataaaatactttacagacaagccaatgctgagagattttgtcaccaccaggcctgccctaaaagagctcctgaaggaagcactaaacatggaaaggaacaaccggtaccagccactggaaaatcatgccaaactgtaaagaccatcgaggctaggaggaaactgcatcaactaacgagcaatataaccagctaacatcaaaatgacaggatcaaattcacacataacaatattaactttaaatgtaaatggactaaatgctccaattaaaagacacagtctggtaaattggataaagagtcaagacccatcagtgtgctgtattcaggaaacccagctcacatgcagagacacacataggctcaaaataaaaggatggaggaagatctcccatgcaaatggaaaacaaaaaaaggcaggagttgcaatcctagtctctgataaaacagactttaaaccaacaaagatcaaaagagacaaagaaggccattaaataatggtaaagggatcaattcaacaagagctaaccatcctaaatatatatgcacccaatacaggagcacgcagtttcataatgcaagtcctgagtgacctacaaagagacttagactcccacacaataataatgggagactttaacaccccactgtcaacattagacagatcaacgagacagaaagttaacaaggatacccaggaattgaactcaactctgcaccaagcggacctaatagacatctacagaactctccaccccaaatcaacagaatatacattttttccagcaccacaccacacctattccaaaattgaccacatagttggaagtaaagctctcctgagcaaatgtaaaagaacagaaattataacaaactgtctctcagaccacagtgcaatcaaagtagaactcaggattcagaaactcactcaaaaccgctcaactacatggaaactgaacaacctgctcctgaatgactactgggtacataatgaaatgaaggcagtaataaaggtgttcattgaaaccaacgagaacaaagacacaacataccagaatctctgggacatattcaaagcagtgtgtagagggaaatttatagcactaaatgcccacaagagaaagcaggaaagatccaaaattgacactctaacatcacaattaaaagaactagagaagcaagagcaaacacattcaaaagctagcagaaggcaagaaataactaaaatcacagcagaactgaaggaaatagagacataaaaaacccttcaaaaaattaatgaatctaggagctggttttttgaaaggatcaacaaaattgatagatcgctagcaagactaataaagaagaaaagagagaagaatcaaatagacgcaataaaaaatgataaagggaatatcaccactgaccccacagaaatacaaaccaccatcagagaatactacaaacacctctactcaaataaactagaaaatctagaagaaatggataaattcctcgacacatacaccctcccaagcctaaaccaagaagaagttgaatctctgaatagaacaataacaggatctgaaattgtggcaataattaatagcttaccaaccaaaaagagtccaggaccagatggatttacagctgaattctaccagaggtacaaggaggaagtggtaccattccttctgaaactattccaatcaatagaaaaagaggttatcctccctaactcattttatgaggccagaatcatcctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgtaaggctggttcaatataggcaaatcaataaatgtaatccagcatataaacagaaccaaaggaaaaaaccacatgattatctcaatagatgcagaaaaggcctttgacaaaattcaacaacgccttatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctgtctcaccactcctattcaacatagtgttggaaattctggccagggcaattaggcaggagaaggaaagaaagggtattcaattaggaaaagaggaagtcaaattgtccctgtttgcagatgacgtgattgtatatctagaaaaccccatcgtctcagcccaaaatctcctcaagctgataagcaacttcagcaaagtctcaggatacaaaatcaatgtgcaaaaatcacaagcattcttatacaccaataacagacaaagagagagccaaataatgagtgagctcccatttacaattgcttcaaaaagaataaaatggctaggaatccaacttacaagggatgtgaaggacctcatcaaggagaactacaaaccactgctcaatgaaataaaagaggatataaacaaatggaagaacattccatgctcatgggtaggaagaatcagtatcgtgaaaatggccatactgcccaaggtaatttatagattcagtgccatccccatcaagctaccaatgactttcttcacagaattggaaaaaactactttaaacttcatatggaaccaaaaaagagcccgcatcgccaagtcaatcctaagccaaaagaacaaactggaggcatcacgctacctgacttcaaactatactacaaggctacagtaaccaaaagagcatggtactggtaacaaaacagagatatagaccaatgtaacaggacagagccctcagaaataacaccgcatatctataactacctgatctttgacatacctgagaaaaacaagcaatggggaaaggattccctatttaataaatggtgctgggaaaactggctagccatatgtagaaagctgaaactggattccttccttacaccttatacaaaagttaattcaagatggattaaagacttaaacgttcgacctaaaaccataaaaaccctagaagaaaaactaggcattaccattcaggacataggcatgggcaaggacttcatgtctaaaacaccaaaagcaatggcaacaaaagccaaaattgacaaatgggatctcattaaactaaagagcttctgcacagcaaaagaaactaccatcagactgaacaggcaacctacaaaatgggtgaaaattttcgcaacctactcatctgacaaagggctaatattcagaatctacaatgaactcaaacaaatttacaagaaaaagcaaccccatcaaaaagtgggcaaaggacatgaacagacacttctcaaaagaagacatttatgcagcaaaaaaacacatgaaaaaatgctcaccatcactggccatcagagaaatgcaaatcaaaaccacaatgagataccatctcacaccagttagaatggcagtcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccatcccattactgggtatatacccaaaggactataaatcatgctggtataaagacacatgcacacatatgtttattgctgcactattcacaatagcaaagacttggaaccaacccaaatgtccaacaatgatagactggattaagaaaatgtggcacatatacaccatggaatactatacagccatgaaaattgatgagttcatgtcctttgtggggacatggatgaaattggaaatcattattctcagtaaactatagcaagaacaaaagaccaaacaccgcatattctcactcataggtgggaattgaacaatgagaatacatggacacaggaaggggaacatcacactctggggactgttgtggggtggggggacgggggagggatagcattatgagatatacctaatgctaaatgacgagttaatgggtgtagcacaccagcatggcacatgtatacatatataactaaccggcacattgtgcacatgtaccctagaacttcaactatagtaataataaaataagaaaaagtaaaaataaaaaaataaaagagaaatgcatttgaggcaaagcctcttttcctctgtgtagaactgatgatggggtaaaatagaagaaaccacacatatacaccctgatgctgatctagagcccagtagctccagagagctagggaaggccccactctgtgtgggacatttatgtggcctgtgaccacaagaaccgtcagcagcagaacaggtgatgagcatttgttgagtgaatcaaaacagaaatgaaccactgtgcaggttcagctgggttcccctgaatgcatccttgagagggtcctcagtgtgtttgtggacatctagttacaaggcaatcaacatataaatggggatcatcttcccatcgccttcaagaaaaacagaattctatttctgcatgtcatgaagggttctttaggatctgacacatacctgcccttccactcagaggtctgacattttattttcacatctgctccgtggctgcctgtctttgggcaagttacatgaccctgctaatcctcagttccctcatctttaaaatggggataaagatacctatctcaccggcttgtgataattataaaatgagaaagtgcaaataaatccactgtcttttcatcacacatatgccaatccagcatttgtgatttttaaaaattcttactgtatagtttacctttcagccaaaccatgccttcttcaagctgatattatactaagaacttttatctttattgaggtgcttatcagaatatcttgccattcttgcattaactgttagatatcccaactgcatgggaaacaaggacaagcacagtatctttttcatctctctttttcacaggacctgacacatagaaggtgctcagctgaatgtttgccgaagggtcatgtgaagtgtctctgttctggagaatcttgattcccaagagccccagataattcctggcccctactctcctatcccatattaggcagctactctgtgtcagaaactaagccaggggctctgcacaaaaggctgtagttcatagctctgcaaccctggggggcagctattatataaacttcttacaacaattaacacaaatccctcaagtgtaaacatctgatgtctctttaccttcaacccactagggacacaaattgagaacccagcaaccctcatctggcatggaaaacttaagacctggatttcttccacctgcacctgctgcgtttgtagccatcccctcccctcttccagcacctttgttgtttgtatcttaccaggattaaccatactagtctggactctgaactcagaaacatgtagattaaacatttcctagcttaaaaaaatagagtgcagaaagttaaatagttagctctcacatgttgattatttactatgtgaaggcagtatgtagggtttgtctaacattgcctccaattttcccaaatatccggtaaggtgaatattcttgtctgtcttttacacgggaagaagccaagattcaagagggcctcataacttgctgcatggatctgtgattcctgacctgggtacaccccaacactgcttcttcctggcaccaggcacccaaggaatcagttccactagcccccacgcctcagcaaccagcactaggcatggaggggtgcttcctcccaccaaggctgagtgctcagtcacaccctatgagagcaagccaatgaaatggaaaaatagctcttactcctgactctgacatctgccctgcaggtgagagccaaattctcaaattgccaggccaatggcaaataagcccacactatgcacagagggtatcaacacaaagagggttctgtgggaattcacacatcctggaagccaggctgaccctggtagacagtttcattttatcttgtctcagccacatgatgagtggagagagagaaggaaagtgcacagatctccagaaatggggtttgggttcactcttgagaatacccctgggcagtactctgacccttgggcccctctctgtaaacacacaagaacagctaaaatgtctggaaaggggaagggctggttccactgatgcccctgcattcattgagtttcctgcttcccaagtagctgagaggcagctggatataaaaggaacaggctttggagtcagacccagatcaaatccccattctgctacttggtacctgtaggacaatgagcaaggctttgaccttctgtgagccatggtttatctgtaaactaaaggaaatggtagattatcatgaaaattatagataagaatatgaaacagcacatagtagctgcttggcaaatgttagttgccttccctcccttttcccccactgcattcatttgtaatgcctttttttaaaaaaaaatgacagtaagagcaattataattggcacaggttgctttatgagctaaatatgttacagatcaataatacacaatctctggcctggcgcggtggctcatgcctgtaatcccagcactttaggagaccaaggtgggcagatcacaaggtcaggagttcgagaccagcctagccaatatggcgaaaccccatctctactgaaaatacaaaaaattagccgggcttggtggtgagcaactgcagtcccagctactcgagagactgaggcagaagaatcctttgaacccaggaggcagaagttgcagtgagccgagatcgcgccattgcactccagcctgggtgacagagtgagactccatctcaaaaaaataataataaaaaataaataaaaaccacaatctctatttaagccactctcacaggactgactgtaccctatatcatgtcatatatttgacagacagttgcttttcttccttttattcttctaaagaagtccagatgagccccagatacaggttcataccctagatagcctattccaagggttaaaatcaggcctgcttcacatcgaaggcattttgttatgatctgttcataacaaaagctgcctcctggctgttgcctgcagctgaatactgttactctgaagccatcatttcatttgtttctgattgttctgcagtgtttacataccttacatattagcgtgatcttttatagagtacaggcagaggttaagccctcccggatccactttccctctgagggctctttcttcttttttactgtcccttgcctctgtgttacaaaccatttctcttttatagaaattcatttaaatagaaaaacaatttttaagtgttttcttttttttttaacatgaggctcacttaacatttttagaaaatgttgaatatggagaagagggaaaagataccaccaaaatgtgtgattttttttttcttttttcctgacataggaaaatcccattacctctcttgaatttaccaagggacatattccatttagggcatagaaggacctgggctgcctccagacctaatgtggaagaaggtgctgtctgcctgctatttccttgcttctccttatttcaatcttttttttttctccaaaaaaaaaaaaaagtgacttaggaaggatatggacttgtgagtcagatttgggtctaagtcttggttctgccctatgtgtaatcccaggaaggaacttgagttgattttctgaagctcagtttccttttccattaaaactgggagtgactcaggcttgcctagtatcttagctggaagaatgtgtgtgaaactggcccacctttcacagataggtcaccctgctgattgcagtggcttccaggcacccaggcctgggaaagattcacaggcctagtccagacctggcaggaaagaggctgtgagcagttctgcctgccgcagatgtgctggcacatgtaccgccgtgtgctgccccaggtaacatatcaggcagctagggaatgtaggctttcagaccctctctcttcagttctcttctgctgacttcctcccatccagccatcatactttcttaatcctctcatcaatcccctttgttatagagaagatggaagggttaaattccttcaccctcatcacttccactgatatttgataaacacctctcagttcataatacttttgcactcaagcaggggagctacccaggtgtctatggaaagttttgaattctttttgcctattcagtttagtcttctcattttctatctggccagaaatggagaaagtgttttgaaggtcaggattcttcaggtctagacttgtagggatgtatcctgaattcctctgagctaagcctgagaagcacaagtgggttctattgggaaacacttccaaaaggcaatgattgatgcttatgcacagaaattctgacttttagtaaaagatgcttggatataaatcaagcaggactctccttgcctttatacaatatgcggtaaacagggtaaatcctcaattttacttatgcccactgacagatcttacaagtagaaattaacccatctgagtgatcgtgttgattctttctccctcttctctagagccattataacctctgtaccctacttcagaattctaatcaagatagtgtcaagtcttttaaaaaaaagttaaacccccacatgagctccaatccataaataagaaactcaccctggcttgtatggaggtgatgatattaacacaggctacatttctctgggtcactgaatgtacccggcactgtaccaaggccagtaatagactgtgccacatttaatctttacagatctgtaagagaggtcttatttgtcccatttttcagatgaacaccccaaagaccaaggtcacacagcagagactctcggctggagactgccctcaggcatccttttaacggaactctaaagtctgcaggagggagccatttttcctaccagccagtttagaatcaaaaaagagcattggttttgccgtattagagaactaattcataattagtactatgctcactcctggaggatttgacagaaatagaagatatggttctgactcaggatccacctcactacgtgatgtcagagcaacagagctaagactgcaactgatgagtattgtgcagatggagcacgctacctcctcgttagctctctcccctgcacccactctgccccacccactcctcctcccttgcgtgatccatagaatagaccaatatgtgtttacccaccacagattgtttggattgtgaaaaatgcatgatataattttatatctttgaaggcacacagctctcagagctttcaaagctgaaaaccagtctgggctcactggagccagttaggcatttgtatatagaaggccaagtgtggcttcttgtctataggagagagaaaatgtggaggaacttttggaaggcttcagagtttttttggctattctctctctcttgcaaagcaatctgggtgcattaactataaatgaatgagaaacatatggattaaattttatctgtgatcacatatgagtttcaagaatgataaagaataaggaattcagtgtttaaggagtccagaatactttgcaagtaattcaggatattgcaggcaacatttggctgcctccctctatccaaatttgaggactgtttggtagggtgacagacctgctcagtgccctccccacccactcagattgctaaacctcaggagatacctgtggataggttttgtgtgtatcttgttttgctgagactgaaataaagagattgggtttctaggaaaggcaaactctatgagaacactcttaaccactttgaaacccccaaatagaagaggaaaatttggtaagcccgatctttattaaccatgtcttgcttacagataatattagatgtgttttatatcctattattgcccttaatgttagtgtcattgtcctgttaatgataatggtagccatgtcctgcacttgtgtagtgatctaatttacaaacaggtacacattacctgttaatacacattacagatgtatttgtagagatgtacacttacaacatatgcagagtatgttatgacaagctacaatacaggaattacagagttaagtgaagatgcaggcaggagtacctaacccagcattgtggtagaagtcagggtttatggaaggcttttcagaggagataacattgagttcagtcctacacatgttcgtttgtttgtttgtttgtttgtttttgagacggagtctcaccctgtcgcccaggatagagtgcagtggcacgatcttggcttactgtaacctccacctcctgggttcaagtgattctcctgcttcagcctcccaagtagttggtactacaggcacgtgccaccacacctagctaatttttgtatttttagtagagccagggtttcaccatgtcagccaggctggtctcagaactcctgacctcccagtgatctgctggccttagcctcccaaagtgctgggttatgcatgttcttaaaagaatatgaataagtaagtggctgggtgcagtggctcatgcctgtaatcccagcactttgggaggccgagacgggcggatcacttgaggtcaggagttcaagaccacctggccaacactggtgaaacccatctctactaaaaatataaacattagctgggcgtggtggcatgtgcctgtaatcccagctacttgggaggctgaggcaggagaatcacttgaacccaggaggcagaggttgcagtgagccgagattttgccacttcacttcagctgggggacagagcaagactcaaaaaaaaaaaaaaaaaaaaaggaatatgtataagttagctaggggaaagcgagagggagtgccctctaatcagtgagacaagaatttatgaacactaagagttgagaaagaaaatggcacaaggggaatttcaggttcacttaagtctgaggcctagcttatgatgggcttggtgcaataaaaatgatgggggcagaggattgggaaatgataacataggggatttcaggagacaaaaaggtaaaagctacatcagacagtcccatatgtcgtggcaagctgctcaaggactttagtaaggagaatgatagaattaaatttgtgtattagaaagatcattgtggtggaggtatgaaagattctctgagtgacgcttaagagagtacaggatggaggacactatttgggtcagggaaacgagtttaatccagtttcatcacccttgtaataatccaagcaagaaatgatgaagggctggactaacgtagtggcaatagttggaaacaggaagacttgtgtttgaaaaatatttgacagagcaccgtgacctactgtggggcagatgagagcgatgaatgatcaggaagtcaagaatggtatcctgagacagagatacttctgacatgtcaaaaatataacgtgccatccttcatcccagagctacagaacaagacatgtcgattagccatccaggtcaaaggttccatgtggagctcaggagcaaggcctgagtgtgggataaaaattgtcattgcacacataggactggatgagctgaccctaagagatgtaggcagtgagatgaacataggagagaatccaggagggaagagaaagaagagcctaccaaagagacgaagctaataatgagtagaggctggacctgcacccagctctttggacaccaaacttttccaccgtcccagaaagttgcagaattaagccatctgtggcttaacatgccttgagagcatactgtgtcctaggatctttatacacattaccccatctaggacttagacacagctctgtggttaatgagatgatccccatcgacagataaggaaactgagtctcaggtcagcaaatgacctaaccagaaatatccaagtttgtcagactcctaagtctgtgctcatgttactaaaccatgtttctgcctttaagataagatatggctcctcactatttcctgggagaggcagacattaacagctatttacaattcaatctgagaaatgtagaaataaaggtgaatgctgagagcccccattcataaacaaaattctctatgcttttttttttttttttttgtaccatgtggtgatctaggagttggctggattgtgtataaatggtttttctctagtaagacgatagcaccgtccatttggagggtgagatgagccaccatggaaatacccggtcccacacatgcctgtggctaccctctaaaattcccaacctggccggaggcactcaaaacaaaacctcctgttccctcccaggacgactggcgcctggagcctgccttttgcccctgccagaggcttaggccagcctcggagtgatggcgttgcagggaggcagaacaaacggagctggagcagctccccactctgagcccagtcatctctcccagaagaggtgtgagcaggcttctgggctttgtcaccacagggaaactcggctgacgggcacattgccttagatgaaactaagccaatggcatgcactcatggagccagcttgagcatagacaaaaagagaggcaggagcacatggaaagaggcttctaatcccagctccatcatttctgatctttatgatcctgggcaatttgcttaccctcttcatgcctgtgtcttcagctataatatgggctgactgtgtttgactctatagactgtcagggtaactctaagtctgaatgcaaatgtacacctacaagtcacttgatatctgagttatgccccagcccatactgaattccaagtccccctagattataaacttcgggaggacggagactacatcacttattggctctgatgtctgtctttctatatcttttcatgtttaaaacagtagtttgaaatcagtgtgtatccaataatatttactgaatacttaatcagctaatgtaagatgttttagatagtagccattaaatacaactcatgaagttgacagaaaaacccacaataatcttggccacaggttatggagcaaagcaagtactaggggtactaccaacagagcaaagtaagtacttcaagaagccccaggagttagcccaagacaatcccatgaagcccaggccatgtgagggcagagtctgtgttgaaatagctagctgaagagttctgattgaccagctgggctagaacaactcagcttcatgaaatcttagaaaacctcaaagacaaaagagatattaaatatttctagtccaatcaattgattttatagctaaggagagttagttatagagagagaaataagttggtggttcataatttggatcctgaaagccctcctcttctatttactagctatttgacctcctgcagcttctatttcctcatctgtgaagtaaatataataataggacctctctcattgggttgtcatgagtgttaaatgtgataatatatgtgaagaacctagaagagtctgtagcatatgataaatgcaaataactcttagcaatgactattttattatttctatatgatttattattataattgttaactgatttaaaggctcatttcagtgggttttttccccaaccataattgttttaaaattggatttttgagaatcagtaggatctgttgatgcaaaactatacccatccttcaaaccatgcgatcttttatttaaagtaaaatgcagaactttatatggggccccctgaaatcaaaatgtgtttacagcttcatgactctgagccttgtctacatgactgtttctgcccgggctgcccttcctctctgcccaagcaagtatgtcctcctcgttcaaagccttgcttcaaggtggccatctctgtgaaatgctcactcttttcccaggcagtgagttattccttcctttgggctcgtactgcactcctctcttacctttttgtagcacttgccatgttttgttgttatttttttatttctacctggctgccctgtcagattaggaactccctgaggtaagcgaccatgccacttcattagtagtagtagtaatagtaatagtaatattttgccttattgttatagctttattgagctcagtgtctgacatacagtatgcaaccaaagtttttattactgtttttgaagtttttataatgatatttatatcagacacaaagagtacaccagatgtctaagtacagtttaaacaaaataccaaaatgaacaccagtattcccaccaccaaacctgtgaaagagaatattgccaataccttttaagtgtaagtttttaactgtgtgagtaaataaatgttacttgttttcttaattttgcttagtgttttagctctttgaggtaattttgaatcttgatttgaacatgtcccataataagctatttttccaagtgttagcatctgaaaatataagcttttcttctgtatcatcttctactccattattaagcatattgattaaaccaagaccaaggacaaatctagagacccctttacatggttgtgattactattgcctgtggttgttcagccagtcacctgactattccatcatacaagcctcatttcaaggagagctaacgtttatttggtgtttaacatataataaaccattgatatgtgacagcttacttaatctttacaaaagtcccccagcattcatgcattcctcccattttggagttgaggaaactgaggctcagaaaggctaccttacgtaagatcgcctagctgagaattgggcagagtcaggactagaatcacgatgggcctttgtcccgacccatagtttctcttctgttgttcactggtatatcagggaacacttaatggaaactttttagaaatgaagattccctaacctacttgtcatcaaggccagaaggttatgttcagtttgagtaagtctgtgttggctctaatggcccttgctttctgctcttcaaaacagatgaaagactcaaagaagtaatggtagcctaaaattaagactataatttggcagagacaaatatagaacctgatgcctgactgctttcagtttttgtaacactgggcatgttatttaactctctgcctcagtctacatatctgtacaataggaataataacagaatttttaagtgatttaatacctgtaatatgcttagaatcaggcctttactaagtacacagtaagtctcaactattgttgttgttgccaacagtgccgttattactgggaagtcagtgtcctgcatggacacctgtcatcaatgtagtatgatgagctccccttctttagggtcatggagcagtctccaggccaagacagccatcagcatggaaggggctttcacaaaaagatttttaaatatttaggtttgttgcaaaagattaaacaacacataagtacacaagtgtacattctttctctctctctcaaaacaaactaggaattcctagattcttctaagaacacagggtttgagagtgactagaagtactctttgtttccttgctttacacaggatgtctgaggagaagcatgtgctattccagatgagtgggcacaaacagaggtcaactcaaaactttctccctggacagagccaagcaaaaccattctctgacatttctgagcagcaaagcagcaaagccacaatcttctaatgaagtcttgctgcagctgatgcagtaacatccccaaattgtgggacaggggatggggagaagggaggtgaagtgtatccttcctaagcaatttatgcatacaagtaaagagcattatcatagagtttgaggtcaacatctgcctcagttgaaatcccatcgtggtcatccatgtactaaccatagacaacttacacaacctcttggggactaatctgtcaaatggggccaagagttctggaggcaaggggctgcaagacacagaaagagatgacttggctttggctctacctgtgcaaaccctgggtcctaagtggtaatgaatatggactgcctcattcatctcaaagaagctctgggacttaggaaagcaatttctagaattggcacgtgataaaattttcactgggcaaagaaaggcagagtggtgaaaataagtaccagttagtatgctctccttgtggctggaacattcaccatagctcactcgtgcattctttctctctcatacacacaacactcacactcacccacctgaataatttccatgcatgttttaaatcttaattcatgtaccatttccttggagaagcattccctgtcacctagactgaattaggtacctcccttgtgtgctctcttactaccttttggctttccctcatttacttctcacagttggtaattacatatttgtgtaatgatctgattaatatttttcttaaggtagccagttgccccagtttggctgaaactgaggggttttccagaaggcaagactttcagcgctgaaactgggaaagtcctggccaaacctgcgtaattgttcactctggtctgcttccctctcaagatcggatgctctttgagtacaggcactatgctcttgttcaccatttatctctgtgcctggcacagacctggactgggaactcaggaaacatctgttaaccagtaaagaagtaaatgtatatgttaatctaagctgaacttacttttcttatgaaagcctatcttttttctccctgaaattattctattttgatgttaaaatatcccttttgaaaaactgtccttatttgacaaaatttaaagttcacaatgttatgctgtttttgttttttgccttccttcccccccttcccattttgtggttggaaatcctactgatttgaggaatcacttgtttagtaaagagagaaccggggtagctgaggtcaagacaaataaggtctgtccccatgctaaaatgctagtaatcacttctgtatcctctgggcctagcacattaccaagcacatagtaagggctgagtaaatatttgtgaaatatataaatgaatagattttctgcccagcctcaagacctgctggaatacaacttgtatgcctaactcccttttcttccctaccctctagctaaacatttctgtgaccataaatgtgacttcagcattccttactgctgaatagatgagaaacatgtaccactgcagatgaatgaacacatggtctatccccacccgttctagttcatctctttaaatgctttccttactgttgaagggactgctatggtctgttaaaaaataataataataataaaataaaaaattttaaaaaaatggcactatcttgattactgagagcacctctcttacccacatggctttgttcaagctcctccctctacttggaacacctgtttcactttagcaaaatcctactagtcttttcaaacttagcttatgtccctttctctaagaagccacctctgtacccttccacttgtcaaaagtaaaatgagaacaagttagggaaaaatttgaaagttttctatcttacaaaaagtaccaattgccatcagcaagacttcaagtggtaagaagctcaccttacggcagttacagtgcagtttatgaagcattaaggagaaagtattttgacctttttagtcattggctgttatgtattaacatttttttttcaggggaaacaggactgtttaaactgatttgtctatagttgattgatttaattttcctgaatcatgctgacaaggacctaaagcttatgttttaatttcatcaaatcatgctgacagggagataaagcttatgttttatgctttgtttataatgagagctagcaactcagggaaatcagaatgacttaagttttaccacttgactctgggcagttggccttggggtatatatctaaatggcggcctctatctttgtataatctttagtacattcctcacctcctgtgcccatccacaatattttgtattttgtctttaccatctcatgaaccacactatattctatttgtctatttttttgtatagctcctccactagatgggagcttcttgaaagtaagaactctgattcatctttgtgtccccagcacccaatagggggacaggattgctattaggtagcagtacatatttgtaaaaggaaagaaatctatcagttattatagtcccccaaatgctaagttacagacaaatagaaaaccttagtgacaaacaacagtagacatttatttttgctcacaagtttgttggttggctaggtgagtctgatgatctgggctagtcaatgctggtcacctacaaatatttgctgatgttacctgggttctttcatatatgtgggacatcacctgagacaactgaacagactcagctctgttgcacatctcctgtcacccagcagccttgtagggcatggtcttgtggccaagtttgaggagcgaaagacagaacagaagcacacagcccttttgagacctaggcttggaaaactgacccagtgtcacatctgcctcattctcttggcaaaacaagtcacaagactggcatagattgaaggggtagggagatagacccacatctcaatgtgaggagctgcaaagtctcattgcaaagagtgttgacacaggaagggtggagaatggggaccacctttgcaatctctgccatagtgagggagccaacagggaaacaccttatcagtttctttccaaaatgaccatttttattaccttaacatttaaatgaatttatcaggaaagtttctaaaaaaaggagccatggcctttcttgggagagagtgacttccccaccataaaaggcattcaataagaagctgaattccatggtcatagaaatattaggaggagaacccttcccctacccctgagagtcaatgttttcacatattttccatctttctttccagatcagcaaagacccgatttttgtaccaggcgtctgggggccttatttctcagccatggtacctgggttctggctgaatgaaggtggtcagagcgttactggaaaattggtaagttgacactttctcaatagggtcatggatgtttttatgtcattgattagtccattttgtcacatgacccatatacccaatatctggaggatttgcagacccctgaatcggggtgtactttctcttagtgcacagcctaacatgtcatacacatgcagcatatattgcttaaggaagaagtgttacagcaggcagtgatgaccagcccttcttctcacctgatctttccttacatcaatccatttttctcagagtgatgagaatgatattctacttagagaaaacgacatgttactccccagcccaaatccttcagttttccccatagccccttgagacatggctcagataatattctggctgcattatacacttcatggtctatcccctccagtcccacacatgtgcctgtaatttacactaggttgctctcctcacagcttctccatgcctcctgtcattgcacttctctgtccctttatacaggcttctttccctgcttggggagttctttaccacctcaataattttacttgtcctttaagatccaactccagctcttagcacactctgttattcttattggttactaatccccttttctagaacactctgagttccttaaagacaagggccatgcggtacacagtggctcatgcctataataccagcactttgtgaggctggggcgggcagaccacctgaggtctgaagctcaaggacagcctgaccaacatggtgaaacctcatctctactaaaaatacaaaaattagctgggctcgatggcaggcgcctgtaatctcagctactcagatactctcctaagacaggagaatcacttgaatctgggaggcacagattacagtgaactgagaatgcaacactgcacttcagcctgggcgacaagagcgaaactccgtcttaaaaaaaaaccccacaaaataaagacaagttctctttgtatccacctcagtgccaggttcatagaaggtacttaatacaaacttgttgaattattaaggctgtccaataggggagagagaagattcataaaagtgagatgagtgctgtaacagaagtacacggtacagagttggcacaaagctaggttaggaaactctttacaggggagaaggcattggtgctgagccttaaaagataaataaggacaaaccaggtaaagaagggtacagatagtctacttggtaggaaacttgtatgggaaaaaagacatggaagtgaaaaataacggctaatttgagggtaatggcaaatagtccagaagttcagctgtggcacaaactattcttagaaaaatggcttacgataaaagttagagagtagggcagagaccacatccctgtaaaacatgctaaggaattgaacttcgtctagcagaccaagaggaaccagtgaaaggttagaagagtatgtggacatgttcataactcagttgtaaaaatctctgcttagaagccatgagggtaaaggcctgaggacacatggccagaggcagggagactagttttagtaggttagtcaacagacaaaaagccacaaggacttgaatgaggacagtaataatgatgactgggaattgaggtcaagagattggcaggcttctgagagatcaaatgtggaatacagagaaagtgagacctaggctcagttacacacactcacatttactgttaaattggaaatatctgcttatgttatgatgtgatttgcctaccaactcttctaaatgttcagccaattggaaatgatcttattcaaagctggatgtatatgcaaatatctgtgagtttacatttcttagtataatcctattttatacatgactgcctcaaattctctttcaaagtaaatggaagcataggtgggtagatggattcaaagggcatgttctgtacgttactgttgtgccaggctacagaaatgaattaaatgaattggacctcatcagtccctggttttaaggagctcatacttggatggggaatccctgagtatgaaataaatcatgtttgattggtctcagtaaccagtgctagaaaagttgagaaggaagacatcatctatggctacagtacagtagaaatgcagcccactttatattctcctatttaaacttgtgctatgtacttagtcaacttattttattttactttcagttccgggatacaagtgcagaacctgcaggtttgttacataggaatatgtgtgccatggtggtttcctgcacctgtcaacccatcatctatgttttaagccttccatgcattagcaatgtgtcctaatgctctccctccccttgcccctaactccccaactggccccagtatgtgttgtccccctctctgtgttcatgtgttctcattcttcaactcctgcttatgagtgagaacatgcagtgtttggttttctgttcctgtgttagtttgctgaggatgatggcttccagcttcatccatgtccctgcaaagagatctcatgcctttttatgaaggcatagtattccatggtgtatatgtgccacaatttcttaatccagtctatcactgatgggcatttgggtcggttccatgtctttgctattgtaaatagagctacagagttccaagatggccgaataggaacagctccagtctacagctcccagcatgagcgatgcagacgaccagtgatttctgcatttccagctgagatactgggttcatctcactggggcttgtcagacagtgggtgcaggacagtgggtgcagcccacagaccgtgagccgaagcagggcgaggcatcgcctcacccgggaagcacaaggggtccaggaattccctttcctagccaaggaaagccatgacagatggcacctggaaaattgggtcactcccacacggctactgcgcttttacaatggtcttagcaaacggcacaccaggagattatatcctgcgcctggctcagagggtcccacgcccacagagccttgctcactgccagcacagcagtctcagatccaactgcaaggcagcagtgaggctggggtaggggtgcccaccattgctgaggcttgagtaggtaaacaaagtggcctggaagctctaactgggtggagcccacctcagctcaaggagacctgcctgcctctgtagactccacctctgagggcggggcatagctgaacaaaaggcagcagaaacttctgtacacttaaacgtccctgtctgacagctttgaagagagaagtggttctcccagcacagggattgagatctgagaatggacagactgcctcctcaagtgggaccctgaccccctcagtagcctaactgggagacacctcccagtaggggccgactgacacctcatacaaccaggtacccctctgaaacaaagcttacagaggaaggatcaggcagcaacatttctgcaatatttgctgttctgcagcctccactggtgatactcagggtctagagtgaaacgccagcaatctccaacagacctgcagctgagggtcctgactgttagaaggaaaactaacaaacagaaaggacatccacaccaaaacccaatctgtacgtcaccatcatcaaagaccaaaggtagataaaaccacaaagatggggaaaaaacagagcagaaaaactgaaaattctaaaaatcagagtgcctctcctcctccaaaggaacgcagctcctcaccagcaacggaacaaagctggacggagtatgactttgacgagttgagagaagaaggcttcagacgatcaaactgctccgagctaaaggaggaagttcgaacccatggcaaagaagttaaaaaccttgaaaaaagattagatgaatgtctaactagaataaccactgcagataagtccttaaaggacctgatggagctgaaaaccatggcacgagaactatgtgacaaatgcacaagcctcagtagccgatttgatcaactggaagaaaaggtatcagtgatggaagatcaaatgaatgaaatgaagctacaagagaagtttagagaaaaaagaataaaaagagacgaacaaagcctccaagaaatatgggactatgtgaaaagaccaaatctacgtctgattagtgtacctgaaagtgacggggagaatggaaccaactgggaaaacactctgcaggatattatccagaacttccccaacctagctaggcagaccaacattcagattcaggaaatacagagaatgccacaaagatactcctcgagaagagcaactccaagacacataattgtcagattcaccaaagttgaaatgaaggaaaaaatgttaagggcagccagagagaaaggttgggttacccacaaaaggaagcccatcagactaacagctgatctctcggcagaaactctacaagccagaagagagtgggggccaatattcaacattcttaaagaaaagaattttcaacccagaatttcatatccagccaaactaagcttcataagtgaaggagaaatgaaatactttacagacaagcaaatactgagagattttgtcaccaccaggcctgccctaaaagagctcctgacggaagcactaaacatggaaaggaacaactggtaccagccactgcaaaaacatgccaaattgtaaagaccatcaaggctgggaagaaactgcatcaactaacaggcaaaataaccagctaacgtcataatgacaggatcaaattcacacatagcaatattaaccttatatgtaaatgggctaaatgctccaattgaaagacacagactggcaaattggataaagtgtcaagacccatccatgtgctgtattcaggaaacccatctcacgtgcggagacacacatagtctcaaaataaagggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaaccatcctaaatatatatgtacccaatacaggagcacccagattcataaagcaagtccttagagaactacaaagagacttagactcccacacaataataatgggagacttaaaccaccccactgacaacattagacagatcaacgagacagaacgttaacaaggatatccaggaatagaactcagctctgcaccaagtggacctaatagacatctacagaactctccaccccaaatcaacagaatatacattcttctcagcaacacaccacacctattccaaaattgaccacatagttggaagtaaagacgtcctcagcaaatgtaaaggacagaaattataacaaactgtctctcagaccacagtgcaatcaaagtagaattcaggtttcagaaactcactcaaaaccactcaactacatggaaactgaacaacctgctcctgaatgactactgggtacataacaaaatggaggcagaaataaggatgttctttgaaaccaatgagaacaaagacacaacataccagaatctctgggacaccttcaaagtagtgtgtagagggaaatttatagcactaaatgcccacaagagaaagcaggaaaggtgtaaaattgacaccctaacatcacaattaaaagaactagagaagcaaaagcaaacacattcaaaagctagcagaaggcaagaaataactaaaatcagagcagaactgaaggaaatagagacacaaaaaacccttcaaaaaatcgatgcatccagaagctggttttttgaaaagatcaacaaaattgatagaacgctagcaagactaatgaagaagaaaagagagaagaatcaaatagacacaataaaaaatgataaaggggatatcaccaccgatcccatagaaatacaaactaccatcagagaatactataaacacctctatgcaaataaactagaaaatctagaagaaatggataaattcctggacacatataccctcccaagactaaaccaggaagaagttgaatctctgaatagaccaataacaggctctgaaattgaggcaataattaatatcttaccaaccaaaaaaagtacaggaccagacggattcacagccgaattctaccagaggtacaaggaggaactggtaccactccttctgaaactattccaatcaataggaaaagagggaatcctccctaactcattttatgaggccagcatcatcctgataccaaagcctggcagagacacaactaaaaaagagaattttagaccaatatccctgatgaacatcgatgcaaaaatcctcaataaaatattggcaaactgaatccagcagcacatcaaaaagcttatccaccatgatcaagtgggcttcatccctgggatgcaagactggttcaacatatgcaaatcaataaacgtaatcctgcatataaacagaaccaacgacaaaaaccacatgattatctcaatagatgcagaaaaggcctttgacaaaattcaacaacccctcatgctaaaaactctcaataaattaggtatttatgggacatgtctcaaaatagtaagagctatctatgacaaacccacagccaatatcatactgaatgggcaaaaactggaagcattccctttgaaaactgtcacaagacagggatgccctctctcaccactgctattcaacatagtgttggaagttctggtcagggcaatcaggcaggagaaggaaataaagggtattcaattaggaaaagaggaagtcaaatttttcctgtttgtagatgacatgattgtatatctagaaaaccccatcatctcagcccaaaatctccttaagctgataagcaacttcagcaaactccccggatacaaaatcaatgtgcaaaaatcacaagcattcttatacaccaataacagacaaagagagagccaaatcatgagtgaactcccattcacaattgcttcaaagagaataaaatacctaggaatccaacttacaagggatgtgaatgacctcttcaaggagaactacaaaccactgctcaatgaaataaaagaggacacaaacaaatggaagaacattccatgctcatgggtaggaagaatcaatatcatgaaaatggccacactgcccaaggtaatttatagattcaatgccatccccatcaagctactgatgactttcttcacagaattggaaaaaactactttaaagttcatatggaatcaaaaaagagcccatattgccaagtcaatcctaagccaaaagaacaaagctggagacatcacgctacctgacttcaaactatactacaaggctacagcaaccaaaacagcatggtactggtatcataacagagatatagaccaatgaaacagaacagagccctcagaaataatgccacatatctacaactatctgatttttgacaaatctgacaaaagcaatggggaaaggattccctatttaataaatggtgctgggaaaactggctagccatatggagaaagctgaaactggatcccttccttacaccctatacaaaaattaattcaagatggattaaagacttaaatgttagacctacaaccataaaaaccctagaagaaaacccaggcaataccattcaggacataggcatgggcaaggacttcatgactaaaacatcaaaagcaacggcaacaaaagccaaaattgacaaatgagatctcattaaactaaagagcttctgcccagcaaaagaaactaccatcagagtgaacaggcagcctacagaatgggagaaaatttttgcaatctactcatctgacaaagggctaatatccagaatctacaatgaactcaaacaaattcacaagaataaaagaaacaaccccatcagcaagtgggcgaaagatatgaacagacacttctcaaatgaagacatttatgtagccaaaagacacatgaaaaaatgctcatcatcactggccatcagagaaatgcaaatcaaaaccacagtgagataccatctcacaccacttagaatggcaatcattaaaaagtcaggaaacaacaggtgctggagaaataggaacacttttacactgttggtgggactgtaaactagttcaaccattgtggaagtcagtgtggtgattcctcagggatctagaactagaaataccatttgacccagccatcccattactgggtatatacccaaaggattataaatcatgctgctattagacacatgcacacgtatgtttattgtggcactattcacaatagcaaagtcttggaaccaagccaaacatccaacaatgatagactggattaagaaaatgtggcacatatacaccatggaatactatgcagccataaaaatgagttcatgtcctttgtagggacatggatgaagctggaaaccatcattctcagcaaactatcacaaggacaaaaaaccagacactgcatgttctcactcataggtgggaattgaacagtgagaacacatggacacaggaatgggaacatcatacaccagggcctgctgtggggtgaggggagtggagagggatagcattaggagatatacctaatattaaatgacgagttaatgggtgccgcacaccaatatggcacatgtatacatatgtaacaaacctgcaggttgtgcacatgtaccctaaaacttaaagtataataaaaaaataaataaaatattataatgatggtaatattaattgtaataattgtagcttactgagtatttttttgtgagagggatttatagacataattctgttaaactttgaatgatagtcataattacaatgcctaatattattttgaaggcttgtttccaatctcagttccaagaacttttcatgtattatctaattaatattctcaaaagtcctatgatcatacctatagatacagtcattatctgtattttatagttaagtgactaaaggtagcaattacagcctggagagtctcctcacccaccagtgatggccttttaatatgttttatttactactcacctttccttaccatttactaattcttgtttattctcttgtaaattccaatctctggttttaaaatacatcattgtcacataggacatgataagaaaaagttgcatcttttttattcccgcttgcatatgcacatcttctctaataagccacatctgaaggtgtctgctccagtagtacattgtccatggtttcaacgatgccacacagtcataaatacaccacctaaagcataagagacgggaagtgagaaaacagagaaaaaggaaagtaaaggagaagaaacaatagaaaaaaagagaaggaaaagaaatgaaaaatatattaaaaaccatggattttaaaaaaagatatttgtctcatttttacaattaaatgcagatcttccattacaaagcaattatttcattctaagtatgtgaatagatttgtatttttaaaaaaaatcttcatctggttatcctcagaatgaaggaaaagaaacaggacaggatcttttgatatttacttcttcttagaaaacacatactcccttcctaaggatgattgattttagtttcatcacacatcaaggcctgtctcatgcttgccgatattctcttctgaatagttgtgcaaaaaagcattgctttttccccagactttgtccacagaacactgaccccgtgcagttcctacatccagatactgaagcttatttccagctggaccttggccatcaccctttccaggtgctcttgtttgtctcacgtggagtgatttttattggggatggcattgggtaaggaaggctaagacaagttcctaagccactgctatggtggcattgactttctggaacaattgtgcttggattgagtcacaaggtcacaatgcaacaagttactatgtgctcttgggattttaggatgtgtacattgtgagtgtctatctgcctcctgcgtcattgccaaggctgggactagcctcaggatgtcacctatggaagacattctgctataaatgggtgtatggaatgacttgcagtgtgcacagtgtagtacagattatggagataatgatttcatgccttcattcattcactccttccatcgcgttacagagatttcctgagtgattccactgggccagccaagaatacggtcactccagtcatccaccatcaaataagaaagttggatacagaactgatcattataatttattgtaggacataaaaatagatagtacaatcactatagcctactggaaaaatagaggctaatactgagtacctattatgtaccaaatatttttaggcccattaggatttggtatttcatctgatcttcacagcatgtgtatgtggtcagtgttgttatattagttttactgatgaagaaataggctgagaatgtcaaggtaatctgatcaaaatcttacagttataagtaggagagccacaatgcaaacccaagctggccaccagaggcccaagatctttccaaaactgaatctgacttttgtggaggtgcatttctgagtttttctttcagttctcttgtagacttctttgagaagcaactgttgtccgttaacatgacattctctttaagtgtcttgaaacaaatacagttggcaggctttgtaaggccatgggagaaaaataattaaatacaataaattaaatacaatatctgaaatacatatatagtagatgggcctaagagctgactggagatgacaaaagtgtcctcagtgagaatgagacttagactgggagacttagagagaaagagagagagagagaatatgaatgagaatatacactgaaaaaattaacaccctcagtctctcaggggcatgggagacaatagccaaaggtcaattagcattgacacgatctatgtacagatgtaggtgtgtccccagcatttcacatccactaattataattacttcatggatacaaggactaactctgcaaaaacaaatgcctccctgttcccttctcccgccctggcttttgcttattttttgtatacccacctggattgctacacaacttcctaattggcttcttgcctgtaatctttccccctctaatccctttgttgcattgtaggtatagaagtctttctgaaacagttatgagtctgtcacttgtgatagctcttcagttgtcattagaataaagtcttaattctttagagtgatgtttatttatacagccagtatttacggagtgcttactatatttgaggtactgttctgagtgagaaagtagcagtgagtaaaacagcctcttctgcactctcctgcactccaccaagactcctgtacccttctcaagcttacattctaacaggaggagacagataatacacaaaaaataaataaattccactttatggtataagttattaagacaaatagaggaggtagcttgtgagttcagatgggaaggttgtagttttaaatagggtggtcagggtagacctcactgatgtgacagttgaacaaagaatgaggaaaggaaggaatttagctattttgaaacctgggggaagaatataccaggtcaagggaacaaccagtgtaaagattctgagagggttgcttgcctggggtattatgggaatagcaacaaggtcacaatggatgcggcagagtgaaccaaaatgacagttgcagggaacaagttcagagaggtgatagggtctacattattggccacagtaatagtttttactctcagtgaaatggaaaccattggagaataatgagcggaggagtgatgtgatatgacaggttttcaaagaatcattcttactgctgcctactgtgttgctgattgttaactggggagtggaagtagggggagggaagcacagaagtcagaaagaggctattgtagtaagccagctgagtgaggaggatgatggcatggagctggtaaagaatggttagattttggatatattttgaaggtagagccaccttcaaaccttgaccttgaccttcacaccctgatggattaagtgtgaagtgtgcagaaaagagagaggccaaggcttgaggaatgtagcattgctattaatgggtgaaggtggattcaatgttatggagtcagagggaggaaggagtcaagaattactacgttttctgatggtagtaactgatccccaaagttgaccctccattatcttccttcatcttagtaaagagtaccatcatttatatttttattaaagccaaaaaataaaataaaaaattaggattaattcttgactcttcctttcccctctctcctcacatctaatccatcagtaagtcctaagggttccacctccaaaatatgttgccaatccatctctcttttttcttctcttttcttttcttttctttcttccactcctagcactgttgggcaaatcaccgtggcacttttcctctcctggtctatgtaaagtatattttttgtacacagcatatagttgggtcttgcttttcaattttatgatctctgaattttacttgggttgtttagatactttatataaagataaatatgatttgatttacatctttcattttgttttttgttttctgtgatcacttctgtctttccttcctgacttcttttggattaaatgactatttttcaattttaagaattcaattttaagttatctattggcatcttggctttctacacatctttttgcattattttttaatggttgctctagtaattataataaatatcctaaacttttcagcctactttgaatgcatattatgatacttcatgaaaggtataaatacccttcaactgtgtagttctacttaccactcctatcccagctcttcacgctgtagtttgtgtgtgatatctacatatgctataaacccaataatgaaatagttgtcatattgtttgctttaaacaatgtattagtctactcttgactaccataacaaaataccacaggttgggtggcttaaacaacagacatttatttccttacaattttggaggctaaaagtctgtgatcaaggtgctggcaaatgcagtttctggtgagggctctcttcctaacttgtagatggctgccttctgtgacctcacatggccttttctcagtatgtgtatatgaagagaaaacggttgtattccttccttttcttataagaacaccagttatatcagattaaggccccactgtcatgagctgtttaaccttaattacccccgtaagagccatatctctaaatacagtcacatttgggattgaggcttcaatatatgaatttgaggtgaacacagtttagtccatgtcaaagatacataaatgttttaaagaaattctgagaaataaaccatagtcttttgtatttacctacataattactatttttattgcttttcctttctttctgaaaatttgagtttccatgtgatatcttttcccaagcctaaagaacttgtcttagcctccgtctcaaaaaaaaaaaaaaaaaaaaagaacttgtcttagcatgtcttacagtgcaggtcaactggcaaaagacattctctctattttttttcaatgcatttattttatatgctgccttgaaagatatttttgctcactatagaattcttgatttacaggtttttttttccatcagcaccttaaaatgttagtattttctattctgacattattatttcttataagaagtcaaccattatttttgtcattctttccctttatataatatgtcatttttttcctctggctgctttcaaattttctcttaatctttggcttttattacggtatggcgtggtcttctttggattcatctttcttgaatttgtaagttgattcctttcaccaagtttgggaaattttcagcatttaatttttttttgtttgtttcttctccttgctctcttccctcttactgtgactccaattccacatatatggtacctttggctattgtctcccatgcccctgagagactcagggtgttaattttttcaatatatattctcattcatattctctctctctctttctctctctctaagtctcccagtctaagtctcattctcacgaggacacttttgttggtcatctccaatcagctcttaggcccatctactatatatttatttcagatattgtatttaatcaatactattacatttgtattttaatagtttgtttctttgctgtttcctctctgtttaataactatgagaatatttttcttttacatccttaagcattgttaaaatacctactttaaaattcttatcttctaacgcctgtgtcacctcagatttggtgttcactaagtggcttttctcttaagtatggattacattttcctgttcctcaatatgtataatgatttggggtcatattttggacattgtgattgatatattctagagacactgtattatttctgtttctcttttgagtattgattttttggtttagcaggcagtttatttggctgaactcaaacttcaagttttgttactctcctgtgatgaacatgtcctaaaatctctgttgcattattttagccttagctggactacttctggtgttcccatgcacatgtaattgagagatcatccagaaattagggtagcatttataggcacagtgttgcattccctttctatggctctctctttctgacatcccctccacaacttacttcctagctactatggttgccttgaactctaacctctcatttcttaatcagaaagactgtgtatttctatctgagtattagttatcttgcatgccactgactggggtccacccatgggcaaaaatgtataaaatcaggaaacacacaaagtactgttttttccttccttgtgtctactcctctccagtttctacctggttttggccactttccagtgtcttcagagaactatttgctgtattttgatcagcatttttaattgttatcaaaatgtgtctcatcattcattcattagagatgtcagcattgctctaggcactgaggagtggaaaataatgatgctcttgctttgaaagagctcagagtatagggtaagagacagacatataactaaggattgtaaaagaacttgatagatgctacagtagagtaaggatagaaaatatctgtgccttatattcccattgccaacctgtgatctttgtctgcatttcctattctccatgcctggtcatctccctgtcctttatacattaccaaatttttcttaacttttcatcatttttctctccaaatcaaaataatttttatggcctttgatctaataaaagtataaactcttatgacattcaagacacactgtctgccttcgccctctttattcatccttattttcaccagtttactaattctgtaatttaacctacagtaatcctatgaccaatgtatgcacaacacaaatagatacaaatgcaaagtgtggtaagtgccaccaaggagaagtacatggtgctatctgtgtttttcctgtggttcactcatcccacatttattccacaaacttttattaaccacccatgttatgccaggcatgaggctaaaccagtccgttaccattcaaatcatatatgtctttccattttcatgtctctactaaccagcctcctttctgtcatgccttgcctctagccctttactcctccaaactctacctatttatggcctctcagctgaagcttcacctactccaactgtataatgattgccaaatgattgatctctcactttgtgctgctatgcatcataactatttcttatttttcagtgtatctccggaacctaggtgcacagttcctggaggcacattaggcatttagtaaatactaaataactgcattcatgcttacaccacacatgctaggttctagctcactcctggaagctcatttaaatctctcttctctgaactcctaaagcacttcccataaaaattagcatcaaatcaagtaatgcctctaattatccattactgttcccagcgagtttatcttgatgctctcagtggattgcaaactcaggggatccaaagtgtgatgaggatatgcttcatcacagtaatgcaaagttgaacctgaaggagataaatattcaataactgcatgagtttttttttttcattgaaatgaccaatgtctttgatatcattttgaaacatttccacaaaaactgcaccaatggtattcaacaacgtatacctggaagttcagtagacaatatgacgtggtggttaagaacaaggtcttaaaatatagagactgcagtttgagacctagatttgtcgttactttactgtgaccttgggcaagatattcaatctctttgagctcagtttcctcatctccataatgaagaatagtatcttctccataggagtgctataaggaataaatgaaatagagtaatgtgtgtacaatgcttaagttagtactgatgtatgggaaatgagtcagtatatttcacgtgatatcatttatactactgttggcactatagtagtgtattagtccgttttcatactgctgatacggacatacctgagactgggtaatttatacagaaaaagaggtgtaatggacccatagttccacatggctggggaggcgtcacaatcatagcagaaggcgaaaggcatgtctaacatggcggcaggcaagagggaatgagagccaagtaaaacaggaaaccccttatgaaaccatcaaatctcatgagacttattcactactacgaaacagtatgggggaaactgcgcccatgattcagttgtttcccactgggtccctcccacaacatgtgagatttatgggagttacaattcaagatgagattttggtggggacacagacaaaccatatcaagcagacacacttaacttcctagaaatcctgtttaaaaggaggccatggaagttcaaaacagtttagtgacttgcacaaagtcactcagctagtgagactcagagccagaacccaaccctggcctctgtgtctcctgaacaaattatcttctttacacagccctagctctcaggaaacatgctcagagagcctatccctgtgcagccaaaagaccaaatcttttccttgttggaatgaaaataaatctatcagaatggttgttttagcatcctagaaactcaagtaaacattcagaaaatatacagatgaggttcaggaactcaagcacggtgttgcttgggtgtgttatggcaagcagagtaaatgcatggagaaacatttctgtccctgatacatatttcatactattttgtttagagccaccaagtggattaaggaataagatcctagacctgggatttcaaatgagaggtgattatctgcagagctcagacatttctgtccttggagagctgtgtttcccatgtgatgattgttcagtcaggagagtttctcctgacaggtctggggcatctcaattttttttaactgagagtttcaaaaaatttttttaatgagggttttttcaaaaaccctcatcatagtctctttcattcagcttctccattagtaagacacagtgagtaattcaaggtttgacattgcccagggatgacagcctagatcaagaaggggaaatgatgtgatccagaaaaggttggtgcttttaacactcagaccccccccatttgacataagttacccttccttctcattcttgggcctgttgctaacctgcttctaccagtttagccttggaaatttcatttctgtttactcttctctctaaacttctttgttttatgtatttaagaggctagcagtaggttaaatcaaagctaaatttcttttagctgaggcactcttgctacattggcattttaatgttcttggaacccgtatggacaaagagttgaaagaaacatatactcattttaatataaatttttctatcttatacataaattaaagaagctataaaattgacccatgtctcttatttttcagatagaccacatggtacaaggccatgctgcttttccagaactacaagtaaaggccacagccaggtaactgctgtctctgttccctctaaaattttccttgtgtgactgtattgagagaattcacgttgggcagttgggtgattttcagatcctacagacaatgaaaatgcctgttagtgcttgaaagatagtcacctggatgatccagaagatagatgtattaattctttaaatgaggtaagagaacttagagaacctagagataccccaagaatatacccagggactatagataagaaactctgatgtagaagaaggaccatggattctggagtcaaaacttcttagtttcacatcccagccatactccttaatagatacaggaccttgagctagttacttaacctctttatgcctgtctcttcatctgtaaaactgaagataataactgatatggagtgatttctagaatattttgaagcaagctgagtgcaaaaaaaatttacgatatactccctttcatgtaaaaagaaagacataggaaaatacatgtgtatctgttcatttttgcaaaagaaatataggaagtggccaggtgcggtggctcactcctgtaaccccagcaccttgggaggccgaggcgggcagatcacgagttcagagatcgagaccagcctggccaacatggtgaaaccccatctctactaaaaatacaaaagttagccgggcatggtgatgtatgcctataatcccagttacttgggaggttgaggcaggagaattgctcaaacccgggaggtggaggttgcagtgagcagagatcgtgccactgcactccagcctgggcaataaagtgagactccgtctcaaaaaaaaaaaagaaatacaggaagtttaaaccagaaaataataagattagttacctacagggggtgggtaggaatggggtggaaagaatgtgggaatgggaccatggtagtaggaagaaatgacacttctctgagtatacctttttatataactataactcttagaattattgtcatgcctcatgtccctgataccccgataaaataggtgatagataaccaggatatatgtgtatgttggcatgggcaaaatgaaatgcacacagtaaaaactgaacctactgtattacaaagggggttgggaaaagaaaagaaaggaaaagaaaaaagaaaagaacctaagtaaatttgggaaagaatattttgactatatgccatatggctaaagagaaaaataaccatacataaatattatactctaattggtaaatctgtttttcataggtgtatatgttagctatagtgacaactctttatgtgtatgctacagttgagtgaagaaatcaatatattgtggataataagagccaggttcctcacaaatgggaaaaggagaaggttagaatgaacctcatggtgtcaatatcaacttatgattttatatatatatatatatatatatatatatatatatacacacacacacacacacacagctggatataaatataagtaaatatagatatgtatattcatgcatgaatatacatgcatatactccctaggtctctctgctgagatggcttggaagcaatgacacgatagtagcaatgtgtgtacctagctcacaggtactgtattctaagtaccattctcccatttctccaataaaagtaatcaggacttcttagaaagatggctgagtctacgctgcggcagtaaaattatggtgccagaaagaaaaaagttactcaacaaggaattgtcaaggtacattggaaccaactttaagaatctctcagtggcctactcaggataaaataaacagtaatagcgtaaagtaagtccataagtaaataactttgtaagtaaactactgaagaaggaaataaacgaggacgaaatgacaggtcttcctcttcactgtcaggacagtagccttacaattaataaatgtagaagaaataatggaaatagataatcaacattaggtaaacactacagagataaatgttgtaggcaagaatcattaatggatgctaaaattagtgagtaaaagtgggaagcaggatattttcataaacccagaggatttcagtacaagatactgagtaataggaagaggaaaataataactttccagtagtatataagtatggcagacaccaccttacccaagtgatgaaagtaaacaacaccagcaataacatgtagtgatatcatgtatctccttttatgaggcaccgataaagatacaacatcatttctgccatgttcttgcccaaaatgattaaactcagtgtaaatatgggaagcatcagacaaacctagattgacattccacaaagctattagccagtttgctccaaaggaaaattaagaaacttaaatactgaagaactgtcctagattggaggagacttaaggaggtactacagctgtaagcagtatataatcatggattcaactctggaccagagaaaggacattggtggaggaaaactgttgaaattcaaatagagattaatagtattgttatttatggcaatttcttaggtgatgagtaaaagggaactctgtgtattatttttgtaacttttgtgtaaatctaaaattattttgaaataaaaagtctaaaaaataatgaatggattttcatgctgataatgcttagttgtcaggctgtttaagtaaagtaagatatttttatagaattatcagagaaacccatgtagctagctagcacaggacaaaagagagatagtctaaggtggccactaatagactctgaagccaaattgcctttgcctcagctttgtcgcttattcactttctgtttctgggctatttacttaacctctgtgccttagtacctcactgtaaagggaataatagtaaacatttcataaggttgttgagaaaattaaatgaattagaataatgggtgatacagagtgatgattaagagtcaggctgtaataggtgttcaactaaaaaaatggtaatgataaaaattactgttggggaacatcacacaccgaggcctgtcgtgggatggggggataggggagggatagcattaggagaaatacctaatgtaaatgacgagttaacgggtgcagcaaaccaacatggcacatgtatacatatgtaacaaacctgtacattgtgtacatgtaccctggaacttaaataaaaaatgaataaataataaataaataaataaatgattgttgtagttagtatattagacatttccattctactaagtgacttacattctaataggatcagcacacctacacagagcagaataaatgaatactgtagtaaaatatacgtagtgtgttatcaggctgtgtagaaaaggaggactgattttgacaaggagtttaagaaaagcttcataggcattcccttctaggagtctttagttataatgccattgcaattagtcattaattacaattaccattgagagggattatgtcacataaccttaccaactagcatattagtggcatagagaccatataacctagaaaagggattcctaatttcggatcatcaatgaacctctttaaattgtgtactgttctgctgattacataattctgcatgtatttctgtgaagggaccataacggtcattattttcttaaagggtttaagcatttataaaccactaagccaaagaaaagagcactaaatttatagtctggagacctgaatccaaatctcagctccaacatgtatcattgtgtgaaacccattttcttcattataacataggatagtaatggagaatcaacccgaaacacctctaaggatttattttgagtttagaagaggtaatatatttgacggggccttgtaaactgaattgtgacaataatgatgatcactactactctgttagtccattcttgcactgctgtgaagaaatacctgagactgggtaatttataaaggaaagaggtttaattgacttacagttctgtgggctgggcaggcatcaggaaacttacagtcatggtggaaggggaaacaaacacatccttcttcacatggtggcaagagagagaagtgctgagcaaaaggaggaaaagccccttataaaaccatcagatctcatgagaagtcactatcacaagaacagcatgagggtaaccacacccataattcaattacctccaaccaggtccctcccacaacacatgaggattatgggaactaaaattcaagatgagatttggtagggacacagccaaaccatatcaactactactattactactaatgattgtaagaggaggaagtttggtggtggttgctatgggttcaagcagcatacgtcagtcattcataccttgcctgccttcttatggaaagcatggaggaacagcaaggacagggactgtgaattagagtccttgagttcttgtacctgttctgccctgaatgtctcaatgactactagattcttcatccataaattacaataatgataccctacttacttcattttacaggcattaataggatgaaagcaggtcacaggaatgtctgtatatgaacattttagtgtgtaacacaaacttactgaatatttagttttgcaatgacatactctaaacttccagaactttcttctatagataaacttcatttgagtagcttctgttgcaaatcataataaaaagaagaaagaatttatggattaccatgcaaactcagagaaacaacagtatcgggtggttcagaagcagcaacttacagaactcagtgatggagtcagaactggatttaaatcccacctcttttcacataacttcaaacccacttccagctactttcctgtatttctccttctgtttagagtggagtttctccaaagcatcgcctgtactcttggtctctacttctccacttcctactccttccttgcccactgcagtttgaattctgtcaccatcagccccctgaaacgtttcatattaaggttatcagtgacctctattttgctaagtccataggatgttttttattcccctttctttagttctcagcagcatggggcatcagtgatcactttttcctccttttaacattctctttccttgactttctggaatgtcaccctgtctgttttctccctatatctctgattcctccttcctaaccacttttcttgagtttatagtccttttcttgaccattaacattaatttttgtcacagctagcttcctggccctcttctctctttgccatctcttccaagatgatctcagctatgctcttgacttcatttctgtctatattttgatgactcttttatgtccagcccagatacttagtaggtattcagtaaatgttagttcggtttccttccacttttcttttattgtcttacaaaggaaagtgcatctgtgtcttattagatctatgagtacaatattctaaaactatgggaccctttatgcttccggtcttagaaagaaacaggcatagctgtttttgaaatgaagttagctgtttggaagagtggacaaatccttctgaatcaagaaccatgtgtctcttttactatgacttggggctttctgaaaacagcaatgcaggtcacccctatctcagagcttagggtcagcaaatcctgtttgaaactgtggaaacaagtgttgataaacagattgagtattttatactcttgatttacaataatcctcttaggccccatctctgaagagaagtgttttgcaagcttataaattaagtaaacaagaactggatgtgcccgtacatgtaactggtaaccaaagtttctcttcatgtggggccaaatttgcagatatttcactctttagcagagatcaccttatgtcaatcataaattttgactcttttcctctaaacttgattctcttagaggttcttaactaacagtgtctctgaattaggttctggtgacaacagggtttagtgagaacattttggcataatccacaagtgctagattcaaggttggcagcaaagcaaaacttaaaatccagggtctgtggcccatctgtctgatgagtatcttttgagcatttgtgatacatgaatgaaccaagcaaacaaagtctttgctttcataaaaatatacacacacatacatatataaacatgcagtacatacatgcaaatatgcatactatatacatatacacatatgcatatatacagatatagccagccattgataaatgctctaaggaaaattgtagataaataaggagatatagagcattggtttcaaagcccttaatgttgtctttgttgtgctagtgcatatttttttcctcagcctttcttttttcctactttccctgaatttttctgttattcctctgaggacagctaatttttcttgatctgatttattcctcaaacttcttttgcttttgtaattcccataatcccactaaatatcaatttcttaaaattcactagtcctctatatcgcgaatcgcagatagattaaaacttcccattaaaggctgtacaaatccccctcaagcaaagaaagggaaaaaaaggacaataacatttattaagaatctgcagtatgtttggcactgtgcttagtgataatagtttcacgtatattatctcatttaattctagatgaggaaatgaggattattgggagctctcaaacttcacttctaaaaatttttctctctttccattctgctcttttgtattgagagtccccttttagcctttatgactttttaaaccttggaccgtcattctgataactggggtgttgagtctatcactgaatatttacttagccttccctgagctaggacagtcagtgtgataatattaacacctttcattcccccatggtatacaaagataatcagtaaattcttgatggctctgagttcagaaagatttcttacagaaattagctggatattattatacatttctttttttttttttttttctttttttttgagacggagtctcgcactttcacccaggctggagtgcagtggcactatctcagctcactgcaagctctgcctcccgggttcacaccattctcctgcctcagcctcctgagtagctgggactacaggcgcctgccaccgcgcccggctaattttttgtatttttagtagagacggggtttcaccgtgttagccaggatggtctcgatctcctgacctcgtggtctgcccgcctcggcctcccaaagtgctgagattacaggtgtgagccactgcgcccgacctattatacgtttctttggtttctgttttgcatgcaaataaaagaaagtgctcagggcattggggtcttctctagaagaccaagggtctgtgctgatttaggacataaatcctcttattttctacctcccaactggttaccagtagctcagcacagtgcctggtggcataggggcatgtgtagggaagtcataagatgcctgttcctttgccctgtccccatcttctgtatattccagcatgtctggaaggctgtgtccatctgaagggttttagatggtgtgggagtaataatcaaggttgcattgtagaagaaccaatcaggaaagagtacagaaagcctgattggacattcttagttgagttgtctttggacatctaagaggaggcatttgaagagtggttggatacttgacctggaactcataagaaagaaatggacaggagttaaggtcatatatttggaagtcctcagcactagatggtaactggagcaatgagaagaggttaggatcatccaagaggagataaagagtaagaaaatggtgaaagacagtagatctctggaagacgtcatatgtttaatgaacaagtgaagaaggagaaacagccaaagaggagggaggaaaatcaagagagaatagtgtttcagaaacaagagaacaaatgaggaaggagtggtcaaatgatgtaaaatgcccaaaatgattcatcggcattaacaacaaagagggtattgttcctcatggtagtaccagtttcagtagaatggagcaggcagaatgcatagtgtattgggttaagaagtaaggaactaggccggttgcagtggctcacacctataatcccagcactttgagaggctgagacgggcggatcacgaggtcaggagatcaagaccatcctggccaacatagtgaaaccccatctctactaaaaatacaaaaaatttagctgggcatggtggcacacgcctgtagtcccagctactcgggaggctgaggcaggagaatcacttgaacccaggaggcagaggttgcagtgagctgagatcacaccactgcactccagcctagtgacagagcaagactctgtctggaaaaaaagaaaaagaaaaagtaaggaactagagacaggcaatatggaagcttcttttctaagactttctcttgttggtagaaaaggcacaagtatattttgttataccatgtattctgattttttggtttaagagtatgaccaccatactctctgggcagcctgtgaacccatagaattaggtgatttatggagagggagaggacatgagagatttcagggatgttgtctgcatttaagatcacaagcaataggtccgaaaaaaaaaatcttctttgattcttggatttttaaaaaactagaaatgagtttcttatgatggcaaagaagaggaaactatttattgataaacctgtcattttatagtgctcagggctctatgtttaatcttcatagcagcctttaagtagacagtattagccccaatagcaaaaaagcaaataggctcagagagggtttgcctacctgatcatccagctggtacgtggtaaagtcactttatgattattgaaactatattttcttcatgatacccagtgggatgtggacagcaaaagtttctccttttgagacaggatatatcaacctggggttcatgagagagagggtgagcgatccacttgggatcacagttaatatgtgattccctagctagaagaaggcaggctgccatttgagaaggaactgataaaacatgcaaaatgacacaaagtcagaaccaaaaaaggcatcatgcaaggttaaaattatgtgaataatgatgtgtattagttagtttaatgtcttccaagtgcatttcattttgaatgatatactcagatagcacacatggtaaggtataattgaaaaaacatgtaggagaatggctgcattcaaagaataaacatacagctgcaaggaggttaggagtcaaaggggtaagcatatgccccatccctcagggatctcattagtgcatgagtggccatatatgtagaggctaaatgaatctcactgtttgcaaagacctgcagtaaatgagacaatgacgaatcaataataattaggcctatacgttcttattgacccagatgtctgaaaccaaatgccctgctcagagattccttgagaggcagaatgaaaagatttatagacatgcgtttccaaaaaaaaaaaaaaaaatccctttactttaagaacagtggctattctgaagtggaaagtcgcaagaattagtgcagactcttgacttctggctagaaaagatgttctcaaggcttttcttgtgaatgtgattcctgttggaccaggagcagagagagcaaagagatggaaaaccaggaggttatcatattcgtgttcgctgatacgttgttctggctgtaccttgtatggaggcttcagaggatcctttcctgaagccataatagaatcattctaaaacagggtttgtgtttttagggctttgataaataatttctgacctaagatacagaaagtccatggcttcagaatcacaaggagaagggtttaaagctggactcagacctgtctcttcacctcttgaagcatctcctctgtatgttagtggtacctccccaactgggcagtgttggaaggtctggtgtacatttagggaatggcaactggtgttaactgtagttgttaagccttttcccagtaatatcttattcctcctaataagatctaaggaagaagatttttgcagatgagaatgagctattacagcaagaagcaaataaactgctggtaggtagggcggttgggctgccctcacctccaccctagtacacatcacacgcactcacacacacacacatatacatgcattcacatttacacactcactcatgctcacacagagcagctttgcttttctatatttttacattgaatatttacatacaatttttgtttaataaaggagttctactggacgggtgtggtggctcaagcctgtaatcccagcactttgggaggccgaggtgggcagatcacgaggtcaggagattgagaccatcctggctaacacggtgaagccccgtctatactaaaaatacaaaaaaaattagccaggcgtggtggcggacgcctgtggtcccagctactcgggaggctgaggcaggagaatggcgtgaacccgggaggcggagcttgcagtgagccgagatcgcgtcactgcactccagcttggtgacagagcaagattccatctcaaagaaaaaaataaaataaaataaaaaataagtaaaggagttctactggtaaatggggaaaaaaagagaatttaaaaatcaatgctctactcattggtttgtttccctacaccaagtacaggaaacttttggcaacttcatgggatccatgggatcactcacccaatcacaaactagaactagaaatcactgagccttccttctaaaacacttttaaaatgcaaagcataaataatgccttaggtatcttagatattaacctcctttggatattgatttcctatacttttttttctgccattatacaagccatgtttttaacctttaaagagacttccaaggaccccagtgggaagtagcacagatgccaactactgcaatatccactttcttttgaaatcattggttcagaacttttagaaagcagcatcttttaagaggggaaggttgaccagctttcatctttgtgtcatgtggtgtgatttaacccggtgaggtaggtgttattaaacctattttatgagtgggaaaattggaggtcagaggttaagtcactggcccattttaccgagctaggagaggtagtatcaagatttgaactgagtagtgctctcatgcccatcatcttctctccacctcctcttcacctgaacatgtaaagaatgaaggagttggtttgactccctcattctacacatgaagaaactgagacttaaaaaggagaaaaaaaaccaggcgaggtggctcacacctgtaatcctagcactttgggaggccgagatgtgtggatcacctgaggtcaggggtttgagaccagcctggctaacatggtgaaaccccgtctctactaaaaatacaaaaattagctgggtggggaggctgaggcaggagaatcgcttgaatctgggaggcggaggttgtagtgagccgagattgcaccattgcactcccacctgggcaacaagactgaaactccatctcaaaaaaagaaaaagaaaaaacgtacacaatgtcatctggtgggtttaggttgaaaatcaggtctctaactcctgatcctaactgcatttatgacattcagtcactttacttagcaaaatcctatcctgagtctgggaacttataatttctctccatttatcaactcatcatcattattacaattaggaatactgattttaataaattattgacatatgaccagtactgtacagtttacaaaatactgcgccttcacatacataatcttctttgatcttcacaataaccctatgaggtaagttggacagggattatgatatctgtttttacagatgagaagagggtggttcagaaagtttgaataactttctcatggccatacatctactaagagtaaagccattcctggatccagtcttctgactccaaacctttctactaggatgtggcacctttcttggtgatagtacagtgtgatttgagagtacagtgggctagcttctctgaagcttttaggagcctgcttactttcctggatctggaagtacaaatggtttctttctatagaatgatttgctccctgaccctatcccccctttaaaaataaaattcacttctcttccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtaagtaacagctagtccttgcacatgggtgaaggcaggccaaagggctacaaagtttggaagaagcaaagtgaggaaaaaggaaaagaaaaaaataaaacaggccaacagccctctggctttgtgcagatgcattgctgttgctgctccctgggatgagctgctgaaagttttcattgtttctgagccaaccttgaaagcgttaaaagcagcatttcctagttcagctactgctgcctctttgtcctgtggagtggctaaaagtcatgcctatgtaattttggcatttatatcagtttgtaaagtcaaattttccagctgcatctttaggttgcccagtaaatcagtagtaaatattaccacccatggtcttgctggccacagccacacatctgcctaggctctgagtcagggctgttcagattctacactaatatagttaggatttcagattaaactttggtataagtaaatgtaatttataacttatgttggaaaataaatcctgctcttagtgccctttagggtcacttcctctgtggatattctaggctctcctagaggggccagatgaacttggtgggagaactctcaaccaccccagttgagatataaaagtaataacatcttagacaccaggagaatcatgtttgaggtgtgatgaagcaggttaaaggtagaggaggggccaggtgaggccacaaataagaaaataagccatgaatgcaggaaccaggaaaatgtcatgaagctgagaaggtgagtgtgaggtacattaaggcagagttcagaatggaggctgtaaacaaggcaaggcttatgcaaaggaagccgcgtaacagtggagcaggcctgatggagtcaagaattcaagactcaaactactacaattttgtggttagttttattgagattgttttaaatatttttatgatgccagcaggaagacctgaaatttattttcattacctagttgacatgatcaacttctattactaaaagggagtcatggtgaaaagaaaagaaaattagacatgacaaaggttatgttgatctggagtccatgaagcatgcctacacaacaaatcatgagcttggtgtccttttttatagaggcagaagaataatgtccagagagggccatgtggcaacagaccgcaactagaaagtcatactttcagataaccaactctctctgtaaacagggggtaggggaagaacacatttcatatgggtacagaaataagtgtcttaattagagacaaatatctgaagccaaatagagctagatatttaaaatgttgaagcagttaagaagcttgaccagtgttttaaatgaccccaaaacaaagcagtgttgcatagtaaaatggtcattgctctggaggtcatttgttgctttagataaaactgacctaggagccttccctagccaatgtctgtcatacccaaattcagtacccagcatgtcaggcttcatgtctcccagtagcttttatccattttttaaaaccaatcctgacatccaagacctaagaattatcatcagaaggatattctaatacagttgacccaaatgcagaatgaaattccaaagaaatcaatggagtgttctgaagaattctcatatcatgagaataagtatgtatgcaccaaaaggaacttcttacatggggacatatgcccagttgtatctaaaaatcctgggtatgtttacttttttaaaaagttgtatgtttgttcacatacctcatatatcacttggtagttcttggcaatgattccctttataactgtccttgggttaggctgcaatggaacagttatcactccatgaatttgcatcacaacactggaaggagaagatgacctaaataagatagaaggaaagcaattctgagctaaacacttcaccccaaatctccttccttcagtccagttttggaaaacatcaaaataatgaccctgaaattcttctgttatgttatatccttttgctggaaactacgatgatgcctatctccagcactcattcagcaaatattaattgggttcctattgtatgccaggcactgccgtagatatgagtaagatgcaacaatacctaccttcatggagtatgtttaaagttgggagtgggcgagtgcttgaaaaaatgttaataggaactagcaggataattccaataaagcaagatccatgtacaatttcttcttttggcccctaaaacgtttccctggacacagagtaagtgctcagtatatgcttatttataatttataggcaacatagagataataaagaggtcatttgttgccttagataaaacaaacatatgaagaatttaataataccaaatgaattaagtggctactgacactgactatccatatcgtaagtatttaataccaatattaatttccaagtaaatgaagataaactccaattgtatcataattatgagactgtttattcatcaaacaaatacaggccctgttacagttgttgggggatataagagtagctagacacaatcccagccctcaggaatatcaccatctttgggaggcagacaaaatatataaacagggaatggaaagatagtattaagctccagatgtccttcactgtccagagctctccagatgcatggaagacgattgcccaacctggtcccagcggtcaggaaagctccagacaggaagtaacattgacactgagtgaagctgggaagggggtttgaggccaagggaatcatagtatgtgcagtattctagagggaagagagcatggcatgtgaatgtctacaattttggctccttgtatcattgtctaaccaatgatagattgcctttagcattttatcttaataataaaaaaagaaaattttctcggatttctcagagaaccactggatatctgtatattccggctttggcagcgttgcactctcccagttctctactctcccctcaggtgactcttttcttgcattgttaaacatttacccattcactgtgtttttattgaatacctgctatgtgcaggcctgtgctaaacccaggtaatacaaagaaaacagaaaagtacctatcctaagttcacataaaagtaggggaggtaattattgtacatgtgtgtatgtgtgtgtatataatcattttacagtgtgatctctgtaataatcagtgcaagctgaaggagatgctcaatacatgtctgactttgaaattgtttttatgtggcattgggctagcaaaccctgatgcagcctttttctgcttctcttgaaaatatttgtaaaaatgcaaaaaagtcatgaattcatgcaggccttaggaattaggatggtgttcaactaggaaaactagaattggtattcccaattatatgatgaatgcaacttgtttgataacatcatatatgacataagaacaaagtcatgtgtgatccactgtggaaacagtttggacctcgccaccttctgctcccttgcataaaagcacaaggttcttttaaacctgaaaacagcatagctattcctctactttactgctaatggttgggttttttgttttctttttggaaagcagccagtgagtttaaattcctagatccccccacaaccctgttcccagccactctttcagttcattccatttgaaaactgccagctcaagaatccacccaagcaggaagtgtgaattaggaggaagggtgatggcttgcattctaagcatctgttaatggggcagatgtaggaaaggccttagtagttctgtaaacttgggaggaagggtgtagtttgcactactagttctaggctcggaaagccaggcagtgctgatctacctcagtccaacaaagctacagaaaataaaaactgctgtactctgccaactggcatttagctgtagatctgaagagacaaatttaagtatacagtgagtggggataagagcaaatcacggctgtgtgcggtggctcacgcctgtaatcccagcactttgggaggccgagccagttggatcatgaggtcaggggttcgagaccagcctgaccaacatggtgaaaccccgtttctactaaaaatacaaaaattagctgggcgtggtggtggacgcctgtaatcccagctactcaggaggctgaggcaggagaattgcttgaacctggtaggcggaggttgcagtgagctgagattgtgccactgcactccagcctgggtgacaagagcgagactccgtctcaaaaaaaaaaaaaaaaaaagagcaaatcatgtgtactgtatgctgggaaatactgaacatgtgtacctgtctagttagcgtaaatgttgaaaaataatggccccttagaaaaaccattacatacggctggacgcggtggctcacacctgtaatcccaacactttgggaggccgaagcggatggatcacgaggtcaggagatcgagaccatcctggctaacatggtgaaaccctgtctctacttaaaaaagtacaaaaaaattagccgggcatggtggcgggtggctgtagtcccagctactcgggaggctgaggcaggagaatggcgagaacctggggggtggagcttgcagtgagccaagatcacgccactgcactctagcctgggtgacagagtgagactccatctcaaaaaaaaaaaaaaaaagaaaaaccattacatacaaagaaaaaaataccattgtgaacacttaaaggaaagccctcttgaaaattatttactactgaaaccaaaagaaaatgttagagaactttgtggtatattcaatggaatatttttaatttttttttaagagacaggatcttgctctttgtcactcagactggaatgcagtggtgcagtggcctaatcagaacccactgtaaccttgaacttctgagctcaagcagtccttccatctcagcctcccaagtagctaagactacacaggcacatgtcagcatgcccagctaatttttaaaatatttttttgtagagatggggtctcactctgttgccaaggctggtctcaaactgctggcctcaagccgtcttcccacttcagtctcccaaagtgttgagattataggcatgaaacactgttcccagccagaaattttgtttcaaggcatatctctatgaaataggccagaaacttattaggaaagaacaagttaagatgaaaggacaatggaatgagaaaaagggggaaatggcaaagaccacaagacaactaaaaatgcaatcaaagaattaaaacctacattgaaagcaatagggagtataattttcactgaagaaaataagatcaaggctgtcataagacataacatatgttttaaatttactctataggaaaaacattttgaggataggagcaatggcttatttactttttaaaatatcaacagttcttaggtcagaagctggcaccaaataattgccttatggtcaaacagttatttcaatcactgtttgccaaatgaggaatgaacagtgacctgcccaaagtcacaaagccaagaagtggcagcgcttgccttttaggatgcaaactctggactttgcaaaacgcatggaggactattaagaaagggagtttaaacatgcattatacatggtttcatagtgaaccatgttccttaagctagtccttggctcttctgttcttctgaccaccaaccttgtggcttgtcctcccacttttaccctaaccatggtctttggatttaaactctgaccctgtctcttctcagtaaggtactagtttccttcccaccctaactgactcagatttaaaaaaaaatagccactcgtggtttgacctggttctaatgccttccacactaggtgcctaccttggtaagtaggaacaggacataacccaggaatctcttccttatgcttgatagtatcattttctttttgttctggtaacagttgactcctatcatgtgactagctgtttcatttttcttttgatgatacaatatcagcctgaagcactggactaaagagaggtggaggaggtgggggatgagcagcctaatagcatggctggactaggtaccccactatgtaaacatttctcctttccagttgataaatgaagcacagaaaggtgagggctacacatacgattatttaaaagaagcagaatcttaagtaataacagtcggtctcaaaacagtaagcgctgatgattttaggttcattaaaaacaagacagacacgcccccccccacccaaagaaaaatgcttacttttaaagtaagaaaatgacatggtcacacataaaggtagatgaatataggccgggtgcggtggctcacgcctgtaatcccagcactttgggaggccgaggcgggtggatcacgaggtcaagagattgagaccatcctggccaacatggtgaaaccccgtctctactaaaaatacaaaaaattggctgtgcgtggtggcacacacctatggtcccagctactcaggaggctgaggcaggagagtcgcttgaacccaggaggcagaggttgccgtgggctgagatcacgccactgcattccagcctggcaagacagcgaggctccatctcaaaaaaaaaaaaagatagatgaagataaatactcaccatcaggaatagttgcatgttttagggatttttttggtggttatttttattttaaatgttttgttgaatggtttttaccactgcaaagcagtaaagagggcccaggttttgaaatcggacttatgtttgaacttgtcttgaagatataccagtgtatgacctttggcgggttaactctgtgcagctgatctgctcatgaggaagcaggagtggcccaggcttctttgcagggtcactgtcagcgccagacagtaggtgttggcacgatggacagacagcacaacaatgcccttgaattggcagctcctgcttggtggcctttacttgcatctttacgagatggccagtaggatcctgtgtggcttttgaaccctgagcagccagccgtgggcctcccactttagccccagaactgactggactcaccagcccaaacaaccagccagagaagcccaccagtcccttggtcctcacagaaagcaagtttcatacagctcttgagattgatcttctttgttcaagtccttggccctcagtttcctcatcaatacaacaggaaactcaaatgtggtgtaccttatggaatagctagcattgtaggaattttcaaagagtccttgccgtctggtatatatgagcagtttctattcacaaaaaattggcgtggcctttgttttgtggtgtttgggatttttaaaaattattttcctgaaataaccactcaaccactcaacaaagcaatgaccttggagacatatcaggccctgaaaacacaccaaatgcaccctattcatcattggttgaaacatgttttctctgcttcatgttaaaagtacagaactacccagaacaaaaagtgattttctgcttctttgaagagctgtgacttctaacatcagagcgtatgctactcaaactgctggagaggttgaatgctgctccaacaactcttcaaagcaaacacagagatagtgtgtatgtgggagaccaggagagagtcagggaggaagcactgggagatcttagccagtttccaagggactgaatcccagctagctgtaggcatcactaaacagatccagatgtggaaggagtcagcaactcagggtatctgcaagagctcaatagagagcagaggttgcacccctgtggcttttccgatagggagatggatgatagagctggaagctcatgagctaattgaagtagctttcaaatgatgtatttataagctttggaaacacatggtctctttgatatgagtttgtggatgtttttgctgttatttaacactgatttattcggactttttttttacatatttttgcttatgaaaaatcaaatcctataacaaagcttaatatcctcagtgtctttacctggttttctgattatatatatataatcacaataccaaattggtgttttccaaattggtcacaaattttactgaatatatatatatgttttactgaaaatacatattttttatttgtatatttatatataaatttacatatttatattttatttaaaatatgtattttactgaaaaaatatatatattttactgaagtgactaattcgccagctggtattgtgatttttaataggtaccatttttcaggcacctgatgcaccaggcaccatggtagatgctttccatgtatcatcaacaaccttcacaacaaccgtgcaagacaatgttgttgtcccatttaaaagaagagagaaaccgaggctcaaggagtttaagtagcttactcagaggagaaaagggtataagtggaacgggaaccagtcaattcaaacctgggtcaatgacattctttggggaaaaagaaaaataaaaaactagatctttgtcattactgttgttttcattgcttctgctttgtttttaatgtgcctggcatctttctttttcattttaatgactttttaaattctatcacagaatcagactttcctttcttactgctcctttatctttcctatatacactaaacaacaagtaaaaccagggaatggactatgggcaggagtgtttcccaaggtcatgtggcatgataaaagactgaggggcgaatcaggtggaatctactgggaaggtccaagacataaacaatgcaaaggaactaaggccagaggaccaaggatagagtccattgtgtataatcttggtgtgcagacccaagacagggttagacaacagcaagtatgggccagaagagttgtacagaccagcttcgagaaacagtatatgagcatatcaaaatggcttagacttaaaccctcagaagcaaggcaaacaaggtgtgaagggcctttgggtaaacagcaaacaaagtagtgttgtgtggtgtagaattcaccaatagagtaaggtcatgaggggcagtgtccatccatcatttttgcttgctataataaattacacaaatctagtggcttaaatttattctcttacagttcttcaggtcagaaatctaggttggttctactggttcctccgtaaccaaagaaagtgttcacaaggccaaaatcaaaggttttattggaaggttctgggaaaaatctgcttccacactcattcaagtggttgacctaatttagtcccatgcagttgtagggctgaggtccctgtttccatgttaaaggtcagccagtgatccttctcagctttcagaggcctccggcattcctgggcccaccacccctgccaccatcttttttttttttttttttttttatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatcgagtctatcattgttggacatttgggttggttccaagtctttgctattgtgaatagtgccgcaataaacatatgtgtgcatgtgtctttataacagcatgatttatagtcatttgggtatatacccagtaatgggatggctgggtcaaatggtatttctagttctagatccctgaggaatcgccacactgacttccacaatgtttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttggttgagttcattgtagattctggatattagccctttgtcagatgagtaggttgcgaaaattttcacccattttgtaggttgcctgttcagtctgatggtagtttcttttgctgtgcagaagctctttagtttaattagatcccatttgtcaattttggcttttgttgccattgctttttgtgttttagacatgaagtccttgcccatgcctatgtcctgaatggtcatgcctaggttttcttctagggtttttatggttttaggtctaatgtttaaatctttaatccatcttgaattgatttttgtataaggtgtaaggaagggatccagtttcagcttcctacatatggctagccagttttcccagcaccatttattaaatagggaatcctttccccattgcttgtttttctcaggtttgtcaaagatcagatagttttaggtatgcggcattatttctgagggctctgttctgttccattggtctatatctctcttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtctttggtagcttgatggggatggcattgaatctgtaaattaccttgggcagtatggccattttcacgatattgattcttcctacccatgagcatgaaatgttcttccatttgtttgtctcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattggataccctttatttccttctcttgcctaattgccctggccagaacttccaacactgtgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggctttttctgcatctgttgagataatcatgtggtttttgtctttggctctgtttatatgctggattacatttattgatttgcgtatattgaaccagccttgatcccagggatgaagcccacttgatcatggtggataagctttttgatgtgctgctggatttggtttgccagtattgtattgaggatttttgcatcgatgttcatcagggatattggtctaaaattctcttttttttgttgtgtctctgccagggtttggtatcaggatgatgctggcctcataaaatgcgttagggaggattccgtcttttctattgattggaatagtttcagaaggaatggcaccagctcctctttgtacctctggtagaatttggctgtgaatccgtctggtcctggactttttatggttggtaagctattaattattgcctcaatttcagagcctgttattggtctattcagagattcaacttcttcctggtttagtcttgggaaggtgtatgtgtccaggaatttatccatttcttctagattttctagtatatttgcatagaggtgtttatagtattctctgatggtagtttgtatttctgtgggattggtggtgatatcccctttatcattttttattgcgtctatttgattcttctctcatttcttctttattagtcttgctagcagtctatcaattttgttgatcttttcaaaaaaccagctcctggattcactgattttttgaagggttttttgtgtctctatttccttcagttctgctctgatcttagttatttcttgccttctgctagctgttgaatgtgtttgctcttgcttctctagttcttttaattgtgatgttagggtgtcaattttggatctttcctgctttctcttgtgggcatttagtgctataaatttccctctacacactgctttgaatgtgtcccagagattctggtacgttgtgtctttgttctcgttggtttcaaagaacatctttatttctgccttcatttcgttatgtacccagtagtcattcaggagcaggttgttcagtttccatgtagctgagcagctttgagtgagattcttaatcctgagttctagtttgattgcactgtggtctgagagatagtttgttataatttctgttcttttacatttgctgaggagagctttacttccaactatgtggtcaattttggaataggtgtggtgcggtgctgaaaaaaatgtatattctgttgatttgggggtggagagttctgtagaagtctattaggtccgcttggtgcagagctgagttcaattcctgggtatccttgttgactttctgtctcgttgatctgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtatctctgcacgtgagatgggtctcctgaatacagcacactgatggttcttgactctttatccaatttgccagtctgtgtctttcaattggagaatttagtccatttacatttaaacttaatattgttatgtgtgaatttgatcctgtcattatgatgttagctggtgattttgctcgttagttgatgcagtttcttcctagtctcgatggtctttacattttgacatgattttgcagcggctggtaccgattgttcctttccatctttagtggttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatcagccgttagtctgatgggcttccctttgagggtaacccaacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttgcaacttggttccattctccccatcactttcaggtacaccaatcagacgtagatttggtcttttcacatagtcccatatttcttggaggctttgctcatttctttttattcttttttctctaaacttcccttcttgcttcatttcattcatttcatcttccattgctgataccctttcttccagttgatcgcatcggctcctgaggcttctgcattcttcacgtagttctcgagccttggttttcagctccatcggctcctttaagcacttctctgtattggttattctagttatacattcttctaaatttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcgttcctttggaggaggagagacgctctgcgttttagattttccagtttttctgttctgttttttccccatgtttgtggttttatctacttttggtctttgatgatggtggtgtacagatgggttttcggtgtggatgtcctttctgtttgttagttttccttctaacagacaggaccctcagctgcaggtctgttggaataccctgccgtgtgaggtgtcagtgtgctcctgctggggggtgcctcccagttaggctgctcgtgggtcagggttcagcgacccacttgaggaggcagtctgcgggttctcagatctccagctgcgtgctgggagaaccactgctctcttcaaagctgtcagacagggacatttaagtctgcagaggttactgctgtctttttgtttgtctgtgccctgcccccagaggtggagcctacagtggcaggcaggcctccttgagctgtggtggactccacccagttcgagcttttgggctgctttgtttacctaagcaagcctgggcaatggcgggcgcccctcccccagccttgctgccgccttgcagtttgatctcagactgctgtgctagcaatcagcgagattctgtgggcgtaggaccctccgagccaggtgtgggatatagtctcgtggttcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggcttgcgcatggtgcttgcacccactggcctgcgcccactgtctgggactccctagtgagatgaacccggtacctcagatggaaatgcggaaatcacccgtcttctgcgttgctcacgctgggagctgtagactggagctgttcctattcggccatcttggctcctcctcctgccaccatcttttaagccagcaatgatgggtcaaatctttctcatgctttgaaccactccgatttctatttctgcttcatctctcctgtcttcctcttctactgtgtcgcttgactgactcctctgcctttctcttctgcttttaagagctcctgtgattactctggatccaaccagagaatccaggataatctccctattttaacgtcatctggctattaaataattctatctgcccagttcctttaaagcagggcctcagttagtgtttaattgaataaccagggtacagaatattgaggggacatatttaggattctgcttaccacattgtggtagcacagtcatctgcatttctcaaatgtggataggatttaggcaatgccaagtgttagcctagattccagacacttactgacacctctaaatatttttggtaagatgtgtccccctttctcttccaagcgggtgattatctcagacttgtcctccaatgtcccttttccctttagaggcttcctataaatctttctctgatcctcctcattgccttgtccatcagctccaccttcattattgactgagcaagcagagcatttctgcctctccattgtgttctggaaagctttcagtgaattcccctgagccttggatacccccatcaagctctgatgaccatagaaaaatctcaggacttgtgaatcccattttcttgtcttttgtaatcttttgagatcccttgggaaactatttttaagccttttttttcttgctaatatgtataaacacttcaattcctttaacaactaggaaggaaaaagtgtaattgctaatacatttattaataatctcaactattttagaacctatgaacctataatttataataccaaggtttagagcagtcatttccacaatttattgtgcattaggactgtggtgaaatgcaaattgctggacccacaccaaaggttcagtaaatctagagtaggatcccaggaaacctacactcgactaggatcccaggaaagagttgagagaggtgccgtagtttagacagctactaagttgcaagatttaaggtgaagtccagggtggacagtaaccatctgtctcttctttttatagtgaatggaagtgtgtaggttgataagtactaaggcttcctcaaggagttcttgcaagagtccccccactctgtgtccctgggcactcaggggcttctccatactcctgcatgcctgtacctttaacattatggtcccagcgctgatgagcaacttctgccctggcttccctacactgaacagtcactagtctccagtgcccctcattaatatcctcagtagtacccacagcatggtgaaggagatacgttactcccatatcccagtaaatgaatgggattgagcctttcatgcaattcgagagaaagagaatgaacacttattaagagaaacggaaagaaaatgaatacttattttacttttgtaagtttactttacgttctgggatacatgtgaagaacgtgcaggtttgttaaataggtatacatgtgccatggtggtttgctgcacctatcaacccgtcatctaggttttcagccccacatacattaggtatttctcctaatgctctccctcccctccaccccaccccaccacaggccccagtgtgtgatgttcccctccctgtgtccatgtgttctcattgttcaactcccacttatgagtgagaacatgtggtgtttggttttctgttcctgttagtttgctgaggatgatggtttccagattcatccatgtccctgcaaaggacatgatctcattctttttttatggctgtgtagtagtccatggtgtatatgtgccacattaagaaaatgaacatttaaatgccacctctttgcacagttggcaccataagagttacaggagtatgtagctcttgtagactcagtacagcttactgaaaaaagtaattcactttgcaaatgatacctcatgtaatcctcacaaaaataatttgaggtattatccctttttttgtggatgaaaaaattgagctcatagatgttacaaaattcatatagtgtcatgcagctaaattagagaaaatgtcaatatttaaacccaggtgccttcctctaaagctcattgtttcaattggcatacaccgctaacctcgaaaatcccaatatttacataagtgctttatattcataatctaggaggttaaaattaggcaatgcagttatttgcattgttttggccattatatatagttttcatgcaccctaatattaattgtaagagctttctcttatagttctcttcattacacaatatccaaaatagataaaatgtgcttacccttgcaactctcacatcgggcttccctacacatttgtctgtctcgcccaaacattcaaaataggcacaggcacatcaataaacacactccttctactcatgcttcctctccacttcctcttgttggaaccattcagcctccagctagggaatcagttcatctggcctatcctagccttttcagccatttcaaagctgtgcctctcccaggacttctttggcactcccagggcactgtcaccacctcccttcgaagacagctccccgagggtcctttgtagcctctcaagcagtcttcatggcactccttgcaaagttccgtcatgggttgactgggctgaggtccctggtatttgagagaaaattaaatggacttaacgatcatctgcatatcagatgagatgtcaaggaaacaaggacctcagaccacagtgtctttgcacttgagagataaatatctttcactaagtcacatttcaataccatggctctagtgttagtggtgagggaatactggaaacggttgtatgagaattgtgtttgtggcttcccttttgatactgaataccttctatattatgatccatgcaagaaatctcttctagaatttcttcccaggaataattttgtctcccttcaaggatagctatgttttatttatcagaaaaaaagctatttcaccctcatgtgtccctttttgccatagctgctagcaagctcaggatttaaatttagtgctcaattacattgattatatcattctcagtttctggggaaaaaaattatcctcccgtttctgctctatgatttctgagctctggaggcactggaaatttagagaagggtccgtgatatctttttgcatgaataccaatgctttttggaaattctcgtggatatctgctggggattaaggaagttaaatccagctatgtcacaccctttcttctctcttatggattcttactaattgagaaggatatcagaacccattacattatcagtattattatacaaagcactggggttcctaataaatattgttaggggaatgcatcttatatacaaagtcatattttacccccactcccaacaaaaatcatccaaatctggtcttcaggagtgggtcagccacacagaggatcatggcttaatcctcttcccattgatgaccagagagaggaagccaaagggaggcagcctcctggacaggctctagaacagtgcactaagccatggcccagcaacttccctaggagacctaatagcagaggtgctgttgaggccaggccagtacaggagagacagagaaaccgtgtgtgaatggtgttcatgactagtgatcattgccaggaccaccgcatgctagcatggtgcaggcagctcgcagaaagtgttcagctcagggatgttcagctcatgactggtgttcatgactagtgatcattgccaggaccactgcatgccagcatggtgcaggcagctcacagaaagtgttccactcagggggctatgaccaggctgaaatcctgcttactctgcacctttttataattcatactcccagatggggtgcctttttcaaactcaagacaaaggctctatatgaggtacagggacccttccttttaccctattctcataaaagccacttctctgatgagaaagggtaagtttagggatggtggagggcaggtggcaacatggagcaagtaactaaaagtgttcttccagtgttcttttctcttggggcatggtctcctcctctctgattgtgtgaggagctgaggcagtaaactttgtccacctgtacttgtagaatttaacaaagaaggataggacataaggagagaaagtggtgtctaaaaggtgaaaagaagcattgaattgtcactggttcatagttcacagtgctgagtgaattgtcactcagcaaatattaactgagtgcttactatgttccaggcacagcactggacattagagctttggtgagtaagacgagcaaagaccatcagaacacctacattctggtgtccattctctgtgttcccttaggcacattatttcctcactgtgaaataaagttccataatgtcagcattgttcatgttctctctgagttccagaattcttaccatatgcttaggtctctgggaaactttgtgaaggatgttctttcacagttaatggcttaggatgattcagcgccagagttcttctcgtgtctctcatttaaattttccatcttcttgtgtattaaaaaatcaaagccatcattctaatctgattgcccaattatttgccaagaaaaactgtcagcaggtagctctactgaatgtaggaatccccgcatcaacagacttagataaataattcagcatagctggagcataggatacagagtgaggagggacaagagtaaacactggagaagaagcaagggcgagcccaggaagaagcacatgagacagtgaacgcatttctactgtgaaatgagggcaatggggagaacgttttacagggagtaacacgatcagatttgcatttaagaacagtcgatctagctctagtatggaaaggagcacaattagaaacagtgagatttgctcagggcctctgtcagcaattaggaaggacataatggtggcttgaattaaggaagtgaatgacagtaaggatcaagaaaaggagatgcattcaaaagagatttgggagatcaaatgtacaaaactttgagactgcttaaatatgggaagacaggggaggtcaagaaagatggcttctggccaggcgcagtggttcacaactgtaatcccagcactttgggaagccaaggcaggtgtatcatatgaggtcaggagtttgagaccagcctggctactaaaaatacaaaaaaattagccagatgtggtggtatacatctgtaattccagctactggggaggctgaggcagcagaactgcttgaacccaggaggtggaggttgcagtgagccaagatcacaccactgcactccagcctgggagacaaagcaagactctgtctcaaaaaaaagagggttcccaagtttcctggtttgggtaactgaatggtgcctgtgcactgtcataagccaattgcagtggggttcagggtgaaatctggagagagtaattaaatggggccagagaatatgaaggaagggacctaggtagaccactcagctcccttattttgatgcaaaccgcatgtccatacctggttgagctcaggacaacacacaccataggaactgagtaaatgaatgttggtgaattaattttataatgtgataatctaaagtgaactatggtgctgatgcccacaaaagttgggctcggcttgaagaacccagcagccctcaccctttagaaatgtcccaagagaacaccttgatgagtgggagacatgaaagcaggactgtgagcaagtcctgatggcatacaaatccggcatcctgttcagttctggactctctcagagattgacatactccatataaacatccgattctgattgactttaatgggatccccttgcaacccacagattctaagttatcccctagtaggtataatatttgtaggagacatattatattaccctggattggacactgaatgctgttacactgaagtctgacagtagcagaactcaaaacaagatcatcttgtactagaatgccactgttagtgttgatttcttgtaagccacagaaaataggtatttgtaagaaaagaaaatgttttaaaataaaaagtatttaattatcgtctaagaaatatcaaacataatcttcctgtggtatttgttttgtttttgtttaaggtcagggtattttctcttggggaggaagggatagtttttcccaggtctggagattaaacaacttaataggcatttcacgttccgctcacaaaaaggggatttgcatatgaacttgtttcggcaagaaaacacatctgaacgtatttcatgggaactatctttatccacggcagcttcttttgaccatcttcttcttttcttcccttcatgcctgcaggtcaccggattgaaactgtctcaggaccttgatgatcttgccattctctacctggccacagttcaagccattgctgtaagatactgtaatgccatttttaaagagacttagagccatcagtatactctaggccactggctccccaagatacagcacatgcttttgtgacagagattcttaattaaaagattgtttgcaaaaaagagattcttgtatgtctggaaggaagtgttgatgaaaggcctcacctgctttaactaataacctcacataacaaaaagctgaaaggagttaaaatctgtgaagattatacttgtcatttatctaatttgtcttctaaatttaattaaatagaagcaagcaaacagatgctatgtatgcttgcattaagaaaagttgttaagaatgtctgatttataaaatacattatattgttcactttgcaaaaggattcatgataggggtcctttaaatagtaagcttccttagaacatgaaagtgtttgtttttagataattagctgcttaagtgaggttaggatgattagggaggaagaggggaatttaaatctgaaatgttaggagtttctacactaaagataaatcaaaaatggaaatgaaatcctaaaagcttaaccattgtctaaagaatcttcttatctagaggtggctatggatgggctacaagagggttctaatcctgaaatcacatccagaaggttgtgtgtgtgcatatattacaaagtgcattttaggagagtagatcatggtgttcggggtctcacagcaggtatgtaaccgaaattaagttaatccagtgaggcttagccacttctgaaaagagaataggaattaacagaaaggaaaaatcagtttatctaattttaattcaaaatttatttttcagtaacacctgttttaagcaaatatgtttaatgctatacgtacatatatgatattcaattattctgtttcttcacacaactgttttcataactttattcctttaaactatatgtatatttattcacaccaccaacagaagtgcttttttaatgctcagatttgtccatgcaccatgtatgtgcaataaagaatggaacctcccagatagtaataatactaatactgaagggatataacttctttaatgcaactacatagaagtatggaatcagtcaacttgattaaacagcccttttagattctacactagttttactatatcttcctgaagcaattttcttattggtcttaatagcttggccaattcagtgaaatcagtcaaatatctttatgcatggaaacttggtcaaaagcacacaattctgacatctgtaaaaatgtaggaaatgaacagtaagatgaaaatagagaaaaaaagtgtgcatcagtagtaaagataattatttagctgtcctgttttataataataatgatgattatgatgataataatgagtgaattaagagggtgttttgtttttgtttttgtttttgtttttgtttttgtttttgttttgagacagagtctcgctctgttgccaggctggagtagagtggagcgatcttggctcactgcaagctccacctcctgggttcaagcgattcttctgcctcagcctcccgagtagcttggactacaggcgcatgccaccatgcccagctgattttttgtatttttagtagagatggggtttcaccatgttggccaggatagtctggatctcctgacctgatgatccacccgtctcggcctcccaaagtgctgggattacaggcatgagccaccgcacctggccgagttaagaggtattttataggccaggcgcggtgactcaacgcctgtaatcccagcactttgggaggccaaagagggcagatcacgaggtcaggagatcgagactatcccggctaacatggtgaaaccctgtctctactaaaaatacaaaaattagccaggcatggtggcgggcacctgtagtcccagctactcaggaggctgaggcaggagaatggcatgaacccgggaggcggagcttgcagtgaactgagatcgcgccactgcactccagcctgggtcacagagcgagactccatctcaaaaaaaaaaaaaaaagagagagattttatatgtgccaagcactgtgctagatacattacacacacctgatttaaccttactacgtagatattataattcctattccacaaactagaaacctaaggctctgtgtgattaattaacttgtgcagggccatatagcttgtggcagaggtgggatttgaacccccagcattctaaaacaaaattagacatgtgaagtacagtcatctgctacataacgttttggttaacgagggacttcctatatgatggtggtcctataagattatgatactgtatgtttactgtaccttttctatgtttagatatgttcagatacacaaatatttaccattgtggtacagttgcctacagtattcagtacaataccatgccgtataagtttgtagcccaggtgcaataggccatactatatatagcctaggtatgtagtaggctataccatctaggtttgtggaagtacactctatgatgtttgcatgacaaaatcacctaacaatgcatttctcacaatgtattcccatggttaaaggacatttgactgtattgaggaacttttattttcagatttgttaatgttattgtataaaagagtcatagaatgaatagcttatattgaaatgaataatcttggaaaatcagagtggtgtgatattcccccttttgagcacatgctaagaggaggacatgaaggatgaggcaaacaggagggaccaaggggcaccatcacatagtggtaatgacagttacctttcgtcagacacgactgtgtgccaggcaccaaagacggtgccttgcctactggtagcttaacactgtaaccctgtaagtaggtgggtttgttctcattttacagacaaggggaggaccatttgccgaggtcaaacagctagagtatggtagttggaatctgaacctttctccatctcactcccaggcttctgctctttccactttaccatgctgcattttcctttgatctgtttgtaaaagctacatgggtgaaataagctttcagatattcctaagaatcgtttttacttaatatatattagaaaatatcattaatttggccaggattgtctcacagaggttcctttcctggtaagagtactgcagcagaagtccagaaatgtataaatgaggttaaacttaatgcgggcaggagaggggaagaaaaaaagccagctacattttctcaagtaccacacacttggaaaatcaatcttgtatttaatgggccgtacatgtattaaaagctatcatatttattctgtccattgtcttaatgacctttataataccatgaaaggaaggcattttaagacagagatttttttcaataagccttttttgtggagtcaagtgaattgtgaggggttcagtctgttttgcaaatgtatctggatgtgctgatcttttaggcaaaaaaatgtgcattttaatgaggtattctgataacagatattttcccataatgttcaacttgggaaaaaaaaatgttgtttcattagccctgaatattgccggagcacttatttgttgtcggtcaactgaaagttaagcaaatttctctctatatatagtcatatctttgggtgctgttttgtaggggtgaaatgaaattaaagaggattgtaatcaagttaacttgggactgtgcaaaaccctccatgaagtaaaattctctcttgatcatgcttaattgaaagacctgtcaaccacccggtttatccatagcctgttcatctatagttttctttgcagaacagacccttaaaaggtactatttgcatttgaagtctcttgatttgcattcggttctgtacattcccagtggaatagcctaattttaatttaaatttctctgtgaaaacattttttccagaaaggtgagcacaaaatcattttcacacaaagccctttggtggggcatttcagtagggtggagtattacacagattggagtctgggacaccgaaagggaaggtcctctaaggaaccgccagactgagtgggaaattccagccgacaataccacatgggggagagacaggctgtctgtcacagcccctctcgagggagtgcctctcattcggatcatttctttccttttcccaggaaatgtgctttgttttattcttgtctcaggcctgctaatcgcaagcccctaggtccctggttttagaaatatcaaagataccagtttttcctgacatttccatacaaattaggagacagcaattctcccattccatacagactgtattgcttagtcaaattatatatctcctaagtggagaaaacaatatgcaggtttcacatttgccttaagattagagatgctattaaagtgcatagcagagtgcctagcatatagttgataaccagaagaactctccttgtatgcacctttcgtgagctggacacttctacaagttttacctttgctgcctacagcagcagacttgtatggtaggtattactagatttcatcaagcctaagaccacatttttaatttttttgcatgttgacatttctgacaatctatagaatttttaactaaatgaatatgatactattattcccatggcaaaaaaaaaaatggcaattgagttatagaaaggttaaggtacaagaaatatgtgaaatgcctaaatgccagcctgggttttttgaattcaaaactcatgctcttagctactacaattcatgccgttagagcagactggggttgcccagaatccacaggcatcaaatgatccatgatggacttcaggcatctgtagacctcctgaaattatttatagtactattttgtatgtgactttttttttctggggaggtcagtaggttttggcatattctcaagggggttcatgaccccccaaaaagcttaacaaagaacatctgggaataatcagccctagttagtatgtaggatctggccttatatggcacaacatgtttgaatttttttaaacacactacatctgtagattgtttatggaggcccaggttttacctaatccatatttttaccagattcatgaatagcttcaacaaaccctcaagacctctgggctagaactgctgtgccttttgctcctgaactgcccctgtccctcatgatttatgccaaaccaattaggatttcatgtcctatggttcccagatcaccctctgaccactcctgtccccaggttcccccatcccctggggtgacagctccccagacagccttgtcaaaggaggctccatttgccctctacccccaacccccctaagacgtgaggtcagggcagcatcctgctgacttccaaaaccctgttccttttttttttttgagatggagtgttgctctattgcccaggctggagtgcaatggtgtgatctcggctcactgcaagctccacctcccaggttcacaccattctcctgcctcagcctcccaagtagcttgcactacaggtgcccgtcaccacgcccagctatttttttgtatttttagtagagatggggtttcaccatattagccaggatggtcccgatctcctgacctcatgatccgcccgccttggcctcccaaagtgctgggattacaggcgtgagccaccgcgcccggcccaaaaccctattccttaccttggctaaactccgattcttcttgccctcagctaaaacacctcctctccctcactacattcctaggtttcaacctgaacaatactgtcacactttcactaaaaaccaagatattggctcatgccttcttcttggtggctgtgccatctgtggagacacattgtcctcccagatccttgactttcttatctcttctgacttctcttccctcctttttagcaattcactcccaggtctacacttaggactgtgacatctccccagattgctcaatctctaaacatttcaaagacttgctacccaccaaaaaatcctcttcctctattttttctggagcccctttctcaaacatcaccatgtggctgcccccttatggccacatcacagttcatctttttgtttttagtccttatcccaaataaattttgattttcgaactctagtttttgaactttcaagtaaattaagatttttcagatgttcaactatcctatctaaaactgaagaattctacattgagattcacttccataactctaaggcaataatggtttttactgagtttaatgaacttagcaagacagacatgaggataatgcatattaggaagatattaatgcacaagaactgagacacaaggctgaattgaaaatatggtgaagccctgaaacaaccagggaatggatttggctcagaagtctccttttagagaaccactacctggtttcaggcaatagcagcggtaattttagcccttagccaccctgaagccttggatctcaccttctttatgcagttagagccctctttccatgattctgctgctggattttttggtgctttttctaaggaaaaagcctttagttcccatttagtaaaggaagactgaccaagataccattgactctgtttcagagtactattgcaatcactgctaatacagggcctgggctatagtagacactcattaaatatctgtttgaatgaactatgttaccattaactgtgttgacattgtcaactgtttttgtcagtgttgtgtaactactgatagaagcaaatggtgtaattaagagggttttggaatcagtcaggcccaacttgaaattcccactctgcgatttaagtaactgtgtgatcatagacaacataatctctgtgagtctcagctttctgagatagtgtatgtagagcttagtacagtgtctagcactgagtagacatttaagaagtgttccctagtgtttacttttgtgactatactgatgctatcttctgcttttcctttcaagttggggactcgcttcattatagaagccatggaggcagcagggcactcaatcagtactcttttcctatgtggaggcctcagcaagaatcccctttttgtgcaaatgcatgcggacattactggtaagtctgggaaagaggagagaaggtcactttttggcttggcagcaaatgggcatggccaagttctgggtgaagtgagaataggaggatatatgcggtatgccagattattagaataatcctgaagtctttatattcacaatggagaaagtgacttctatgacgtctttatatgcatgatggagaaagtgatttctgtgtatatccaaccattgaataatggtgagaaataacacgagagaagttggccaggactagatcttaattcaagcatttacacaacagttttgaatacctcttctgatccacacattgtggagaatattgaagatacgaagatgaataggacatgatccttgctccccaccacccaggaactcacagtctattgaggaagggagacagcaaacaggcatattaaagatagtatggcaaaagcttggcgtgagaaaagtacggggtatcatggaaacatagtggggcaccttgtctggtttgggacctaatggcagctcagggcgtgtggtctggaagaagtgataagaaagctgtcttgaagaaagaatgcagaggctggatgctataggatctgtgggtatgattgcagactgggaatttgagccctaagaccctgagatcctgtgattccttctcagctcatcagaatcagggatcataatagagatgcagggaatcacaaataatgggctgagctctttgtgatatcagcagacagtgggggagaaggatccttagcaagcccctaggacccaaggaaggggccccattggcaggaggctttctgttgtcgcagagagtggcctggacctctgtctctctggacctgataccctcaccccttttactccttgcccctctagtgtctcctggggactggagacccattctctcccaggacccatcactgggtggccaggtaccaccagggcagggcaaggggagggaaagtggggaagggttgtacccatcccatagtcccaactccagcctgataagagcccacttgaccctacctccatttatcattatcctttgctgtccctcatcccctactttcttacctctgacttctggccaggtcaaagtccctgccccattatatcctccatccccctctaagccacacagattcctgcagatgagagccttgtctaacacgatggacgtaactgatctttgcacatcatgagatgaaactaagtaagtcacttattcccagcttagagataagcagactgagacacaagtctgaggacagtaagaaaagcatacagtcagccgggcacggtggctcacgcctgtgatccccacactttgggaggccgaggtgggcggatcacctgaggtcaggagttcgagaccagcctgaccaatatggagaaaccccatctctactaaaaatacaaaaaaaaaaaaattagccaggcgtggtggcgcatgcctgtaatcccagctactggggaggctgaggcaggagaattgcttgaacctgggaggcggaggttgcagtgagccgagattgcgccattgcactccagcctgggcaacaagagcaaaactccatctcaaaaaaaaaaaaaaaaaaaaagcatacagtctaagggcagaactattgggatgtgaagtatagaaagtattaccattaaccaagcacctactatgtgtcagtgtgaatcacgctgtagacacttaatcctcccataccaccaaaggtagaaatcggtgcccccatcttacagacaagcaagttgatgggtgggtaggtgaattaaattggctatctaaagtcaaacagccagtatggggcaggaccaatattgtaactgtggtgtgtcggggcccaccgtccctttgtactgtactgctgacccaggtttcttgacttttctgccaagtttgtaaccagttgatgatgacgccactttcctgagatgtccaaaaccctatagaagtgggccgttcaaagcagaaggaggaaagacataaaaagagcccagattgccttataattgtcctcaggagaaaaaccataacattttatctaaaaatcagctggctagttcagataacattcaagcttaaaatttgatctgtgacattccaatttctagacttctttttttttttttttttttttttttgtattttttggtagagacagggtttcaccatgttggccaggctggtcttgaactcctgacctcaagtgatccacccgccttggcctcccaaagttctgggattacaggcatgagccaccgcacccggccccaatttccagccttctgatagccaaaaaacttcctatctggatgcaagaggaaagatgaaagtcagctttggagaacacagtactctagaaaatgggaaacagggcctcccagagcagaacagctagctgtgagtgaccccggcactgactccgcgctgcagccctggactttgtgaaaatgggtcatcttccaggccctacatccctgggctgactcagaagcacggcggggagtgcagcggcttcacagaaagttctgctttggaaactgttctcctctaggctgttgaatgaaaaggctgttaatcgttatttggattccgattgaaactggaccttttgtctctaactatggaccagttacagttccagacaaagagaccttttatttagcctggaattcctctgcctttggaagcctgtgactgacaagtgatggcaaagtgcatctgcctttgaatgctttgggttctgctaaactcattaatgcatcagataaaatagttcacattccagccaaagctgccctcttcctctccttcacccaggactcagagaaaagaacacatttgcatttgtccctgtaaaaggcacgtacacaagcagccagtatagaggtagtgtcattggtgcctttaaacattgtattgctctagttttcctacaaagacagttagggaggactgtagacctggaacatgattctcagaaatgcatgtgaaaaacacattcgaatttgggagatttttttggagatagtgtggaacagtggaaaaagcagatcagctctgtgactttgggcaagttactttacctctctgagcctcagttccctcttctgaaacaaacaaaccaaaaaacattatcatctccctcatgtagatcactgctgaggaataaatgcttgcgagtttgtgagcatcaaactctgtgcctagtccaagtaggtgatcagtaaatgtcaattctcttattccatctaggaagccccatgccaaaaagaaagaggggcatttgagggaaaaaaaaaagcagcttattattttgaaagtgaatctttgccatgttgagaacagcctgctctgtacaagcagggagagcggggccttgccagcttgggaaatgctgtctacatgaggaggaagaacctccttgtaccctggtcatttggttaactgtggtttcaagaaatacttggtatgtactaagtaattgttaagtttcccccactgacttgggactaaatgttccttcttctaagttttattttttagtactggtagtttcagtaggggtttccctcttctggtcttactcattattttaattatttgttctttcatttattcactcaaaagcattctctgtgcacaccagtgtgccaagccctgaggttggcacagggatgctaagaagaacagtaatgtccagccaagaggttctttataaaacacagaaaaagtgcccttggtcttatgaccaatatccagagtgagtagagtggggacccagaggacaaaatgtgtcggtgtcagtcaggtccaggcagggaacagatacacactccagttaggttaaccggagggaagttgaatagtcagtgtacagagctgtgggcagggtgctggaagcccagacaaccaagaagtaccttgggatactaacagtgtttccacccctgggctcacaagggtgagggtagggagcaggcaatctgagcctggtgggatgtgtgaagagggcagcccagcagaagcttagccaaggatgaaaccagagggcaggggcccacagctgtgatccccactggccagtctcccaggctcagagtaggtggagggaggaagggaagaggtgggattggtcttagaggcaaatggaagcagtggattgatttcaccctgggtaacaggtgtgaggagagacttcagaagtaaggtaaactttaagaataacaactaatgctaatttagtgctttctctaagccaagcaccattttaagagccttattataatagcagttttaattctcacagcaactctatgagataggcggaattttaaccccatttttcagatgagaaagctgaggcacggaaagattaggtatcttgcctaggatcacacagctaagtcagtggggaagccaggattcaaaccctggcagtctgggttcagagcactttgggcagcaacttgagagctgataggggattcaccaggttcactcacatctctggttcgcaaggggaggggcctgtgagtagttcctccctgctcacaactcagggagcttttggcagggtaggaaggcccgggaagtgaatggtgtttggaggcactgtcttcaaaaacgtcccaggtccatagagaaggcttgatggtcatagtcgcacacccatctgtatcattcctaggattcttcaacggcttgcagtgctctctcctgctggtgtcagcacagccctgtagtgtggcctggcatctgtccttcccctctggatggttgatgggaacctttattgtcccttccccacttatccagtttttagtccaggtctagtacatgcatagaggcttcacttgccatctacctgaattctaacagtagcagccatcatttctccagggcttactgtaggccaggaaatatgctaagcaccaagtgtgtgccctctcattaagcctcacaacacacctgtgtggtacatcttatcatcatccccattttacatttgggatgatccccatttgcatttgggaaccaaggcttaaagagtgtaagtgacttactggacacagagctagtggaaccaggaaataaactcaggtctgagcttctcccagcattcccaccccacctgacaccatgttggcaatgtcttaagtcctggcccagttgagagctggtattcctaaattctctggggtgtctgtgggaatttactcccctgccctttttctctgggtagctggaggaaagaattgagtggggaagtaatgggatgtagagagagtgtcttctcagacaagataggaaaagaaatctaggctttgggaaaataactcttatggcttgagtagaagacagtttttacaccacaagtttacctctgtaaagtttgctgccatctcccgattagcagactaatctatacattatagacctaagaatcctaaattatttctgttaatcttaaacctaccatgaaccctcaacctctgggcattggcatatggagggctcctccctgcctggtggactcctgctcacccttcagatgcctgtttaagcctcatctccaccgtaatctgtgatgaccgctaccccagaaatgtaagtgactcatcattcagtcacttaccatgtgctagatactggtctaaatgccagggattccgcagtagtcaaaacagagtccctaccctcaagtagcttaagtttttggaggggagacagacattaaacaagataagtaagtaaaatacaatgttggaaggtgggatgaagcagttaagggggtaaggagtgttgagggaagttgtaattttaaatctgatggccagggaaagctcagtaggaaggtgatgtttgcggaaacacttgaaggatgggccggcaattagcatgtgggcatctaggaggaagtgttccagacagggaacagcatgggtaagggccccgaggcacactcaggaagcagcaaggaggccaggactacgtggctggaaggagaagaggaggatatcagagagggagaagtggggccagatctgggagggagagccccttgtcagccactgtaagggctgtggcatgcaccctgagagaggggagaagcccctggagggatgaatcacaccctctcttgctatctcctttcccttagcacatctcagttagagaaccaaccccctccgtagccttcatctctctcatccatttccctctgaaacctgaatagcagggcacagtccgattcatctcagtattccctcggccagcagagcgcttaataaacatcagtggatctgaacttgaatcaaatggcaggtagcagcttgcagaagcctgaaaaacctgggcactgaggtctcgtgagttgatatatatggtgttggttcccttgggctcttggctactgcaccagcaggcacaggcagtgaaatcttttagaaccaaataatcccaaggaataaagaagggaggactgcagggagtcgggcggggggcctgctgctgccctgatgtcaggtgtttttgccactgcggctgcttgttggctcctcacactcccctggctctgctccctaaccaaggtgtggccttgtcctgcgcaggcatgcctgtggtcctgtcgcaagaggtggagtccgttcttgtgggtgctgctgttctgggtgcctgtgcctcaggggatttcgcttctgtacaggtatgtgaagaccagggggtgggctgtggctcctcccctgtctgaggccatccttcctcttgacagcagctcgcattttacaaaatacacacaggatataattaagaaatgataggttccagccagggaaagcacaaacacttctagcctcagacatatttattgcagttttcatttgacttggcctcggttcgtgttggtcgttctgtttttcagttgttttttttctttcttctttaaaataccttttaaattattccttttaaatttccccttgaccacttttctttgagcacatgaaacaggtaaggctcaaaacttcagtgtttcatgtgtatttcagatttttatttgcttatgtcaacctcaccattttctaaataccttgaaggcctctatcaacaagagacacaaatgaaactgtcagtatgaaataaaaaaggaattaaaagggaaaataaggaacaaagatataggaagaaggaaacaatttggtggctgtgattaaacacataatttggctcagagcttcctggcaggcaagacaaaaaagaacacatgataaattgcataattcttactttcaaaaagaggaaacatactagtttctggtgagagggaaaacttttcctcccaccaaattgcgaaagaccttgcacacatggggctttgtggagaggttttgagtgctaaaataatacaaggtaaacaatgaatgtggtatggaagctaagagcatacaggctctggcattagaccacctgggctcaaatcctagcttgattacctaccagctcttgtggcctaaacagtcttctctgtacttccactcctttatctgtaatagtaattgacagcgcatcgtgagttctgtgtgtcaagcatgctcatttagtccctgcaatagctctattatccccattttatagttgaggaacctgaggcataaagaagttaaataacttggcctaaatgaaacagctagtaaatgccagaatcaagaagtctggctcccacttctcaactgaacgttcaagagatatttgttcagcaaagcagcagagtccaaatgacttgcccatggtctcaagcttaggactacaagccaggtatctagtagctcagtaattagagctttgtttattgtgaacctcttatgttccagacactatgctaggtgctttttgtataatcttcctaatacctataacaatgcttcatgagccacagagattgggccatagagatccaaaatttaagggtacactattgggaacagacagatgtaaaagtgtgatgctgtttgtactgcattttggaaaatgtggtacactacacactatccaagcctctgaaactaatgactgtgaaatctccctcacaaggaattaaatccactcatgaattcttgtggattctgagtgagtctttaaacaaaggtggtatagttcagttctcgactttttctggatagtctcgtcctttctcaaaaatagcacatggagatatttgttgttgaaatatcaatgaattgtcaattattattttagtgtatcagctgacggagatgttctcacaattaaatatcttgcccttcctgcggcaaattataatagttaaaacaggggggatgcttactaaggttctgcagaggttaccctgtgttgtgaactgaatatttgtattcctgcaaaatttgccctgaccctcaatgtgatggtatatggaggtgggtctttgggagctaattagggttagatgaaatcatgagggcaggagcctagtctgatgggttatgatggtctgatgggcccttatacaaagacaccagagagctggcttgttctctctgccatgtgaggacacagcaagaagtccatttctataggccaaaagagggctcccacgagaccctgacattgctggcaccctgatctcagactttgagcctccagaactgtgagaacatagatttctgttgtttacccagtctatggcattttgttatagtagcctgagataagacacctcatttaatcttgacagtcatcctgcttgcaggatgcgtgtttttatccttctgtgataggaagccaagcttcagagatgttttaagtaatttgtccaaggctacacagaaagggcagaagcagaattgaaatgaaggtctctctgggtctatatcttatcctgtcattctttttctaatttgttcgatttgttttttctttaaaaatattttctggcttcttaagtgttcagtggtgtattttctgaaaagaaatgccataggtcacaaatcaggagatagtctgtagctcaaacagagaatagcctttcaagatgaggctgctatactagatacatcataccatgactcatggcttcattgatatcttattcaaaactgggatctccagctccaaaggaattccactcacatcttcccctaatgggaaactgagcttaattccacactgacatcttgactacatgagatttgctgttagtcttctgtaacagaatctaagatatagtagatcagatttggaactgatgacttgagtagcagctgcaaggctcacagcattgtaaagacaagctcatgtctcctattcaacccaaggatgtgtgtgcctgtcctgatcgttttcaggagacacaatctagtaaagggagccaccagctgagagagtcctgaggtcttatctgtcatcacttacctgacagactccccatagtctggagctctgtgcttgctttactgtcctcagacgatgtcacttgttctctctgggtgcttgttttatttgtctgttttatgtattttttttaatgtttaaataagaattgccacccatatgggactatcgagataaagagcctttgaaagttccagtgacctctcaggtgtaatcaatatcattagaatgataaaatatttggaactgctttggaaatgaaaatgcatgtagacttggcgtcatttgctcccctccaaagaagaggggccaacctttgtgccccaggtctgaggaccagcttcagattctggcaaggtgaggcaaaattgaattgctttctttctgtgattcatattttcaacctgaacttcaacacagtcttttctttgaacttcagggaccctggcttggtttgcagggtacctgccttcccctccttaagaaagttgagcaattcctgccagcacctcaactattccagcaagtcagatgttttatcttctcatggaccacacatctggtggttagatggaggatttcacttcttatctagataggccaattttggtagactcaaccagagtcacctccttcagatgctgggaaggctgggaagaatccagaggacccagacagtagaggtaggaaaaacttttatgtgcttgaggagacagggttttcataggcccctgaatggatgattttcagccgggggtagagtcctatacctttcttgggtgataccaatggatccacagctgtagattttacttgtagcttttgtagactctgtgtatctcaattctgggagaattttatcaggggaagggagactggatggaatattctggtgggcccttaatgaaagattggccaacaacaagatctattgatattgcaaattttgaaacatgctgacaattcctagcttccttcttttgttcttttatccattcagattctccttctcttagtttgtctctgtctctcttcccttgtcctttcctgctctctctctccctttagacatctaaagtcttcttactatttctttgtcaaattcggatctcacaaaggatactgacatagccattcgttcattctaaagaatacaatgactaatactatcttaaagagttgcccctctttagaaagggtgttttccttttagtagttttcaaaactgtgtctttactaaagagaacagtctccttgtggacaagtattcttgaaggcaaatcatgatcagctttatatctgcggtttaatgaaaaatatggaatcaagccacagatatgctgctctcacagtaaaaatttagctattgaataagtgggaggggacacaaagaaggcagttcacttcccctccctttactcttaggaatgtggaatccctgcagtcttgacctctgtgacctttctacttgatccctcccccatcatcagtagagtacaaaatgatcctctgtaattctgaatatcttggaaaacaaataattataattagaagctgagagtgttccataacacttctctaggctcccaggtcctggaaaatcaataaactggaaaaaaactaagtttatgaaatatcactatgcttacactttctaagcacagacagttaaaagattctaagaaatacaaggacaaataaataaaacaagaagcagtttcaagtcgttgtgagagaaaactcaatcaaatggcaaagagacagcaacatgaaatggctctccactttctgtttccttcaggccccctgcagatgtcattagctttctgtaatttcttatcttcaggggcagtttttattcaagtctatttagacaaaacaagctttaattccagcagtgctatttgtcttgaaccaccaccccccacccttgaaaaaaaggagtggaggaagcatctgaagcaaaaatcagtaaaaggagacagtgacaagagatcaaaatgcattcagcagtcattttaaggggagtaccagtgtaaagaaaataagcccttggaatcagccaattaatcacagaccttccttcctcccactgtgtgagtgttgccacccctgtaaaccactgactccatgcactctcaccatcaactttccctgtcacgttccagacagactcctgtgtcttcaagaccaatacatgtaagtggccagttgagagctgtgattactcaccctttctgtaatgtgtgcccacaagataaaccatccatgctgaccgcagtggtctacccttgaggtcattccttgcaaacatcctcattgcttagctgaaacctctacttctgttctttttcatgaaattcacttcatttagggccagttatactcatcacctgttatgcatttcagagcctatgatttttgtatataacatgtctcccattctattttattttgtaagagtcaactttctgtgatttttttttttagctctatttggctttctgtcacgataaataacagttttgctatttgcaaaataaagctgattatcattattttagtttccagaggttagaaaaaactgaaataccgtagatgttcagaagtatgaaaccatcccatttctcggtgcattcaatttagtttacttgcatttttttctttgtctggaatactaacatttcatgttcattggggacaaaaataagaaaatttaattaagatgagtgaaaatatgaaaacattgatcttgttatcctaaaataacctattttaaattatttacttattaactatttaatattatggtttctattctcttagtctttttgtacatattttaaaatcattttatacttttaaattacaaaatgtattatacaatgcataaagttttatctttttagacctttttcctatactcaaaaatatgtagtaaacttctttatttatcatttttgtaggctgcataattttctacctaatagaatatattatagcttatttcaccagtcctccagacttgaatatttaggttttctccattgttttaaagaatgctgcaactgacatctctgttactaaatgtttgcacacatcctaaattatctctataaaataaaattagaggcatataattgttcaggcaaaaagtgtgcccagcatttagggttctgatacatagtaataatttatactcccatcagtagtgtctgaaaactcagggtttacatttcttgtatataaggaatctcttgccatggattttagttccattttagttctatttagctttcatccccaggcctcttataatcctacttatttcacatatggtcctgatattatcagcttttttttttagtagccttttgccctttgctgcttaagcatgtgtttctggatgagattctgattcctaattaaatagattcagattactgattgaattttctgagtatcctgtcccatatgtcagtgtccctcagaaagtcaacagaaaactttggaatggtataataattaataattgaaagaagaattcaattaagaatatgaagttggccctaacattcattattcttattgccacacctggttaacaatacattctttttttttttttttaagagttttttcgacccctccagaaaaaaaaaaaaaatagaataaaacaaaaatagatcaggttctgattaattataaaacctctggtttcaatccagtttgcagaatgataccatgggtataaaagtcaaaacattagctgaaaattgtaattttttaaggaaattatttcaatataagatacacatcatttgactctcttgttccttacagagtgatccaagaacaggacctgttactttccatccattgtcatttcatagaccccttgaagcaacccagtggttggtagcagcaatctttgtgcagatgaggactctgaagctcagaaatgttgtataacttgtttaatacaaagcccacgctctttgtattccatcagaccatatcctgtagatacatatacattgctagggaagtacactatggcaactgagacacctctcacaaggtggtatcgtttataaaaaatagcattatgtatttgtcatcattgcttggttgagtgtccaacacagaaataaaaataagcagggtgccctctttggcatggaaatattctaattcatttccccagagaatgaccatactcaccagtattattttgctctacttgtttgcttttaatcataatatatgcctgtttactttttgtagctataaaaaggtagataaaagaagcactttaggtagatataaaaagcactttaattaagaacatgaattaaaagatacttcaataatgaagtacaatagattaaggaatactttaatagattaaaataacttgaattaaaagatacttaaatgctattgttattaacacaaaggtttaggctaacaaaacgcattttcccaaatatctctctcacctccccccacaatttttattcaggaatgtaagaattgggcttttataaaagcaaccaagggctaaacatctactaagttcttagaaactttgaaggattacagaactctctttctataataaggtttacctgtttgacttgattttgttcaagatggcatttcatactggtgtaaacctaaacaaaaatgtgtaagatttatctcatagaaagacgtgcctgtaagtaattaattcctcactctaattactatttatgcctttactttttattgtaaacattcttgttggaataaactagaaataggttttttttctttacactaaaataactcatgaatagcaatgaaatccatgctgtataatattcaaatgagagatcaggaaagacaaggcttttagttaaatcagtaatattctgtgatggggaaaattgccttgaaaaatacacacacacacacacacacatgcacacacacacacacatacatactactagaaaaagtttgaggttcgattcagagtgtggaaggtacagtgtcttaaaagagtttcagttgcagcatttaggcagatgatcaagaatatgcagaagaaaacaaaagaaatcataattatagtttcctaacagaggtatttgatcctctgcagtgaaccataaaaaactagcgtgggatcagaatcttgagtagcatgtatttaattgtatgcatttcaaagaaatttgaacattttaaaaagttacaccatatgaaaaattgtatataaagacattttctataatattataataattttacaaatgaggaaacagggttagagagagtaagtgagttaccaaagccaatggctagaaagtgagagaggcagaatccaagtactagcctgggattcccaaaccaaagactgttcagctcagccacaagtggaaatggattcttatggggctaagtgattaccattactttaaaaactagtatcagaaatagatgacaagaatttaaatgtatatcaaaatatccctttggtaaatgttagtgtcctcacaggtaaacagagggcaccctcaaatttgagtaatttgagagggtttaaaagagggactgtttacaaaattgcagtcatagagacatagagaaatcacagggagaatgtgaccctcgggtttgtaacagctgggcctgtagaggcgagggaaaagtgcagttactggatgcccagaacagagggctgtgtggagactgcacagtgaccctggaagaaaagggctgcactgttaaccctattctccctctctctaatctcctgcctgcctcaccattggctggaatcagaatcagagagcaagggaacctgttgatgtattctgtagaaggccacatctctaagctcagaggagggtgggaaggaatcttcagaagcacttggagacattcaactgagtcacccaccctggactattcagagcggtctgcagactagagggcagtctctaaatggtttgttcagatttgctatgaaacaaggaacttgcatcagaatgtaaatcaattatgtcaccaagtgtactgtttagttcagctgtcattttattcatagcaagatgttctcaatgaaggaaccggtgtgctggcttacatcctggggccaactcctttcaccacagatgggccctttgaatagcactaaactagattccttgctctgtaggtaatgataaaaacgctggaatccctttccttgttttgattttcctaccttaacttctgctaaagagaagaataacgagtatttttctgtacctaccctgagcctggcactgtgctaaggtactttagatgacatttaattcttgcaagttagattattcacttcatctttacagacaagaaacagggccagaaagtttaagtaatgtgcctgtggtctagcaagtgagagagccagcactcaaattcagatcttactccaaagtccatgcccctcactgtttgtaggctatcccaggactgtgcttaaaattatctgacattaacaccaagaaataaagcagggttgttgggggattgccttatatggagacctatgactatgttctgtatacatatgctatgcatgattcctgggaatagataaaacccagctccccccaaatcagatggcactgtttgtgaatacgatgttactccacgttacaaggccttgtccagcccagccagccaggtcagagatgaattcagtttgtttctaagtggctgttgtctgttgccatctctttttaaacctgggaggtcaggaagaagatagggagaaagaattcatgagagggatgcatttccttagaaatgttattaattggctgggcaaaacaagagaaggaaataaaatagctgctccttactaagtaaaggcatcttcttcccttatctcattaaaaattaaaagcactcttggtttaagtagggcaaattagtaattaagtgctatataatgaacttgtataaacagaatattgaaggggaagccaaattaatcactctgctggcttgtttttgcccccattaatgcaccttttactcaggtccttcctgtgataccaggatgcattttctgctctcctctgctgctggagattgggtgggctgtgatagttgggctgacagatgacagtggactagatctggaaaagtcatgtgtaggggcctcgatggccatttcattttttaagccaaggctcatcagcacaagcctgcatgtgacgggaacagccttagacagtagcagggcaaggaagaattagacacaatgtcggtacccaaggaattcccagtctactggtggcgggaggttgggcacagatggatacagttatgaaaaagtctaaggtgtaatggcaaagactatttccttggactcaaatcttggctcagccacttaccttgggtgagttacttagtttctctgtgtctcagaggcctcacctgtgaaagattccattgcaattactctgcaatggaatgatggagcatttgaggagtgacttccactgtcttaagagggctgggaaagtcttccagaagaggcaacctttggctggtgacggagctagaactcagggtaccgtgggaccccccaggcctatgctcctcatctttgcagcatagtgcctcctctgaaagcggaagaaggagcttgggcctcaacccaggacaaatctctctccatttcagctcaacatagtaaatattagtaataacatctggatcctcagtctcatgatatgttagcaactacctgccaagtatgtggggtgaggagtagaaagagtaagtgagctgagtccatcacaggctgggtaagatgaaatcaaatggagcagcagaaagtagccctctaagtcaccttgctgaacctcacggtgatgccatctcctcggcttgctagctgtgtgaacacacctggctgggcaagctacttaatttctctgatctcagttccatattaactgaccccattgagtttctgcaaagattctgtgaatgaaagcacatttagcacaatgcctattcagcagaaaagtactattatcattccctgtgttcatttgatcttcaccacaaccctatgaggtaggtggcatcattgtgccactctattaagcaagaaattgaggcaccaagctattgaaaatctcgcctaaggtcatctagatggttagtggcagaacgatggtttaaactcaagtggtctggctccagccctgccctctgcgtatcccccacagccctgtgctttggagggcacctatagctaggtttgcatgtcacatgctagaaatagggtagacgcttctcaaggatgtccggacctctctctcactactgaggaagaagttatttccttctgcttgagggaatggtggggcagagcctacagctgtggtgaccctttgacaggtggggcaggtagagcaggcacaagtgactcaccagggagcattagccctaggatgcagtaggaatgcagctgctgcactgatcttggcagttttgattagtgaacagaataatttatttgtcattcatactctgcttccataaaggatttaagaaagcttacaataagtgactaaatagttactggaataaaactcataagttagaaatgatgtaaaaagaggaaaatacacatatatatacatataaacatgggaagataccagcaaaggacaaggtgatttgattctgtatcaggtaggagaaaagtactagaaaagtattagtattaatatttgtattcaaagtactgccaaagaatgttgaaaatcagattgttttaattctggattggtgagtgccacaccaaatatctatgggacagatctggcttatctatgggtctctgatctggactaggcagttattattatttttttttaaatgaggtctcgctctattgcccaggctggagcgcagtgacataatcatggctcactgcagcctcaaacacctgttcaagcaatcccctagggggttactttgactgaacttcaggcaaccaaggcaaaactgggaaaagtgtcaagtcatatggagtcaaagaattataccaattctttgaaagagaccacatttttccttataccaaattctaaaatcattatttctttaaaaatgaacttagaaatccttccatggaactcttatagaagaaggcagaattcattatataccaccttgctgagagcccagatcataacattgaaacctgacttcgggtctaggataggctgggtttatagctttttggagatgtcacttgactcagtgatagaaccaagaatacccagtttggtagagagatagcatgtcccttcacctttttccatgaatattccttcccttggccagctttgcaaacaaagctgtgttactgacctaggagtgtctcatagtacctcagtactaaagctttttacaagcctggcatcagagaagtgctaaaatgaagcacccgtcaatcgagaagggcaacagatgttgaagcatatcaaatatcagtaaacagcaagccacagagactgctgaacttggcatcctcatagcaaaaataccctgttgcctttaagagagaacgctgtggacttttataaaccacattaagtgatgtatttttttctccatttggacaattgctaccctatgaaatattttccctgaaagatggtctgctatcctctattatttttttttaatctctacttttttaagggcaaacttaatgctcacagagtgttctaggctctcagccctggaaatataggtctccagaaattgagaggagtttcatattcagcttatctagtaccctctcttttactattagccgtatgattcatattataagtaataaatcgagctgtatttcaatcctgtagctgtgcactagattagtccctttacctctctaagcctgcttactcatttgtataaaaataagactattaagaacacatacctcatgcaattgttgtgaaaattaaatgagatgatatgcaagaagtatttggcacagttgctagtatgaataaactctcaatgagaggtatacaaaattatagcaatatttatgatgatatctatcattactattagctgactataagtcacatgctgtattaatgctttacatatattactgaaaggtggctgggctggtcctttgcctgtttgctctcagagagtgctccttcccctgctctgctgtgtgttacacttcctaggctctcttgcacctggcctctgagcaggcttggccattgggaggtaatggtgggagaatgactgatgtgcaggcagaagtcaggtcatttctccccttcactacagcagcagctgcattttctgtctgattccagctcccagcctctctcagatcccagttctggccactcagcttttctttggtttccgttctatactgacattccctgttcctggctctagtcacaccactgcctcctgtcatcccttgattcctaagaggggtagcatctgtctgctgtcggtaacctctgtgtggcttcaacaacctgttgggcttctaggtctcttctgtcactaatgaaactaatttcttttttttttttgagacacagtctcactctgtcgcccaggctggagtgcagtggcacaatctcggctcactgcaagctctgcctcctgggttcacgccattctcctgcctcagcctcccgagtagctgggactacaggtacccaccaccacacctggctattttttttttttttttaagtagagatggtgtttcaccgtgttagccaggatgacctcgatctcctgacctcgtgatccacccacctcggcctcctaaagtgctgggattacaggcgtgagccaccacgtctggctgaaactaatttcttatatttaattcctcctgttcaaagacctagagtaggtctttgggctacctagctaacttgactggtagtccagctacctgactggactctgactgatatcattgcttttaactactaaaagaaaaggtagtccttatagagaattcacttctcctcctctccctgttggagtgagccaagccaactggagaagggatggctggttatcatggagagacgttcacttggactaaagctcaaaagacaataaattgacctaagcatctttgatgaatactgcctatacacccagctgagtttggcattgaggccaggagcctcaggtagcttaccccctctctgaggagacaagattcaagtacaagtcatagccaagcacactacaagatagtgtctagtcagaaggaataggaactcctctttcttgagccagagccctggaccattcactattctaggtaagtaactataatagatatgtgattattctcacatgaaaaatgaggaaatggaggctcagagagggcaagtgatttacccaaagtcacactgcaattaagtagtggtcttagcagcttaagtctgtatgtcctagaacctgtttatgggacttatatctgttcctcaaagttttctaatctttttgtcagtttcaaagcagatagtaagaaaactacatacataattcatattgccctggtcttgtagaaatgaccttacagaaacaatattcagccttattcacctaattctcagaacaggtttatgtggaaagtttattgtgttcattttttacagatgacaaagcagaatcaaaaaagtaaaggaatttacccaagttcataccgaacgttcatattcaacctggaatttgaatgcaggtttttctctccccaagcatatgctctttccacttggggacgtccaagaactggaccatatgtagtataagaccaagtgttttttagaattttttttttttttttgagatggagtctcactctgtcgcctaggctggagtgcagtggcgcaatcttggctcactgcaacctccacctccctggttcaagtgattctcctacctcagcctcccaagtagctgggattacaggcacctgccaccacacctggctgatttttgtatttttagtagagacaggatttcaccatattggccaggctggtctcgaactcctgacctcaggtgatctgcccacctcggcctcccaaagtgctgggatgataggcgtgagccacctcgtctggcctagacatttttttaaaaggttggggagaaaggccaggtaccctatcttccaggaacagacagttgggttagagaagtatatataaagtgacctgaaaccagagagtgctgttgcataatctactctctggtagtgactaccagcaggaaagagtagcctggctttgtgtaagaaatggggcttgaaatgggctggagtggaaacattaatttaggacaggcagagaagcagcaggaagagggatttttagataaaggtgctggtgagagcaaagaaacagatacagacagaacggagatcaacgttaactcctgggaagggtcccagttcaggagtagtgaaaaagaaagttggatagataggaccacagttgattacaggtaggggttgttaaccacaaacagatcaattaggaatttgatcagcagtcttgggagtactttttgctcagtattcccttatcctttaactgtcttttaaaaaaatgttgcaagctgatagtctcactttaaaaaaaaaaacgttaagtccttcttagataatactgctttctgcttaagaaaaatagcttttaaattagttcagcctgtgagtaataataaaagtttattacttatctctcacagttttgaagagtctctaaaatagaagggaatactctttaaatgcccctaaagtgctatcctctttcactacagttcatttgtgtatagggtgttataaaatcacacatttgagaatttcaggatggagaaagcaccttctgaagcaatgtcattgagagatggggagcaagccactttctaccagctcaaaatctactccctcctccctccccaacccctccctgacacctgggcctagaggagcctgtgtgttggatagagttgacggcagtgaaattcctaccaagttggccctttcagtttcacctgtcagtgtctctgatgaagagggatcttgacaaaccagactggtttggataattggactacagcagttgtcttcatctcagtaaactgactaaccactacagaggctggaggagaaatttatagaaaatcctaaaatggaaattgaagcaagtgtttcaatgactaggaaacaacaggctttagtgaggttccaacatattatagtatggtggggtgctgggactcctgtcttcaaggggcccctaaaagtgatagaggggattcatttagtatgccccagctgccatttaagcactttgtggttattggctcacttagtcctcacaacggtcccatgagatcctgatattagttgtactttgcacacaaggaacctgaatcaccaagaggccacgcgctttcccaagcttacatagctggtaaaaggtgaagctcagatacaaacccagattttctgactctgtggtctgttcactgtaaatactgaaacccatctctataaagctcctttgggaaactcatcttggtgaggcccacctctacacggccctacccccatgtgcccatctcttgcaccgcccttagatgttgccatgtttgctgatctcactcaagtgtgagcttccatataagggtccaagtcttactgatccttagccagtagtcagtgctggatacatgtatgctgtaccagactggaggtgaagttttacagagactttgtaatcttcctgaagctggctaagaaggcagccacctgtgactagttacacagaaacccagccacttaaagcagtggcactgctggggatggacttagatttaaagtcgctagcaggtaaaatctgacctatgtctccagaaacaactttacttgtgcacattagctgtgactgtaaactgctgcttaacggttctcacttgctctaatttttcaaagactgactccccagtcattagagtctgttctgttactagtaactcagtggatgatctggaacaagaggtctacctctttgggccacagtttcctcatctttaaactgaaagaatcagattctggttttcaaaaatgtaaagcagtggaacctttgggaggccaatacagaaaacagaaggtgaactgtgtctctggcttatccatcacaccctctttccccactgcctggcagccttggagggtctttgctgaacataagcactggactagatctttccaaaggaaataactgaaaatattataatgtttaataatgatacttaataattcaataataaagtaacttcaaaatagcctagcctaccttgagaaaagcaggttggagggccctcaccatggggtcactgtgcctgtctgtgttactgtcaaacattgtgtgttccaggcacggaggggtgtcagctcagcctgataatgtacagtggattggggaagctaaagcctctgggcctcattctccttggctgaaaacagactgcgtgtcatggcactggtgaattagaaattctatccagccactcttggagattgattttccgtctggggatctgacctcttgcttcactagcagaggggatcagactgttctgggaggagtcaacgagctggccctcagaaaagccttctctttcttttttgttctttttttttcttttcttttttttttttttttaactgtatgtttcaaagggaaagtctgattactttggggacttaacactaccagtttgaattcttcttggtacttacagccttaagatatccatacacccccacatccgtcctttgtgctagaagattactgaagatttaattccatttatgtcattggatttgtaaaaaaccccttttggattcaaagatgaaggcctcacttactttatttttgtcattttcacagaccccttatgtaaatgcctcaagagtaagaatcttgctcaagtgatttttgtatctccaatggctaacaaggagcctgacatagagtagctgcttggtaaatatgtgttcattcattcaacaaatacccccaaggtacaacgataagaaaaataactatagtcctaatactgatcacctctgcagttgactggaagagacagttaaaaagataagtacaaataaatgtatcttgggttaagtgctataaaggaaaagaacaggttcaatggaaggaaaaattagaattgttgatacatgaatggaagtaaatgacccggacttccaactctaaatctctgtctcatttcacctctttgtaaataatcattgctattatgttaaatatcacaactactgtcatttcttgtttacccactacattctaagcttggtgctgacatctttgtatttattatataaaattctcaaaattactctgcccgttaggctttcttatcacttattccaaatgcaaaaataaggtccagggaagataattatgtaacttgttcatgattggagagctaataagtgtcagagatgaattgaaccaaagttggtgtgacaaagcctctgttttaagcaaaagggaaaaaaaattctcattaactccaaggattatcatcaggagtccaacagggttcccaatttgggaactactatatcattatcatatggcaaatggtccactatgttagatgagaggacaaaaaaaaaaaaaaaagttgggggagaaactttgctgtagagtgggagggaaaaagaggaagatagtcttcttgcatgggccgtcttatcagcctagcaataataaactatcaccatagcaacaggaagtctaattgatggcagatgttgagccactttaaaagccacgccaactgaatgccaagctgatgctgtaaacctctctcctctcccgcggctagactaatcatgctatggtcatattggagagacccatctttcaagggtggaagaaactctggacttggcatcagaagacttgagtctgagcctcacatctgcccgtgctgagctctgttgccttgagcaagtcagttcatcaaaagtagaagatagttatcattaattttatcatcattattactaccagtagtaggaactctctgaaattcaatttcacaatctaaaagatagataatatttgtgtaagcatcgtcagaaggtttaaatggaataaaagatgtggaagtgcttagtaaactataaagtaattcacaaatacaaaatattaacaccaagagacagcttgacgtgctagaaagagtttgcattggcatcagacagatatggctgcttacagactgcttcatctgaacgcatcacttacatgctcagcctcagttttctatcagtaaaatttcttagtgtaaatctgtaaaatgttctacccatgttacaaacctgtggcttaattaacctctctacacttcagttactcctctgtaaaatggaggtggcactggcacctccctcataaggtcgttgtgatgattaagtaagttaatacaggaagaacatttagaacagtgcctggcacaggcagcgtgtcatacatattaatggtggtaatggtagtggtggtggagaagaagaagaggaaggagaagaggaggaagaaagagcaattgaaatcatatacgtgcatagaactgtgaaagctggtggtaatggtagtggtggtggagaaggagaagaggaaggagaagaagaggaaggaagaggaggaggaagagcagttgaagtcatatacgtgcacagaactgggaaagctggccaggctcggtggctcacacctgtaatcccagcactttgagaggctgaggccagtgaatcccttgagcctaggagtttgagaccagcctgggcaacatggtgaaaacctgtcactacaaaaaatacaaaaattagctggatgtggtggtgtatgcctatagtctcagctactcgggaggctgaggtgggaggattgcttgaacctgggaggcagaagttgcagtgagccaatgttacgccactgcactccagcctgggcaacagagtgagaccctgtctcaaaaaaagtaaatggccgggcgcggtggctcacgcctgtaatcccagcactttgggaggctgaggagggcggattacaaggtcaggagatcgagaccacggtgaaatcccatctctactaaaaatacaaaaaattagctgggcacagtggcgggcgcctgtcgtcccagctactcgggaggctgaggcaggagaatggcgtgaacccgggaggaggagcttgcagtgagttgagatcacgccactgcactccagcctgggcgacaaagcaagactccgtcttaaataaataaataaataaataaataaataaataaataaataaataaaatactgaaagctccatgtgatacaagtgaggacctccatagtcaatgtcaaaatacttttggtcagttcgtggactggttcacatgtcttatcagttttctcaaagtttccattgtctacatagccttttttgtcatgcccagtatgcatgcctgctctgatccttggctatgaagttttcaatgggaaagggacaaccaggacaaagaattggtagaaaccatgagaaatattttctcagagaccaaggtctccacaggccaggatttctcagagtcttcttcgatatattaaaaagtatttctggaaaaaattagtttgaaaactgctatgatgttcaagataactaggtgtcttttttttttttttttaaagagatggggtctcaatgtgttgcccaggctggactctaattctgtgcccaagaaatcctccctcctcagttttccaggtagctgggactatggatgtacttcacagtacccagctctaactaggcgtcttcatagcaaggcatctgttaagactttaaaatgtaaacatgcattgtgaatctcccaggttggataggcatagagagtatggtgtttcccaaatttacttgatcgaagaattagtttttcatggagcatcttactttgctaaagtttcaagtaccaaaattgggaaatgttgatgtaagcccatagccaagacaatcaagccttaagcatagtaccacaaaacaggtttgaaaactcctactaatccttccatcaattcatgtatctatttaacaaattaaaagagttctatatgtggcagtgactatgtgctagatggtggagaaacaatgacaagcaagactagtatattctctaccctctcagagttctggtgggcctactggggagagggaaaagttgcccactaattttattgcaatgacaagtgaaaagatggagaggacaggtgccatgacaccgggagcagcggcttcttacctaacctggtgggtcaaggagagtttcccagggaaaataacttctaagtggagacccaaaggaggagttacagctgtaggacacataggagcttgcaacacactcgcccatgcattccatgttgtatcctcatgacaacctttcttggtagatgcaatgagagtggtaaaagttactaagtggtcattacgacctaatgagttcctactcaatgagtcaggcactgtgctaggcatcttacaaatttattgcatataatcttgacggcaatgagcagtatcctcagtttacaaatgagaagttgaggctcatgggagataagtggtttcccaaccctgtacatgtagttagtacaaaaccaggactttcagatctgcctgattccaaagcccattacactgtggtcaaccagtgctgggcctggaccgtggctggtccataacagggtttttactagtcagaaatacggaagagtaagcagaatgtcatgagttcttccttaagctaatttttttcttcttaaatgacatattatcctgagatgtccccctcccaaccatttgatgtagaaagtcctgtgggttttttttttatatattacttgtcagagaaaactttgagcttcttcttagcaaaataaaaactttctaaccatatgtcagtctcccaagtcattttggaagtgttgccatctatgaaatctaaaaatcatggaagttctgtgtatgcaactttctagaacatattccttctaaaagtgagagaaatatgaaccagcacattgctgtgagttctgctggttcaaaattggatgagttgctgaattccatgggcaccagcagccaaaaatggagataaaataagatcaagtgtcatcttccaaaatgtacagacataccaccagtgacattcaggcattctacgtcctggtttatagacaccctttttctaagttttaatagatactagaaaagtacctagcattaaacctgggttttcatgaacatttttccctagaaaattttaaaaagaaagaaaagtttttttcccaggacttaaagaaatattttatgactaatcaatactataggtagtacttgagaaaagaaaataattgtgaagataggacctgaattactaaaatgtgtgaaatagtacgataatatgtataaaagtgcctcatgcataaaaggccccagtaaatgctttcttcctccctgattcacatggtgagcaagtggcgggggcccaggactaaacctcatagcatcagactcccagtccagtgctccttccaagaggcctttcaattgttttctttctgtctacctacctcacactgtgtccttcatctctctgtctagcccccaggaaaagtgcagcaagtgcaggtatttctgaaatgacgagtggctcgcaaaaaggatctgatgagtgttaatagtaagcaatgtgtacctaagagtgtagacactattagcatttggaaaaataggaatctgaactgagaactggaagggcccttagagatcatcccacacaaaccctctttttacagatgaggaagttgagacccagaaacgggaagtgctttgtgcatggccagagagctcgttgctgatcaaaccaggacaagcatccatatgaaacacgcaaatgtaaaattacatgaaaaaaaaaaaccctttacctccagatgtactgctttccagaaaagtggcgaggaaataccacaaaaatacctttacttcaaaaaatttgaaaatgttgaaggtcatgcttcatattgtgccaggcaagagaacattgtacataattgtaaatcaccattggaggaggtggtcctggttgtattcttttgtttgtttgtaatacacataacataaaatttatcatcttaaccatttttaagtgtacggtttggtggtattaagttcattcacattattgtgcaaccatcaccaccatccatctccggaactcttttcatcttgcaaaactgaaactttacccgttaaacaataactctgcattgccccctcccccaacccctagcaaccaccattctactttctgtctctgtgaatttaactactctttagatacctcatataagtggaatcatacagcatttgtcttttgttgactggctaattgcatttagcataatgttctcaaggtttatccatgctgtagcacgtatcagaatttccttccttcttggttgtattcttaatgcaacatagcttgttctctgtgatctgctgattataaccatcgtcgctgtgaagactttggcgtgcttaacatttttgtgacttctttccagtgggggaaatagatagctcagttgtggacgatagcagcaatgggaagcagtatttgagaagaaatcagactctcttcttccagtcttttgcaagtaggtgacacaagaggtaaacagaattgcatgctgtgcccctccacatcaccccctattttctttgtttcttctgcccaaggcttcagtcaatcagagaagcaatgagagttgaagattttaaaagtgggttttcaaataagacaagcttgggttccagtcctacctctgaaacttactaaatatgtgatcttgggtaacgtgattgaactctctgagcctcagttctgtaatctgtacatagagataataatacttttatcaaaaaagcatgtcttttttttccttctgattgatgagatgctttctgtattttttctggatttaaacatagtttccaaagttaaaatattaatagtacttttccctgtcccattgggttgtttagaaatgtaatgtgatatatgacattttggcctctctgagatgtcttgttccagcccaaagattattagggaacctcatgtcatttgaaaggggagaaagataatttattgataaggttctgcatgtcatatgtatcatttttttctcatcaaaaacactgagtagaactctattatgatacttggtcctttacttcatacttttctatcttcccagctagtcagaaccatgcccaccccgcagttcccaccccttggtcagtacctagcattatgcccagaaaaactacagatgcttcttcacactcccctccaacccccacacccccattaccaaagtgtttctataatgctctgggaatcagcatctcaattcccccatggcctcatggttaaacataccattcattcgacctctcaactgtgacaaagaaggaagcctgggtgtagaaactgatttcagctcccctctgaagttgggcgtctctctttgctgaccacttgggaatttttttttcttgcttctgacccacctctcccctttcttttgataaacaggacagctgtccccaaagggatgaatccattacctttcaccagagttgagttcgttttccatttcatctttctgcttaaagagaaagccctttaaaagcgcagcgcatacattgagtgcgtgtacttaatttttaatatgtgtgtgcccacagccaagagaacagagaaccttaaataataatgaaactgaattgtacatgtcgtatgttttatgtggcactgattcctaaatatgctcctagcagccaggtattatttaatacatccccattaatcaagctgccaaatctaaatgaaaaccatgtttaaatatgtttaataagattatagcttttggttgaatatcaaactaacatagctacatttttccttccagccagctctcatttactgtcttacatttttactctgaaagcttttgtactatcaaaccaatcttgattataaaacaaattataccacaaacttttagtatcgtgagcttcagctgagtccctcagtgtaaatgttaggagaaagaacagttctgagattttttttctggctaaaaaatgatatttttcttcttcttggggtgagcctttgagtttaaaaggaaattaaaaattcaattagagatactaaattgtttgtagcttctgtattaaatgatgtctgccttttgcatagttattgaaagtgtttcatattaaatgtactttttctttttgacggttcaggcttctgttagttttgcaatagtgacacctaggggctgtagagaacattgcatgggctgctaaaatctcaaaaacaacccctctgctcttttgccatggatagaaaaagtatttgtgggtcattggggctgatggagaaagaaggcaaatggtaccctgggcgaggtaggtttccagttctatttaccaggcttccaatatgcaaacaaaaaaaggaggtaaataaaaagaggtttttataaaaataaagaactagctgaacttggagtaacatacagtattctagcagatttttaaagttattgataaaacaacatcatatttattaacatgtttaattctcgttcttatttgcaacagtttgcctgctgttcttgcctttgtaacaggcatgtcccgcgttgattgcagagaagtgatgactgtatgtggtgctttgacttgttctgtgcgaatgtctcgcttctcacatctctaattcttctatttgccttgttcaatattctatatccatattcacccttataaagttgtcattgagacttttagcctatttgttctctccactgatatcattatttcttctagcttctcagagcccttacattttctccatgtttatatggcttgaagcttttaaattcttgatcaaagcaatcataaatgtgtctgttacaaacacattaaaattcttcgattatataaaaactgacaaacaagtcttataaaactgtttttgtactacattaagttcaaaataggtggcacatgtttaactttgtacactgtaggaattctaagaatcatttcaaaaagaaaaagcaaatacagtgcacagcaatgcatataattcttatagatgagtattatctatctgtcatatctctctgtaaataatgatggtgacaatgatgataggcaaagtttattgatgttttttatatgccaagcactgttctaaccactttgcatgaattaactcagtcaccatgggacaggaactgttattatcccaatttttacccacattcacagaatgcttctgtgttccaacaaggaaacttcaacaaagtagtgcatgagcttatcacaggtcgtgtgcaataagagtttatgttattagtttttccttgaactgcttgggagtcagtgtcacttttcttagccccattagcctgccctccctttggagtgtgcacgtctcctttactgtctgatacctgtctgctttcctcactgagtgcctctagctttgtctagcaacacctgccctcatagaacttacattcagttgggaagatcctaagaaacagcaatcacaacaagtaatattgatttcaggtaacaagaaatgttacaaaagaaagcaaagtgatatcagggagcaaaaatggaatgacagactgggtgtgaagggctggctttgtgagcaggagagaggccctcctgaggaagggatgttcgtggtgagtcccaaatgacagaaaggacagcaagtgcaaaggccctggagtgggaatgaattgaacatgtgtgaaggaaagcaaaaaaagcagggaggctggaatgtgttgagtaaggagaatactgtggggctcctctctctttcctttctctgctgccaacacttgtgttttctgtctcagactctagtttcactgaattcaaagaaatggtttggaattgcaaaatcctgagatgtcatccactgggagtgctggggatagggggacacgtgcaagagaattggcctaagaaaggttataccctgagtatcttccatatatacccatagccccacacatttttatcttgcaaagtcagttaagatgaacataaggcagaagtggaatcccagcacagttcatcctcagtgctccacagcacggaacagaccttggatatcgtacttcacacaagtttggtgactctttttttatgtctgcctctccactagactggaaattgactgaggacagagcttatgtcataatcattcttcagtcatttttctttcttgcattcattttatcagtaaatgcttcttgagtgccatctgtgtgccaaccactcgtactaggcccatctatctctgcttggataaaattccaagcaagaaagatacagtccctgctctcaagtttccaacagtattgcagaagaggcataccataaaatagcatcatacagtgtgctatgcctcagctttggggaggcagagaaaatgttccaaaggaagtgacagttgagtccagtcaggacttggaagtataaataaaggcgagtatatgtctgtatgtgtgtgtgtttctgtgtgtttggagaggggtatgcatgtgtagtgggcccgagatgggagagaatgtgtgcagaattttaaaccttgggaacaaaggattcatgaactcagaggtgaactcaactgtgtactggatgaaaatgtgaatgaatgagtacatgaatgtataaatgaatgaatcagtgagtgagtttttcagaggcagctcatgaaatggagattgtattagcgtgtttttacactgctataaagatactacctgagactgagtagtttaaaaacaaaaaaaggtttaactgactcactgttctgcatgacttacagtcatggtggagggtgaaggggaagcaggcaccttctttacaaggcggtaggagagagagagcaggggaaactgccatattaaaaccatcagctctcgtgagaactccctcactaccatgagaacagcatggtggaaacagcccccatgatccaatcacctctcaccaggttcctccctcaacatacggggattacaattcgaggtgagatttggatggggagacaaactatatcagaggtataaagccaaaaggcatttttattaatttaccctgagaaatcactattccaaattctgcccattatttccatgtaggcagactcatatggagacctatatctttatcaaaaatgtgcttgtcaagtagattattcagtgacttattgggagaaaaggttaggcattcatcttattgtagggatggctttatcaatggaactgcatatagctgatggccaatattcatctttatcctgaacattgcttagatgagaactatggggtaaacaaatgagtgaaaaaaataagttaaaatgtcaagggtgttcatagaagagagagaggctgttaatgtggtctagatgccagaggtggagagctggcttggaaagtagggactagattctagtctttgctgtactactctcttgtgtgacattgagcaactagccatcttcaaacccgtaaagtggaactatgccaggcaatgtctaaatttagtctctatcagctctagaattttgtgttcatcttagttatacctgctgaggagggagaggtattgaatgtgtatggacaccagctgggcagcttcctcatggtccctggatgacagctttgtcctggggcactcaatcctccagagtaccttaagaagctgtcctaatctgccatacacttgggagggttctggctgttaaccacctatgttggacacactgctgctattctccttccccacttttatctgttattctaaagtgatctgagaatttggctattcctgatgttgccttttcttatactccacgtagggagcctctgctcagagggttattcgtaaaaattaatgagatacatgtaaagcagccagaacagtacctggcacatgaaaaatagtttaatactatttgtcataattattcctgcagcccttcattgttgcctttcttcctcaggtattttctgccttgttctccaacaagcacaagggatacaggggtaaataggataccatctctgtgctgaggggttttgtccagtgctatttactgagtgccttccatgtgccaggcactaaggttaaatcattaagcccccaccacaatccattgcaatactcattatacccatttcatcttccaggaaagtgcatcccagaacagaaaagtcatgtgacattcccagcatcacacaattagtaaatggcaaagttggaattggagctccagtctcacagactccaaatccagtgttctttccaccatgtcacccagctaccacaaggctgccattgcacagttttgaaaggacaaagaagcagcagtgcatgatggaagtcagcataatgggaaataagctctccttccctgggcatctacttctaacttgcagaagaataggaaggctagtcttgtgagcccagctcccagcagtccttgctttagcccatctgaaaaggatctgtctttaaaagcaaggagccagaaaaaataattcatactaaaaacaaactctgtcatgagtcatttgactttgctttcccctgaacacatagtttatgtcttgggtgagctaaggctaaaggaacatctgatatgttttaggctagcagagccattatttaaggaacttcacatccaatgtgcgcccattggaccctatggtttaaatcaagtcttctgcttatggggcctgacaatttgttattcttgttgtagttgtattggagtgtgattgtgtacatgttttatcaagatgacaagaatcactctggttcatgattcaaaagttctcaggctgttgaactagcctatgcagtagttactctgagtatgtgcgctagacaggaatgtgtatatgtgcgcacatgttcagatgtgtgagcacttacagaaagagaagagaatgagagaaaggcggattccagctgagcatcttaccattcctatcagcagaagagcgacccagccctggggctgggtcagaggatttctcaatcctgggagaacagcagataaccccgagcacaaagcaagtgtttctgtctctgttgccaacttgcttttctttagatcattgaaaaatgacaggaatacacttactctgtaaaagcacgaacaatgtaggaatatatagagtaaaagcaaaaggcacaaacctctcctgatcccaaaagtaatcactattatgcgttttgtatgtctgtcttacattttttatgtattcacagacatatatatacacatatatatcatatagtagagattgtataatagaatactatactgtttaaatagtagaggatgaaaaagagataactttttttatctacaagatactttggaatatattaatacatataaagctgccccatgtctattacatgctgacagtaattccagaatctgcatatataaaaaactgtttaaccaatgtgttgatagacctttaggtagtttctagtgtttagctgttacagagacacaaagattattgttggtgtagttctttatatacaaatatgaggacttcttttagagaaatacaaaaaaaaagtggaatttctagtggaaggatttgtgcatttaaaattttgttagctgtggccaaaatgtcctccaaaaaagctgtcccaattcgtattcctgccaatgatgtccctgtgcctttgccaatgctggatattgtcagttgtttaatattttttgccaattttcgggcagaaaatgactgctcattgttcttttcctttgcctttccccattactagtaagaatgaacattctctttatacccatcaagtacttttctgttaatggcctattaatatcttttcttcattttcctatagggttgtttgtcctttcctcattgatttagaggagttctttatctgctctacataccaattctttatctatcattacatactgaagacattcttatagtatgtcccttcttatctacctttgcttacaatatctggtaccggagttttaaaacttcataaacttttatctgtgaatctctttatgacatcagaatttcttggaaatgttccctttaaactatttctttacttgaagctgtgtttttcagactgataatgttttagacttttatgtgcccaagagtaaacttttatgtgcccaagagttttagacttttatgtgcgcagtaaggactgaggaggtgagtgttttaccaagggcaaagctgagatcagaacataccaggctggcaggtccctgtgtttgttaaagacattcttagtaattttatcattaattatggggaaattctaaaactccattgggatcagccacaggcaaatgagatgctgcaagaagctggatactgagcatgcagcctgaagtcatctgagcgttggatcataaccagcttcctctacttaccacttgactttgagacataactttgcttctctgagccttagtttatttctctgtagaatggagctaatcacaacttcaaatgactattgtgaggtttcacatttcccatgtttcagcacttggtatctgctcaatacatgtttgcttttgccttttctggttaaagaccttttttcccctggacctttgaatgcaactggtcatctaaaactattgacttccatctcttctgaggatttttgtagccaaatggtggaggcatatctagcttgagagtctgaggcaatttcctgatgatacatctcagtgggcctaaaggaaacgaaacacctacaccattgctcaatgctggaaaattctccacagtggccgacccctttaggaggagggaagccagggctctggggaacagctcctgtctacgtgggtggagagttctttcttcaagcattgtggatcgtaaactcactgagcctcctgcctgtacaggaataaatttcccctgcctttgagatcatctcctcttctcctcacctcaacctggcatccttctcttcttaaggcaacacagcactagaggctgactgcccagcctcttgagccagacttcctggaattaaaacccagctctgccactctttacttgtgaggcctggagcaagtttcttaattactctctgcctctgtttccctggctgtaagatgagagtgctaatgttatctacctcacagagttgttacatgggtcactatttataaagtacttggcacatagtacagtactcagggagctactaataaatcatatatggtatctgaatttgggcttctcatttcacagccaattgactttggataatatgcttactccaagctcagctctctaatttgtaaaatgagtatgaaaatatctacttcatggaattgctgggcaagtcaaatgggataatgtgtgtaatgattgtaggtactcaagaggtggtagctactgtggtgatgagtatcaaaaaagacaggaatgaatatacagagactatcctaattctcaaaagccaagagactggtagaatgtggcctccacactcttagccctgtgaccttagacctaacctcttcaacattcagtttcctgatctgtagaattagattgacaatggtgcctacctctaggttcatgatgaagaaggagtaataataaattgggttcatagaaagtgcttaataaaattaattattattgttacctgtatctcctgtccatttaagggaagattcctatttgtagtcaggggtccctgggcagaagtgatgacagcacaggcagagggctgcaccccctgccctctccaactctggggatatagcacaaggtaagaaagagaagcaaatctaaggaagggaaattgagatcaaagcctggtttctatggatcaggccaaaatgattgagggagagagagaaacacaactcaggatgtccatcaggatttatctgcagcagtgtgtctcattttaactcttaaaacagttttgttggataggtactattatttccagttttgcctagcgaaactgcgagctggagaggttaagtgactcgcctaaggtcagatagctaaaaagtagaaaaactgggatttgagcccaagtctgtccaactctaaatccctaatgatatgcttttaatacatgccttgcctctgctgggaatgactcagaggccaagctgtaggaggagggggagagagggatgactgtgtttctcagggtgaacagagtaggcagccacaggggcagtaggcccggagctaacaggccttcatgtaaaaatttggaaattttgcctgaaagacaagagagtgttttcagctgaggccgttttcaactgtaccctgtgtactaggctgagggtaaaccaaaacacagccataaatagttctccacagaattctcgtcacaacagcccactgtattccttctgtttggagatgaatgttgaaacaccatgcatgaaaatggctgagtctgttgctgttcatgaagtctagtcacagcccattcaaatgaagcccccttggatgtgaatagagatacgagaatcagcagatgatcagccatcatggactcttgacaaatggctttgcccaaagaatcggcatccttggacttcatacaaagcaggccttcccaaagcctctgttttgaagggacccagtctgtttgaataggtgtttacccacttgctacagaatatgtttgtatacctgttctttaatttaaaaaagtatcaaagctagaagggactttaacaagtcatctagtccaatgcatttaaaagaaggggacatttggttccagagtaggaggtaactgtcctaaggttatatagagagaatccgagatgaaatccagggcctcctgtttcttagtctaaaacatgtctgactctgcccttgtgaatgcagccaatacagggacaaaaagtctttgggcttctctaaagggagggactgcaatgtgttagaaatgggaaggaggttatgtttgcccttggtgctttctacctttcccatctattcttttcctcccatttcattttttttttcctcatctgtcagaactaaccagtctaatgtgctcaattttcattccctaagaatcagactcccagatttccagagttactgctgtttacctatttcagagcttttccctacttcaactgggctgccttttgaacaatgaaagggaccctagaccaggggaataccaggctcggcccctattaagtgggtctccttggttaagacattgcctacccaagtgtcaattctcaatctctaaggtgcaggtgagaaagaggaaagggacaaatagtaattgatcacctgatacatgctgaactctaattatataaccagacttaatctttaaaggaggttatgtgaggtgggtagatattattatcttcatttgcaaatgaggaactagatttctagaaaggtaattcacgttctcaaagccatggaatcagaaagggagagagttgggacctgtacctagatttgtctgaaaaatccaaagtacaggttgagcagcgctaatttgaaaatctaaatccaacatgctccaaaatctgaaactttttgagcactgatatgacacccaaatgtcatgctcaaaggaaatgctcattggagcatttccagttttggattttggattagggatgctcaaccagtaattatttaatacaaacattcaaaaatccaaaattaaaaatacttctgattcctagaattttggataagggctcaaccttttaaactaaacctgtttaagctgtttcaagtttgccaagtaagagaaagtgagatgaatatatgtgttcatacacacacatacacacacacgcgcgcgcgcatacacgtcctcactctgtattagtccattttcacactgctataaagatactacctgagactgggtagtttataaacaaaacaagtttaattgactcacagttccacatggctggggaggccgcaggaaacttacaatcatggtggaaggtaaaggggaagcaggcacattcttcacaagacagcaggaaaaagagtgagtgcagaggaaactgccacttttaagccatcagctggcatgagaattctctcactatcacaagaacagcatgaggaaaccacccccataatccaatcacttcctaccaggtccctccctcaatacgtggggattacaatttgagatgagatttaggtggagacacagaatgaaactatatcacacacacacacacacacacacacacacacacactggaagagtgctttccaaactatgaaatgccgcccacaggtggacaattagccacccagtccaggccaagaatgaagtggctgtcagcatgccacagccatcacacaaggaatctacttgcaagtgagaggagcggaggaaacatttagaggcaagcacctatcagttaggtcagtagttctcaaatgtcactggagggccactgcaggcagggctggctacaatttgtatatcccccaatttgtgggacccagtgcaaaatgaaaatgtaggtccctgaccagggacaggaaagtcactccttccaacaggccttctgtctcaacctatggctgacaggtgacttccaaggctttccaaattctacatggaacccctctgtgtgttgtcagcctgacactccatggcagtggtagccagctggggtcactgccttgacccaccctgagacacagggggcccaatgtctggcctgactctttccacacctatgctcatctttatgaggagaagagcaagagcaaaacatgcccccacccctagccatgtaaccctgccaccaactcacagatgtgtggtcagcagtgggatggggcagcagaagacagggagtggatggccaagaactggccctggagactagccccattgttccatcaatttttcacctataaaacacagattcaaagataaaataggattccttatttaataaatggtgttgggaaaactggctagccgtatgcagaaaactgaaactggaccccttccttacatcttatacaaaaattaactcaagatggattaaagatttaaatgtaagacttaaaaccagaaaaaccctagaagaaaacctaggcaataccattcaggacataggcatgggcaaagacttcatgactaaaacaccgaaagcaatggcaacaaaagccaaaattgacaaatgggatctaattaaactaaagagcttctgcacagcaaaagaaactatcatcagagtgaacaggcaacctacagaaggggagaaaatttttgcaatctatccatctgaaaaatggctaatatccagaatttacaaagaacttaaacaaatttacaagaaaaaagcaaccccatcaaaaagtgggcaaagaatatgaacagacacttttcaaaagaagacatttatgtggcctacaaacatatgaaaaaaagttcatcatcactgctcattagagaaatgcaaatcaaaaccacagagataccgtctcaacaccagttggaatggtgatcactaaagtcaggaaacaacagatgctggagaggatatggagaaataggaacacttttacactgtttttgggaatataaattagttcaacctttgtggaagacagtgtggcgattcctcaaggatctagaactagaaataccatttgacccagcaatcccattactagatatatacccaaatgattataaatcattctactacaaagacaaatgcacatgtatttttattgcagtactattgacaatagcaaagacttggagccaacccaaatgcccatcaatgttagactggataaagaaaatgtggcacatatacacaatggaatactatgcagccataaaaaagaatgagttcatgtccttcgcagagacatggatgaaactgaaaaccatcattctcagcaaactaacacaggaacagaaaaccaaacaccacatgttctcactcataagtggtagttgaacaatgagaacatatgggcacagggaggggaacatcacagactggggcctgtcaagcagtcgggggaaggggagggatagcattaggagaaatacctaatgtagacaacgggtcggtgggtacagcaaaccaccatgacacatatatacctatgtaacaaacctggatgttcttcacatgtatcccagaacttaaagtataatttaaaaaacaacaacaaagaaagaattgaaagaaattgactgcaaacaattaatgcccagcttgggctctttctggatagagctctgtgcattgcacgggtgtattagtacattttcatgctgctaataaagacatacccgagattgggcaatttacaaaagaaagaggttccatgtggctggagaggcctcacaatcatggcacaaggcaaggaggagcaagtcacatcttacatgaatgacggcaagcaaagatagagcttgtgcagagaaactcccatttttaaaaccatcagatcttgcgagacccattcactatcatgagaagagcacaggaaagacccacccccatgaatcaatcatctccctccaggtccctcccacagcatgggggaattcaagatgagatttggatgcggacacagccaaaccatatcattccaccctggcccctcccaaatctcatgtcctcacatttcaaaactactcatgccttcccaacaatcccccaaagtctgaactcatttcagcattaactcaaaagtccccagtccaaagtctcatctgagacaaggcaagtcccttctgcctatgagcatgtaaaatcaaaagcaagttagttacttcctagatacaatggggatacaggcattgggtaaatacagccattccaaatgggagaaattggccaaaacaaagggtctacaggccccatgcaagtccaaaatccagcaaggcagtcaaatcttaaagctacaaaatgatctcctttgactgtgtctcacatccaggtcacactcatgcaagatgtaggttcccatcatcttgggcagctctgcccctgtggttttgcacggtacgacctctctcccagctgccctcacaagctggcattgagtgtttgcagcttttccaggcgtgcagtgcaagccatcagtggatctaccattctggaatctggaggtcggtggccctcttctctcagctccactaggcggtaccccagtagagactctgtgttaaggctctgacaccacatttccctttgcactgccctagcagaggttctccaagaggacctcacccctatagcaaacttctgcctgggcatccaggtttttccatacatcttctgaaatctaggcagaggttcccaaacctcaattcttgacttctgtgcactggcaggttcagcactacatggaagctgccaaggcttgaggcttgcaccctctgaagccacaggccaagctatagggacgcagggcaccaagtcctaggctgcacacatcatggggatcctgggcccggcccacaacatcactttttcctcttaggcctccaggcttgtgatgggaggggctgccatgaagacctgtgacatgccctagagacattttcctcattgtcttggggattaatatttggctcctcgttacttatgcaaatttctgcagccggcttgaatttctcctcagaaaatgggattttcttttctattgcattgtcaggctgcaaattttgcaaactttcatgctctgttttccttttgaaactgaatgcctttagtagcacccaagtcgcctcttgaatgctttgctgcttaggaatttcttatgccagataccctaaatcatctctctcaagttcaaggttttacaaatctctagggcaggggcaaaatgccaccattctctttgctaaaacataacaagagtcacctttgctcccattcccacaagttcttcatctccgtctgataccacctcagcctagactttattgttcatatcactatcagcatttttgtcaaagccattcaacaagtctctaggaagttcgaaactttcccacatcttcctgtcttcttctgagtcttccaaaccgttctaccctctgcctgttacccagttccaaagccgcttccacatttttgggtatcttttcagcaacaccccactctactggcaccaatttaatgggtgacacactcgtgcagctggtccccactgcaggtccttcacaaagcttcactagtccatgagaaatgaaacaataaggacagggtattgagattttaacaaaattaaatgtagactatttaaatgattctcctttattctgatatcatgataaccacttttttggtattaaaatctccttttggttatgaaataatggtgagagtaaatatggagcagttgctttgtttaaagtccttatataatcaaataaaaagctgacaattatgttgtagatctccaaaaagtttgaatattttattggtccaaagtttgagaactcctactctaagactttcaagaagatggcccttcccacatgtggggctggaacctcttcccctttcactatcatcagaaaggcttccgccctggatacaattagtatttgttgcatacttcagtattttctaggtatatctttgctttttggaagtctaaaacatctggtagaatctttcagaagaagcaacacagaatagaggcattaaaatcaaaatttgaagtctgaaacttctgtttcttaccatcattaagagagaagtgcccaatgacaatcatttctccaaaccatcagcagctccttggaaatgaagtggaagggtgataatatatccaggacagacctagctaatgtcttaatcttggcataattattaataataacattccctttccttccaaaaagtgtctaggactcaaaggtgagttcattgggataataaactatggccaccttaaatgaaggccccttcagctctcctgagctagaaagtcccaaagagcctgctctttccctgggcaggaagccatggtgaccagtggaaggattatgtctgtcttaccagaggcctgggttgggtgccagcatgaagcctgtaggatctacttagatctgggacttcaaagacctagtggtgggtgaatctttgtggcttccatcattgctttgtctctgggagcatcaagttgaaggccaagctagtttctttcctttgatgagggaaaatatgtcaacacaatggtccactgaactctgggaatagacagacatgtggtgtctttgggggattatagcctaaatggttttactctggcacatgtggaattaaatataaaacaaacagctgattgctgttaaattcacatgcataaaaacaaccattactatgtcttctcagctacagtaccagagagtccccctagaatcaagcagttattagatgggactttggagtgagtgtagaaaagaaaaggaggaggagaaggaagaaaatgaggaaaagaggaagaggagagagaaataacaagtcaaataggtggagagttttgaaagttacaaagtctgtgccatttagcatgagttatttttcctttttattccttgtatttgacatatgaaaagaaatctttgctgatactggcttcagattctcaggtttaagtatgctatccttgacccaggaaagagttacatgcatcatacttccgaggccttcaaagaacaacttggagcaagcttgagagtttgcagggcattttggtgacatttctggatgccctttgtttccccctttcaagaaaagccctttctttcgttgccttctcacataacagcttgggattcttgtccctcccagaaatgcatttgaacttgctgggtttgttaagagtcagggcatgaagcatttttccatggtagaaaagttctggcattccaaagcagaactaatgtgggatttgggaagcttgccctatttgtgcacttaattagagctcaccaaaagcagctgatccattggtaccataaaaaaccaatgctgagaccaaggaaggctaagactgtgagtacccttagagggtggtgaacatgaattccacacctgttccctactgactggaatcaggattcaaaggcaaaaagttgtgtgctttccagcaacattcattgggatccgcagcccaatttaatcaattgataggttgccagtgtctaagtcaagtcccgaaacacttggttccccttgggtcaatgaaatttggtcttggttctaatacaaactttaagttggctaaaaatggctgagaaaactactggttttagagtcagtcaagcctgtgctctaagtctgactctgccactatgagatgtcagatcttggagaaactgttcagttacttctgagctttagtttgcttcccggtaaagggacatactaacacctattccatgggtccattatatacacaacagccaacatttgttgagtaattactatgtgcagagcactgtgctaagagcacagtctatgttaactttttaatcctcatacagacctaaggaaatagattctatattggagattggcaaactactccccacaggccaaattttgcctactgactgtttttgaaaataaagttatattgagacacaatcacatccattcattcacatagaccctatggctgctactgtgctacaactgcagagttaaataattgtgacagcgaccaaatggcccataaaacctaaaatacttactatctggcccttcatagaaaaaagtttgcctctgctttaaattatctcaacttaaagatgaaggaaataagccaaaggtattaaaacctattttaagtaggttagctggggccacaaagctggtaacaggtaggactaggatttgaatcaaacagcctgactccagaacttgtgttagtcaccagtatcttatatataatatatatgaaatgcctagcatagtacctagcacacaggagatacttaatacatctgttttattagcatggtattccctttctttttacctcctttcccagtttcctatcaattccagttaccttttgcttttcttctgcaagataattcagttaagcatatttctggccaattctatgcccatgatctcagtctatccaacaactctatgaggttggtatcattattttcatttaaaagatgaagaaactacatcttgatctctgagctcccaggaatctttgcactccatttggggaccctcagaggaaacgttgctaggaacttttggaacatttgttttatgcggcaaactagcatcaaagaaaaaagaatctcagtggctgcttgagaaaggattacaatctaattagggagacaaaaccaaaatactgagacaacagcaggcattttaaagtaagttatttagtacagacagtaagtgagtgtgaattcagagagctgggaacaagagagcggacaggggaggggagggctctcaagtttcctggtcaaatgtgaactgtgccttgaatgacagactgaatttaaaaaggagaggctcagattcaggcatgatggaagcgggaaaaggaaccacagatttcctgcagaaatggaagtgagagctctcagacggacagaatcagcaaatccctgggaactgtagaaaatcagaatgagtaaataatgtggtgacagattctacaggattttgaaggccagagagaggtacctgggtttcagaataacaatagtgatcatcataacacttagttgcaggattgctgaccacacacatttcacatatgctcgcccttaaccctccttgtccattctgtgatgtaggtatcatcctgttttacagatatgaaaattgaggcttagattatagcaatcaaaggttgatgggaaaattagaaatattctgcttacttagttcaacagtgcagagcttttgtgttgttacgttcttccttggatacatgtgcttgtcgttgagattttatagggtaatctatataccctataaacccatttaatataatcataggttctgcttgttctaatactgttacctataaacaattccccatggactcagatggaaagtgccatgaattaaagaccttacactacctggaccactctgatactgcccaccacaggcaatgggcagctatggcatggtttagagcataggataccataatgaaaaggatcagttctttcaacaaaggccggatgggaaagacaggaaggaggaaatcgtgtgaacccagaagtgtgatattcgatggagaggcaatcctgggatgaacacccagagcttgggtttgggatggctgaagaacttatgccaagaagagaaggcacacatgtagattgagaaggccatgaccagcactgcttaagtcttaccacttagtcatagttgagggacataagacttgaagtatggagatttaggctcaagtcctagtctcacggctactggcactatgtgaagaaggacggaaaaggcaagaattatatgctgattgagttatgcaatatattgtgtcttcccatcaatagcacttaagtatttctgtgtgccagcactttctaatttctcttctaatcgcttaacatatattaacttatttagtcttcagagaaaccctattagattgggggtattatcatcttctttgtatagctggggagactgaggcacagaaaaggttaagtaacacacctatggtcacacagctggtatgtagagaaactacactttgaacccatgcagtttggcccctgagtccatgctcttacttactgtcacattacctctcaggagaaaacaggataggtgttacgagcccagttttacagatgatgagactgtgggtccaagaccataagggatttgactaaagatcaaacaactaaacaaactgttacgctggcatttgaactaggtcttcctaattctgatccagacattctttctatcagatcacactgcctcctgttggtgtgaaagcattttacaaccataaacctcctcctgtttattaacacattattatgatagatataaggcttctctgattcagtaggaaaactaaggaggtagatcagccaagctcgtggttggtagtaataaagggcttgccttctagacggtgactccctccaggagagccaccaaccagttcctaacctctgtttcttgcagttcctacagagcctggcatggggcagagggtggctctctacaaatgtttgttaaacacaacttgttccagatagaagcatgtgaggctctccactaccaccagtggcatagcaggcacacccatgcattagcgacttgccctctgccaactcctgggatggtgatatgatgatggttctttgtaagcttgtcacttgtccctcttccaaagtgagtttacccagaggagcattctgaggttgaatttgtcccataccaccccttcacctacacattgacactccccgctgtataccatggggtcagagaccttgcactacaaaggccccttgccaagcgtggtattgcttgcagcctgtctgaggctttcactactttcccccagactctcagcccctggcctcctggctcatggccactcccagtgcccttagctttagcttcctgacccccctataactggcacccaggaccacttcaccagcttccttctcagaacaattgacttttgcccctggggtacttatacctcttttgttcaaggtcacaccccagctcaacacccaggatccaccctgccagcctgtgtgagagccatccccactagactttgaaagggactggacagtgtgttcagccaccttctcaagggcctgtccctggcagctttactggtcccacctgttcctagcctaggagctgccaatccaacaagatgaggctattctgggaagaagcaggaagacctcttcaccctaattgagtctttcttaacaaagaagtcaacagaacttttttttttaagtgttttaaatactgcacaggatgctacagcagttaagagcatggcctctggaatcagaaggatatgagttaaaaatccagttctgccacttgctagccatgtcatcctagggaaattacttaacctttctcaacctcggtttctcatttgtaaaatggagctaaaaaaggcccacattactaggtaatcatgagaattctgtgaaatgatatatgtgagcatatgtcacagcatgtgacaagcagtagatgctcaataaatgatagttattatcagcattatattaaatattattaaagtatcttttaagactttctggagacatttcattcagacagttatttattcaacaaacatttatcgagagcctgcatttctccagatccatgctgagtgcaaatatgggatgtataattatgtttataaaaaagagcggtgcatgttaatcacttactataggccagacactgttctaggcattttaggaacattctttcatttaatattgataagggccttgcaagttggcagaaattataattgtcattttagagatgaaaaaactgaggttcagagaggttatccccaaaaagacatgacctgtgattgagtgtggcatgcatcacccttaaataaaccaaaatattttaagttcaagtccccactattgagagatcgacaatttactcccatgtagtagaatgcctttatataactttcttgttaaagtcaaggtcagagcaaagtggtgtgatttcctcctcattggtaaaaatctctgtaagaggtgagtgttctcgtgcctttgttagcatgccagcaatgagcctggggtctctcctctgattactggggatttcatcatcattcaggataccttctctcattatgtgggactgaaaatagagatagaaaaggcaacaggtaaggggctcatagtgaactcacccaatgcatgctttgcaagttattttgttttttaagcaagtcccagtcatgatcttgctttcggattcatgccttatgcctgtagccattgaaagccaagtatgtcagggggaaaaaaaggtccttcagttagctgaggttttattctgtttctactttggtggtttgaaactaattacagactcggttgtgcctacatgtgcaaaatgaaatgagaggttgagccaattactttaataatgaagagaggaaaatccacttttctttccattatctaaagatttcaggcatatgtgagttttatatatgtatatattaaattatgtgaaaaattggcctcaagccttcatttcactttgcctgtctagaaacagactcaaattttgtttcggaaaggagatgacatgccttaggcatcttccaggagactagagggtcttgttgtaacaattgcagctaagattgattttcttattgttatgatgaatacttgtgcctgcctgggggagggaggtatattatgaaggatgacttttaaaaaaaggctggaatacctagaataaactttaggaggaagtttccactcatattatttattcattcatttatttagttcttttcaggacctgcaaagccctcctggcctggtgctcactccctttctaatttcatctccttctgccacttgcccaaactgccccagcaggtctggcttcgttgctctctttccattcactgagcacacttccaactcagggctttcaagcttacagttccctccgtgtggaatcatctttccgttgattttttcattgttcactccctcattcccttggatctctgctcaaatgtcattttatcagagagatgccattcctagtcaccctatacaaactgcctgctccacgcctaccattctctgtcccccttgccctacttgatgtttttttctccctagtacttaccaccatctgtgtgatatatgtgcatgaacttatgtgttattttgataaacatgaccatatattttattttaataaactttatttttagaagagttttatatttacagaaaaattgtgaagatgatacagagagtttttcttttctttcctttgtttttttttttttttttttgagacggagtcttgctctgttgcctaggctggattgcagtggcacagtcttggctcactgcagcctccacctcctaggttcaagcaattctcctgcctccgcctcccaagcaactgggagtacaggcgtgcaccaccacacccggctaattttgtatttttcgtagagacagggtttcaccatgttggtcaggctggtctcgaactcctgacctcaagtgatccacctgccttggcttcccaaagtgctgggattacaggcataagccaccacacccagcagatacagagagtttttctaaaccacatacttagttacctttattattaacatcttacattagtatggtgcgttcgttacaattaatgaaccagtattgatacattattattattttattttatttgttcaccagtttggaatgcaatgtatttttaaacagagtgaaagacacctgacaggtaactgaacaagttagcattagctgggcccaagattaaccaacttgtatcaacattcacagacttctgcagattccctgaggacagcaatatccaatagtgtttacttgttttgtgagcacagtaatagaagcaaagcgagacctttgttaattaaagcacatattttatgcagatttccttagattttacctaacatcccttttctattctagcatcccttccaggacaccacgttacatttagtcatcatgtctccttaagcttttctggcttttgatgaccttgacatttttgaggagtactggtcagatactttgtagtatgtccttcagttgagatttgtctaatttttttttttttcatgattggagttttggtcttttgggagaaaacagaagactgacaaagtaccattctcatcatatcatatcaaggatacttactatcagtgtaacttatcgctattgatgttggccttggtcacctaaggtagtgtttgtcaggcttctccactataaaattactctttctccttcctttttacactgtactctttggaaagaagtcactaaacacatctcaaacttaaggagtgagtgagaagtaagttacgatctacctcctcgtgggaggaatatctacataaatttggaattatgctgtttgggagatttgtctcttctcatttatttattcactcattcatctgataactcatacatatttatatttttggttataatccagtactactttgttttgttactcagttgttccagttgtagccattggcaactcctcagttggctcctatgaccctttgacataatcccgtaattgtgtgtcttgtgaggttttaaaaaattattatattcttactttctggcactacaaggcactttaggctaattgtgcatatttcctgctccagttctggaatcagccatttctccaaagagtctgattcttttttttgttttgttttgttttgtctgtgtgacggagtcttgctctcacccaggctagagtgcagtggcacgatcttggctcactgcaagctccacctcccaggttcatgccattctcctgcctcagcctcccgagtagctgggactacaggcacccgccaccatgcccggctaatttttttgtatttttagtagagacggggtttcaccatgttagccaggatggtctcaatctcctgacctcgtgatccacccacctcggcctcccaaagtgctgggattacagacatgagccactgtgcctggccagagtctgcttcttgttactggagactggtggttagacaccaagatttgggcactaagtgtgctcattgctcttgggctattgtcaatgcttcttggccctcccagctgaaagagcaaggaaatgtgtatgtaccctaacccatgtatatacccatatctataaatatttctgtatgtaatcatctttttgatattaagctaaacatgaattcacactggtttcctactgtaatctattgccacatggatcattctaactcgctctccttgcttatatttaaattccccctcaaataatgagaaatctggctcccaccatctgccatccatttacttaattattcaatttcagtatacatgtatagaaataccagaattgttaactcataccattgcagaatacaactttattaactggaagacagtacttatatacagttttcttggcattttcttgtttttttttgggggggggtggttgggggtttttttatctttagtttttcagactctactaatttctgaagttacttaggtcagcaccttaatcacccaccacacagagtgagatcgttttatacactagtaacacagttacattgtttttgacatactacattccatcatgggatcccccacctcctgaatttttaaaatttacgtacattaaggtttactttttgtactctaacattcagtggttttgataaatgcataatgtcatgcatattcaattacaatatcatatagaatagtttcagcaccctaaaagttaaaaatcccatctgggcatggtagttcacacctgtaatcccagcactttgggaggcctaggcaggcagatcacatgaggtcaggagttcaagaccagcctggccagcatggcaaaaccccgtctctactagaaatgcaaaaattagccaggcatggtggcaggggcctgtaatcccagctactcaggaagctgaggcaggagaatcgcttgaacttgggtggtggagtttgcagtgagccaagattgtgccactgaactccagcctggacaacagagcaagactccgtctcaattaaaaaattaaagttaaaaatcccccgtgttggccaggcatggtggctcatgcctgtaatcccagcactttgggaggccgaggcaggcagatcacgaggtcaggagatcaagaccatcctggctaacacagtgtaaccttgtctactaaaaatacaaaaaaaaaaaaaattagccaggcatggtggcaggtgcctgtagtcccagctactcaggaggctgaggcaggagaatggcgtgaacatgggaggtggagcttgccatgagcagagattgcactgctgcactccagcctgggcaacagagcgagactccatctcaaaaaaaaaaaaaaattcccctgtgttttacctctttaactttccctccttttttcccaactccttgacgatcactgatctttttattgcctctatagttctaccttttctaaaatgtcacataattggaatcttgctccacatacttttttagcatttggcattgttcgtttttttattttagctattctaataggtttatagatgaatgtcactgctgttttaatatgcaatttttaatggcaaatgatgttgagtgtctttatatatattatgtgccatctatatatcttctttggtgaatcacatgttcatatattttgcttactttttcactacattgcttgtttacttattgttgaattttaagagttctttgtatattcagatacaagtttctttatcagatatgtgttttcttctagtttgtggcttgtctttccattctgttaaaaatgtctgttgcagagcagttttagaattttagtgatccagcttatcaatttttttcatggattatgcttttggttttgtatctaaacttatcacctaacccaaggtcacctaaattttttcctgttatcttctagatgttttatagttttgtgttttacaattacatatgtgatccactttgagttaatttttgcagaatgtctaatgtcactgtctaaattcattgttttgcatgtggacatacaatatttcaaacatgacttgttgaaaatattacactatatcctttgaattacctttactcctttgtcaaaggagttggaaaaggaataaatcagttgactctatttgtgtctatttctggattctctccttggttccattgatctatttgtcttttctttccccaaccttacactgtcttaattattgtagctttacagtaagtcatgaagttgggtagtgtcagttcactgactttgttctttttctttagtattatgttgactaatgtagatcttttgcctttccatataaattttagaatcattttatggatacttaaaaatagttcgctgaaaattcaatttatttatttcatcagagttttgtaattttccacatatagattctgtgtacttttgttagatttatacctaagtgtttttgtgggggttttttttgttttttgttttttgttttttttgcagcatgctattttaagtgttatttcttaatcaaattccattttttcctcaatggtaattgctagaaagaaattgactcttgaatattaaccctgtatcctatacccttacttgtttgcttattagttccaggatttggtggtgttctcattgggtgggttggttgatttgttcattctttgtgattttccacatagacattcatgtcatctgagaataaagacagttttctttctttctttccagtatgtatgccttctcatttctttgtctttttgcactagctaagacttccagtacagtcttgaataggagtggtgagaaaggacattcttgctttgttcctgatcttagtgggaaagcatccagttttccatcaagtatgataatagctgtagagtttttttgtacatgttctttatcgaggtgaggaaaatcccctatattcatagtttgctgtgaatttttaatttttaatcacaataaaaaatgattgttagatttttttgaaatatttctccttcatttatcaacatgattatataattgtttttatttaatctgttgatgtaatggattacattgactgatttttgaatgttgaaccaaccttgtacacctggagtaaatcgtatttggttgtggtatataattccttttacacgttgttggattgatttgctaatattatattaagaatattttgcatctatattcatgagagagagtggattttggctttctttttttaatgtctttgtctggttttggtaatagggtaatgctgacctcatagaatgagccagtaagtttttcttctgcttattttcctggaggacatggtaaagaactggtataatttcttccttaaatgtttgctaaaattcactagtaaaaaccatttgggcctggcactttggtttttggaaggtaattaattattgattcagtttcattagtggatacagctctattcagatgatttatttcttgtgtaaattttgatagtttttgtctttcaaagaagtagtccatttcatctaaattatttttagttgccaatgttagtaatttgtaacttctctctttttatcttgattaccctggctaaaggtttgtcagttttattgctctttctaaagaaccagctttggtttcattgatttttctctattgctttcctgtgtttaaattcattgatttatgctctaatttttattatttcttctgcttttttaaaattttaatttcaacttttattttagatacaaagagtacatgtataggtttgttacataggtatattgtgtgatgctaaggtttgggtacagatcctttctcccaggtagtgagcatagtacacaataggtagtttttcaacccatgtctcccctccctcctgtccccctctagacatcccagtgtctcttgttcccatgtttatgtccatgtctgctcagtgtttagttcccactgacaagtgagaatatgtggtatttggttttctgttcctacattaatttgcataggataatggcctccagctacctccacgttgttgaaaaggacgtgatttttttcttttttatggctgcatagtaatctgtgatgtacatgttccacattttctttatccagtccaccattgatgaacacctaggttgattatatgtcttcactattatgaatagcatggcaatgaacatgcgagtgcatgtgtctttttggtgaaatgatttcttttcctttggatgtatacccagtaatgggattgttacattgaatggtagctctgttttaagttctttgaaaatattcacagttaaaatgaattacctaggaatatactaaccaaggaggtgaaagatctctacaagaactataaaacactgctgaaagaaattggagatgatacaaataaatgccaaaacatttcatgctcatggatcagagcaatcaatattgttaaaatggccatacttcccatacagattcaatgctattcctatcaaactaccaaaatgatttttcacagaattagaaaagcctattctaaagttcatatggagccagaaaagagcctgaatagccaaagcagttctaagcaaaaagaacaaggccagaggtatcacaatacctgtcttctgctttctttagatttaaattactatttttcccctccttgtctccaatgtctcttttgcctgaaattaatgtaactactacaactttattttgattagtgttagcattgtgtagctttctgcatccctttacttataacctgtctaagttaaaagtgggtttctttgtaggccttattcttttaatcatctctggcaatttctttcttttaatcagtgtatttagacaattcacatttaaagtgattattgatatagttgggttattatctaccatgtttgtaactattttatatttgtaacatttattctttgtttacctttttttcctcttggcctttcactggtattcatcaggcattttatgtgatttcattttctctcctctcttagcatatcaattatacttctttttttaaaaggtagtaatgtccctaatgtttgtagtatacatgtttaatctaagtctggcttcagataacgctataccacttacatgtagtgcaggtaccttataaggaagtactttcaattcctccttcctatccattataacattgctgtaatttatttcatttatccatttgctataattactcaatatattgttactattgttactttaaacatataattatagatcaattaagagtaaaaagatgaaatattatcatttaccttcatttatttcttctctgatgcttttcttttatgtaggtccaagtttttgacctatatcattttccttctctctgaataactttttttcaacattttttataatgtagatctcctttcaataaatttttatttgagaatatctttctttctctttcatgtttgaaggatagtttcattgggcatagaattctaggttagtgaggtttttcttttaatactttaaatattttactccattctagttttatttacacggttttctgagaagtccattgtaattcctatgtttgtttctctatagattaggtggatttcttgccccctttggcttctttcaaaattccctctttgtctttggttttaattttgattatgatttgctcagctttcgatattttcatatttattctactttgtgttctctgaacttctggatctattgtttggtgtttcttctttattttgggaaattcttagccattattacttcagatatttcttctgctccattctcactttgttatcttcatattctaaccatgcatatgttatacgttttgaaatttttcttgggtgtcctgggtgtttccctccattcttttttctttttgcatatcagtttgggaagtttttaactgatgtatcttcaaattcactgattctttccttgtccttgttaaggccatcaaaggccttctttgtttctgttggtctttttattattattatcattattattattattaggatttcttttagatacttttttagcattttcgtctctcgttacattgtccgtttgtgcatagtgtttactttttctattagaacacttattaatcatagttgcattaaattatctgataattctaacatttgtgttatatctgagttgggttctgattcttgctttctctctttggactgtgtttttcttgccttttagcatgccttttaatattttgttgaaacatggatatgatgtatctggtaataggaactgagacaaataggtctatatgtgacattttgtgttagaaattgaactgtgtttaatgtttgttatagttgtacatgccagaggcctcacattcttctattgtccttattttttcatccccactattgtctttggcgtccctaagatctcctccttagatagagtctatgtcttgctgctctttgagctgtaattcactaatattatactggggtcatgtcgatgtggttttaaggtatggggaaggaaaagcattctataatcttttgattatatctgtcttttagtgggactatgtccctgagctatgaccttcatagatgttcttaggcccctactcctttaggtgagacagaaggcttgcaggcactagagttgaagagatgtccttcccctgtgtgcaataggcttttgtaaagtctcttcctcttaaaaggtctttattatggagaactctgtgttatggaaaaacactgtaaaaaatattttacagtgtttacgctttccctccccctgccagagccaagaggggatcattcttgactctttggattcctggaggtaaaaccgatgaaagtgtgggcccccttccactaagactgttaccctcaggagttgctcgctttcctattagtccacactcagcccccaacacttcaaattaccactgaagtgtccctaccagtttatgactccagcagctgctcctccaagtaagatctcagctgtgactgtctgggttgtcctttctcttcagatttcagggtgatagtttgtcctgtaacctcagttctcttatggatccaacaaaaatcactgatttgcagtttcttagcttttttttttttttttggagtaaggatgggataaatgacttagacagtttttacatgttggagctataaccacaagtctctacatgtctttaatgtacttgctgactttccctactggaatgtaagcttatgaaagcaggggccatgtctgttttattcatagctacagcttcagtagccagaatagcacctgactcaaagtaagcgggccaataaatagttgctaatagactaattaatctcttggcagtcattgagcatattgttataccaggcactgtgcttagtgtggaaagacatcaggtgcctacattattacagtggtgtgggggcagggcatggtggacatacaactaaaataacaataaaccacagatcagagaatagggaagttttaaagcactgaggacacatacctcatctagcccaagcaagagggaggtagaggtaaagcattgccagagaagaaaaccatcacctgagttgagttgtaaacaatgagtagctgttagcctgtatagtggagagggacccagccaaggagacagcacagacctgtcaaagtccatgtcggacaacatgcaaagtgatttacttaacccacctcatgaacgtttagtagcccacgcaaggcaggcccctgttaactcacaggtcaggaaactgagcctcagacagtttaagtgactcgacaaaatgtcaccaatgctgagtgatggagcaagtcggcttgaggccaaggtccattttctccctgctacaaagatgactaagcacgactcagagtctggtggaggagcagaacacataaacagtctttgatgatacccatgctcttttgaatttgctctattgttgttcattttctttaagatttcagccctagaagtagcaagctgaaaatcagggctgctttgcaaatgcccacaaaccactgaggggagttttgtcaaagaaggcgggaaagaaaaataaatgtgggcttctgctctttaaacctcagcccagtgaggcagactttcccggaatacttcaggcctcttcaaaggcctattgtggaaagtgtccagatgtgcgtggaaaacctcactgggaagcttcccggtgaagaggccttttaagcatgaaccgagatgaaggaagctgacgccatgagtcctatcaggtggccttttttctgaaggagcccagattttcccctaaccttaagaaggttgtagggggttgggtgattagccagttcgtattcctttgattacaggaagcagtggggttagttgttttttgttgttgtctttcctttttttgctgaagtgagaagaggagatgggggtggggggcattctccatatgatttatctacctgtaagttgttagtgacagtctggtcattcctccagcataccttgtgagggccaggagggatttctggattggataaagttgaggcactgagtaagtcctgctagtttctatgatgatgcctctgagtgttctaagagtcagaatcccctggaatctggctctgatcccctgctccgaatccctgtttaagctctcttcccaatgccctgtttatcctaggtttgaggccccatcttcctcttgctagatacagttaagccagagagacccagatttaaatcctgctctctcattagctgtgtcatcttgcacagagtagcatcagcctcaccgagcctcagtttcctcatctgtaaaatggaggtaataccagtcccgtcatcatccagttgctgtgaggattaaatgaattgctgagttgccgcacacaaagcatctggtccagttcctggcacagagtgagggttcagtttattttcattccttttctctttaatccagttgtacaaagaggcagagctgtcccatttgaccagagaattttacttctgtagctctttaaattctctccccgccatgtacatatgggcttagctaagtattttgagatcacagtgtatttaggggaaagtccttttggctacagctaaaattaggcctctcttgtgctcctctgtttaccaccccccttcctattttaactaattagaggcattgacactaagaaacacttaagaaaagttggaagaacagctgggagttgttctagatacaagcagctgctccctgtcagcatgcaggcacagaaaaggatgatcctgaatggggaagtgcagggagggcacctcagagatgaagatgaggaatggcaaagtctgtctatgttgtggcaaactgagcagggtggagttcttatcactctgtcctctaccttctgctgagagaaaaggggggtcagagataccaaagcagatagaggaaaggggggcaagaaaggggaagggaaggaaggtattcaggagcttagctagttggttagttgattactttatgcagaccactgtcgcccccacctagaccactgcggtatctcctaactggtctcatgctgccggctgctttcctgctggaaccagagacgtcacaggaacatgcaattcttgcaccctgaaatccccgcgacgagcttccaccatggaatttagacagaattccaaaacccatcacatggcccccgagtacctggatgcaccttccccctgttccccgtaattgttactgctcagtcctgctggcttctgttcattcgctctgcttcaaaggactttctctcctggagccagattgcctgagtttaatccaggtttccctactcgctactactacttacaggcctctccatctcccttccagccttaaacacctactgagctcccctggaattccctgtccacgtcctacacactctcctcatggagtccccgggcctgtgcacccccaaataaaagtttctgtgtttccagatggccatggtgactgtgcataaagcctagcaaatgtgcatcaagccagaagacacgagacctttccaaagggctcatgtcttctggcctgatgcacatttttgtgtcccctgccccatctcctcctcactaccctcgggaaactgggtgatgtctctgtgggaagggctgagcctcaggctctgtattgattgtccagtgctgcatttaaacttcctgactggatattcagaacttatgctgttgttttgttttgttttgttttgtttttttgttttgttttgttttttaaagcaagcaccttcacatctcaggtgtaaatgccagatcttctaacacttacaaggacaaattcatttcttactaaatagtcaagcttaaaacccacatgactggctgatgtaagctttggccttgtctgtgaggaatttttgcaacattatttctcttgatttctttctttgttgctgctgttctcagaacaaggcaaggctgaggttctccttctcagttactccatgtccctgaattaagccctgtgagatctaaaaacaggagctctgtgcacacagccgtaaggacaaaccctcactctgcatccccctaagtgggccacatgcctaagcccagaaatctaagagttacttctaacaactttctctccctaacaccctcatctggtctgtcactgaagcatgttttctgcctcctgagcatctctcatatctgggtgataagagagccaccttgatgtcccctggcccttgctgacctcagcagagcctttgggtgacagtagctctggcttcccagggcccttggaaaggagactgtggggtccgcgtggtatggccctgcctgcctcttggttctgtttcacccacacttcccttcactcttatctgctccaacaacacagcctttctcattcctcaagtatcagttttcttttctttttctttttatttatttcagtagggttttggggaacaggtgttgtatggttacatgaataagttcttttctgagacagggtcttgctctggtgaccagactggagtgcagtggtaccataacagctcactgcagccttgacctcctgggctcacgtgatcctcccatctcacctcccaggtagctgggaccgcaggcgtgcaccgccacacccagctaattttttgtgtttttttgtagagacggggttttgccacattggccagactgatctagaactcctggctcaagcaatccacccaccttggcctcccagagttctgggattacaggcgtgagtcaagtgtcatttttcgtccttccgtatggccctctcctctgctagacacatgcttccccctccttcagccattaatacctgtgcatcccttgaatctcagctaagctatgacatacatgaagcatacatgcatatagacacagacatacataccattcaacctaacatgaggtgattgaggaatgccgagaccctcctctcccctctcagtgccctgaagcagcccctgggggaggggatggccctggtccctctgactctgacagggactgccctcccacagagagaggaaggcctcgggagctggttgtgggctcacctctgtggtactgctcttcctcctgcttctgagcagagaaggcctgggggccaaggtgcccaggggctgtggacaagatccttttatgctctgtccttgcctctaatgtgacagattattttgtaattacctggcagagataagtttggtttctgcaaataaactagcaaagattccaaggttattaaacacaaccttgcctcatctatctggtcatatccaaaaaccttaaaagaatttttgttcttctgaatttcactctccaaggcacaaagaccaggtgatggtggggcaggggtagagagagggatgggaagacttctcacagtgattcgagaacgttcacacacacatacgcacacaaaaaccttcactctccccctctccaaccccaccccactgactgcacacatgtcttggcccccttgagaatcccttttccatagacaagccctctgaggtaagaggtttaggcctccttcctgctttagttaacatcttgtctccacagaaccacatccaaccttccatttttctccaacctctttagctcatgaggaagatttacagcctgggagtcaggaggcccaagttctagtccttgctttgacaccaggtgatattgtggtcttctctgagtattgttggttcactcttatgagagcattctcagacctgtggcattttcaccattgaatccactgtgcacagaggtaaccaacatttgtgacacctgctgtttgcaaaacactgagctaagaattagtgattacttctcaacccaccatctctacaaggcagctatgactcctgttttatctatttatgaaggaagacagagcttagcaaaattaagaatgctgctcagacccacaaacaggtaagattagaggcaggtttcaaaacgaggtctctgtctccagagtttctgccatcacagtaagctgagtctcaactgtactatagaaaaataaatcaaaatgacattttaagtatcatctcttttatttatgcattatgcaggagatggaactcctttcttagatttttttcccccaaatatgctgtgctcaggagctgggaaaagggaaaacacacaccctgggaccttacaccctgatatggtttggctgtgtccccacccaaatctcattttgaattcccccatgttgtgggagagacccagtgggaggtaactgaatcatgggggcaggtctttcccatgctgttctcatgatagctgataactctcacaagatctgacagtattataagggggaatttccctgcacaagctctctctcttttttttgcctgctgccatccatgtaaggtgtgacttgctcctccttgccttctgccatgattgtgaggcctcccagccatatggaactgtgagtccaattaaacctctttcttttgtaaaatgcccagtttgggatatgtctttatcagcagcgtgaaaatagactaatatagtaaattggcaccgggagtggggcactgctgaaacgatacccaaaaatgtggaattgactttggaacttggtaacaggcagaggttggaacagtttggagggctcagaagataggaaaatgtgggaaaatttggaactccctagagacttgttgaatggctttgcccaaaatcctgatagtgatatgaacaataaagtccaagctgaagtggtctcagatagaaatgaggaacttgttgggaactggagcaaaggtgactcttgttacgtttcagcaaagagactagcggcattttgcccaagccctagatatttatggaactttgaacttgagagagatgatttagggtatctggcggaagaaatttctaagcagcaaagcattgaggaggtgacttgggtgctgttgacggcattcagtttcaaaaggaaaacggagcatgaaagtttgcaaaatttgcagcctgacaatgcaatagaaaagaaaacctcgttttctgaggaggaagtcaagccagctgcagaaatgtgtataagtaacaaggagccgaacgttaatccccaagacaatggggaaaatgtctccaggccatgtcagaggtcttcatggcagctcctcccatcacaggcctggaggcttaggaggaaaaagtggttttgtaggcagggcccagggtacccctgctgtgtgcagcctcaagacttggtgccctgaatcccagctgctccagccatggctgaaaggggccaacatagagctcaggccatggcttctaaaggcgcaagcctcaagccttggcagcttccacatgatgttgagctggcaagtgcacagaagtcaagaactggggtttaagaacctctacctagatttcagaggatgtatggaaatgcctggatgtccaggcagaagtttgctgcagggacagggtcctcttggagaacctctgctagggcagtgtggaagggaaatgtggggttggagtcccagcccagagtccctactggggcaccgtctagtggagctgtgagaagagggcactgacctccagaccccagaatggtagatccactgacagcttacaccatgtgcctgaaaaagctgtaaacactcaacaccagcccatgaaagcatctgggagggaggttgtaccctgcagatccaaagcggcagagctgcccaagaccatgggagcccacctcttgtatcagtgtgacctggatgtgagacatggagtcaaaggagatcattttgtagttttaagatttgactgcctcactggattttggactagcatggggcctgtagcccctttgttttggccaatttctcccatttggaatggctgtatttacccaatgcctgtacccccattgtatctgggaagtaactaacttgctttcgattttgcaggctcataggcagaagggacttacctttgtctcagaggtgacgctggactgtggacttttgagttaatgccaaaacgagttaagactttgagggacttttgggaaggcatgattagttttgaaatgtgaggacatgtgatttgggaggggccaggggcagaatgatatggtttgactgtgttcccacccacatctcaccttgaattcctccatgtcgtgggagggacccagtgggaagtaattgaatcatgggggcgagagcaaactgaggaccagagtggttataaaacttgtctgaattcataccatttacaaagtaaaagaagagtctagagcccaggtctcctgagtcctcagaatcaaccaagtcaaataagctcccctattcaaaaagaagaaccttcaagaatattaattttgtgcccatctaaaagcctcactgagctgtgctaaaggtaataggcattgaagaaaacgttctcacagaaactcccagctgcaaacacaaagaagcagctctccagggaacagggtaaggattgtctgaagagatctatgctggtgagattacaaaaatcataatatatgaataaatgaacatatggaaggaatcagcaaagccctctcattcttcccgtatgtaaactcggcctttgcctaaagtcattaagtaaacacagatgcagccaaaccaggcaccagatggcaaacaagaattggaataaaaggtaaagaaagcttttggtgtttactcaaagatggggaaaaaaaccatgatccaaaatgctgtggtttccccagaatggccacctggagtcaccagggcccaaaagtgaccaaataaaacaaaacaaaactagaataatcatgattgggaagttgtaggaaaaccgctgctatcttctgtgaatggaatcccatgtcagaagaaactggttattctgggaaatgaaataaatggttaaatcaaagtactaggaccagagagcaacaggaatgtggcaagaatccacttttgctgggcactcacatctgtccagagctttgtattcttggccttatataatcctcacaattacccattaggtattggccaaattttataaatgaggaaattccataaatgggttgagagagattaggccccaaggtcacaccacaggaatgccatcctagctgtggccagtgcttctttgtccattcccagcttcgtagctctgatttcagtaccagatacaggggaatccaggcacattctctctgcctttcctgcccaaaccactggacctaagtaagaaggtcacctggtcaggtactgccttgaagggagaccagaacagacatggagtggggaacagagcattcctgaaaacttaacttcacctttatttcacaaaagacacccttgcacatgcctcatccacctcttagcttgtacatttgccatgagcaccagtaatgaaggcagtccttgtgaatatttgcttttcagtatgcatgagtttatatattgggggtagaaaattccaataatgtttcagcttcaactaaaagctgtatcttgttctgtccttgcctctaacctgacagattattttttaattgcttggtagagataagtttggcttctgcaaataaactagcaaacatttcctgcccaggctaccaaacacagcctcacctcacctatctggccatatgtaaaaacgttcattcaaataagttttgttcttttgagttttactctcccaagcgcagaaactgggtagtgaggggtgcaggggtatggggagaatggtttcaaccaaaccattcattgcttgcaggtgggaaggtaaggtggaaaatgctttccagctaaacagacctgtctgataaccctaccactaactaaacttgctctcttgggcaggccacattatgctttgagttttagtttctttctctctaaaatgtacgtggaagggctgttttcagaatttttttttcactttcctcttacccatcttctctttttctacatggtcaatctccacgtggctgttttattttttccccattgttctttagcaaagcttaatccaggatgaattcagctttgtggacactataaatcaaagccatacaaccataaggcaggcttctaccactctatactaattgttaccagtctcttagccctggtttctggttgggtttggccaatgggcagccccagcaggaacctggagaataatgaagttgtttattcccccagcgctctccttgctgggttgacgcaggttagctacatccatctaccatccttctacaatggaccacagttcctgtgtgtggccctttccctacaattttgtgcatgatgggaacctctcctccctccctgtcctccttcaggctaagaggttgtaatggctccttactgttggtaatcattaggtacttgtttctttacctaaacctttttaaacaactcttcttgaagcttacttcagttacccaatgtgagtgtcaatctctttcctaataggaacctgaataaatatatcacttcagctcaatttcccattttctacaatgactattatcaaactttgccaatttccatccctgtctttcctctcatgttcagagagatgacctcctgtttattcttagccaccaactacctctaagagaaaagccattagaaagacaactgccattaaatctcccagctttcttagatccggtagtgagctggggctagctcagccctgctcgcaagagcatattgtgcacatctcttcccagcttcacatccattccatcacattcagagcttgaaactggccaagatggaagtatttacaacacagaaattggcaattgataaaattagggctttctattgattatttatcagtattatttatcaacacaccactgcttatatccagatacagtctttttctccttcacatttgttacgatgaaagagatggcccacttattatcagagactctttcatctcctactgcctctaacagcccacttaattcattatccattcactctatgtttagcttcttcaatactatctccttctcatcaacatttaaacatgctctagacctgtgctatccaacagtagccattagttaaacgtatttattgaacccgcgagatgtggctagtccaaattgcaatatgtaagatacacaccagatttcaaacattttgcatgaataaaagaatgtaaaatatctcataaataatttttgtattgattacttgaaatgatatttggggtataataggttaaataaaaacatattaaaattaaattcaccagttcacttacacttttttaagtgggtactagaaaatttaaaattacttgtgtaaatcatattatttctgttggacagtgctgctgtaaacctttcatcttaaaaataaaatccctggctgggcacagtggctcacacctgtaatcccagcactttgggaggtttggatctgtgtccctggctaaatctcatgttgaattgtaatccccagtgaggagggccctggtgggaggtgattggattttgggggtggagctcatgaatggtttagcaccatccccccattggtaccacatagtgagttctcaggagatctggttgtttaaaggtgtgtagtacctccctccacttcctcccgctccagccatgtaagacgtgcttgccttctgtcatgattgtaagtttcctgaggtcttctcagaagcagaggccactatgcttcctgtatagcctgcagaaccatgggccaattaaacctcttttcttcataaattacccagtctcaggtatttctttatagcagtgcgagaacaagctaaagcaggaagattgcttgaggccagaaattcaagaccaacctgggtaacatagtgagacactttctctaataataattttttaaaaattgccaggcgggcgaggcgcggtggctgacacactttgggaggccgaggcaggtggatcacaaggtcaggagatcaagaccgtcctggctaacatggtgaaaccccatctctactaaaaaaatacaaaaaaattagccaggcatcatggcaggcacctgtagtcccagctacttgggaggctgaggcaggagaatggcttgaacccggaaggcagagcttgcagtgagccaagatcgtagcactgcactccagcctgggtgacagagtgagactccatctcaaaaaaaaaaaaaaaaaaagccagtcaccgtggtgcatacatgtagtcccagctgctcaggaggctgaggccagagaatcagtttaacccagaagttcgagctgcagtgagctatgatcatgccactgcactccagcctcggtgacagagcaaaaccctgtctcaaaaagtaaagtaaaatcccttcttctgcctatcagctcccctagctgttgcctctcatggtcaaggatgctttaaaaggtatctatcctcactaccatgatttttctcaccaccacccctgcctccttaactaaggcagatcttccttccgctacagaaattccaccaaaatcatgctgcctcagtcattagtgctgacccaaggcattgctgagcccaaagggcttttcaacccctactcagctttagccttggcaacattttgcaaagtggagcactcccttcattgaaacacgcttccactgacaacatattttcttgatttccctcccgctgttctgaatgtttctgcacaaattccttttctagttttcctttctcctctccccaatattatatggtagtcttatacaggaatctgtccatctcatctacttctaaggattcatttactatttatatgccagcaggtttacacctatctatataacatcttcacttaaagggcttacagccatctcaatctaagcatattaaaatctgaacccaccatctccacctctgcctgaaaaattggcactgttcccatacgtggcactatcaataaatggcaccacgtgtccttactcactcctggcagaacctcaaggacattctgagcccactctgtctttctgctccacatcagtctctcatggtgtctttctaaattacatttcatgtctcttgaattcttccactttgctttaattctaccatcaccatccttttgtctcacctggactgctccaaagaacttttgaatggtttccttgcctccacttttaccattctttagtttattctctacaaaactaccagagtgatctttaacaaacatgaataagatcactcttgcttaaaactctccagtggcttctccttgactttggcataactcaaaaccttttaacatgatttacaggaccatccaaaatctgacccctgccttcatctatagcttcatctcctatatgctttcccttcattttatccagtcatcttggacttctttaggtcctttaaatgtatcatgttgtctttacttaaggccttcagatatgcatttccttcagtctggaaccttcctcatcaactttctttacccagccaactccttgtcaaccttcagctagttccataagtttccatagtagttttgtcttcctcttcctgtctcccatgatcaccgatgtttctccagcaggctttaaacttcatgaggtcagggatcagagctgtctggttgcctcctctatccatattgtgtagcacaatgccttgcacacaataagtactcaataagtatttggttgcacaataaaaatgacattatctggctcaaacttcccattttgagaaagaggaaactgggatccaaagaaaggaagcaacttattcaaaacaacagagcccaggctaagattaatacagggctggagcctcctaatttccagatcttttttttttttttccagcacatcatgtgcctatctataatatggtaaccagaaggaagcagactggattccctgtgtcttgtaaaagccggagcaagttcttatttgtaaacacagctgacatagttgttttctttgtttgttttaagtaaaaggactggaagtacaacccaaaaataaactttgtgtttccaaaccaagaagcttctacaacttttatcccctgcagcctcctttctgtccattgttcatcttccttcccttcattaaccacaggcatcagctgatattcaatgttgaatggtccctgcattctgtgttctttatcactcccctgcccaggcagcatgtcacatgcagcagcagattaggaagtgctgtctttaaatagtatcactcaagagaacattacaagatcctgtgtagcgctggggtggagattgatgtaataatttttagaataaaaataactcacatttttgaaactattagtttgtgactggcactaatttcagtggtttgtatgcattttcttttttaactttatgagtaattatttctattacttctattttacagatgagtaaactgagggacaaagaggttagttaaggcccaagccattctgttttgtttgagacagagtctccctctgtcatccaggctggagtgcagtggcacgatctcggctcactgcaacctccgccttctggattcaagcgattctcctgcctcagcctcccaagtagctgggattacaggcacctgccaccacacccagctaatttgtgtattttcagtagagacagggtttcaccatgttggccaggctggtctcgaacccctgaccttagatgatccacccgcctcagccttccaaagtgctgggattacaggcgtgagccactgcgcccggcccacccaagccattctgttagctagtgaaagagtcaaagttctaatctagccagtctagagcctgtgatcctaactgtctgacatcggacaatgaagaatgtgttgacctggcaggaaataccaaaaagtacaactgagggagatcctaaacttgctttatacagatatcctggatcctacccctgattcattcattaattcattaatccatttactcattcatttaattctttcaacatgtatttattacatttttgcattatttatatcaattttggggaatacagagaaagttaatggcttctaccctttgacatctcacagtccagtggggagacgtaagaaaacagacatttatcctactgtgtgctgaatgataagacagaggaaaatcagtgagctttgggaacatggaagagattataaacacataataaagagagtttaaaagggcactacagtgatttgctttggacctgcattccacacctgtcactctatctgtctgacctctgctctctctatgctcctggcttctagcccttctcttactttggtaccatccttagcctctcaactcctggcttcagattcgatgtctttgcttgtctttttcctctggaagttggtttggaatggattctggcttggctagagggtttctgtatcgtaaacagtctaaggccagctccaaagtctaggccagaatatctaggccccactaccaaaatggctctcgcttagaagaattggagatccaaaagcagggaacttgaaagagcatggagggatagatggatggatagattccttgcctcttagcttcgattattcacctgcctaaacccagagcagttggcctagtgactaaccaacatcccttgcagctcaatcattattcattatgttaatattatcacacattttgattctttgctgtcgatttggttgctgatctgctggccaaaggatcatcatgggaaggaattactattgaagcaggcagtgcaaatttcaaaagtgttcagaccctgcggcctttcatgatatttcactttcttgagttgcagtctcccattggcctgctccttccgaagcagattttgtcccttgtagccataagtgaagcatatcctggctaaatgtttctgtggactgaaggtagctattgaattgggcagttaagagaatattgcagattcttgtcggtaaatgacacaaaagatgatggactctaagctagctatggaagaaattagagccagacagggcacatgaattgaaagaaaatgaagtgatggagattctggaagttgctttaaagtggagaaggacatttgctaagaatgatagagtacatgagagaattggactgaagggcaatggaattcagaaagtggctgttggtatattgtaatattcataagtatagcagtctcaaggggggctgtgggagtattgaagtgaaatggagatgaaggtcccggaggtggaaacattttgaaaccgtctaacagtggaacattggatgggtcttatgagcagatgctgaagttgtccaggacaatgataaacctccaggtagatagggaggcttgtgatctaggagccttagcctcatttaacatagggacagaaacaagaggctgacagtgacagcagtgagatgcaggggagacatgtgtcattgtatctccatcattaggtggcataaacctcagaggaacaggcttttttgcctgcaactgcaggaatacttgtctggaaatgataatgaggaggcctgagaataatgactgttatcaccttccccaacccacctgaaacatacacacatggcaacacttacctttcaataaagtttctgggaaaataaagtttatttcagttgataggtacatagtaataataacaatatctgcacttttaagcatttagtccatccaataggcctataaaataggtattaaaacttccctttttttgagacagcatcttactgtgtcgcccaggctggagagcagtggcacaatcgaggttcacttcagcctcaacctcccagactcaagggatcctcctatctcagtcagccttctgagtagctgggcctacaaacacgtaccatcacacctggctaatttttattttatgtttttgttgagatagggtttccctatcttgcccaggctggtttcaaactcgtttcaagcgatcctcccacctcagcctcccaaagtgctgggattacaggtgtgaatcactgcatccagcctaaaatttccatttttaaaatgaggaaattgagactcaggatgttcatggcagaactagggtttggattatgatctaaatatcactgaagtctttgtttcacagcaaatgtttaaaagtataggttccaaagccatatgttttcttgtctttgaactgggaatacaaactaggtaacgtatttaataatatagtgctaggccatagtaagtactcaacaaatatcagttgccattataattattgttattgagttactattatttaattacagctcacggcagtactatataccttctcagcctcacatatcagcaagatcatatttttttccagtcaacaatagattattagatgagtgacagcttgcagttttggaacctatcatctgtctgatgcttttagcaagaagcttcctatttttactttgagaaatccataagaagtaagtcaaactcatgtagatgggatgaatacttgctccctattcatgtttggatccaactcttttgcagccaggccatatattaggaccccatctcagagtatcacaacagaggttgatggccttacctagtataaaaccactcccctgtgccgtatttgcccatgactgaatcggaatgaaactttcccttgctaggaaaacactgtgggtatattctctgtcggagtgtgctgagcaaaaccctaatagaatgtaccgtgaggaataaggagtaacttgtcaactgagagttaatcagaaaaccacatgtgcacaaaaccaacagattgcagagctggcaaagacttcagagataatttactccaaccccctcattctactgataaagaaagtgagtcccagggaggggaagggtcttgctcagggtcatacagctggcagtaattttgtttgtttcaataattaatatgaacagtcattctatacatcagtgaatccaccttcctgcctttgtaagcacaatataatgaccataattgaatttgtctttgacagtgaagaaagcaggcttttagggctttacagggccccaaagtcatcagaagaaaataaattgtcatgaactaaagctggagatctgcctgttgactgtgagcttcttaaggaatgggcctggtcttattcatgagctaaagcaagtttcaaatcctggcttagccctttactagcttaagcaagtacttaacctctctgagcctttatttcctcattgtaaatttaaataataagaccttcctcagagactgttagtgaggatcaagggaggcaagatctgtataccagtaccttgcgtaaaataggcattcaataaacttgcactttcaccttacatttaacaaatgtcctgctaaaagctagggatacttcaaagaaaggaaagccaacgactccactttcatggagcttagattcaggagggaggagagcagaggtgaggaccacagagaagcaggcagacaataaacaattaaaaatataatttcagatgatgatgtgctatcaagggttatgaggaaaagaaaatgagatgatgtcatagatgtttaggagagtgcactgcttctgctaagagtggccaagggcagtcttttcaatattatgtttgaagagaacctaaatcatatggaaaaagccagacagtcaaagatcctggagaagaccattcctgagagattcagaaaggccttaggcaggaggaaggttggcatgttcagccagcagcaagatggccagtgtgttcccagcatggccagcccagtaagcagggcatgagatgagactggagacatctgcataaactccatcctgaagttctagtccaccctatgacatttgagttttattcaaaaagcgatggaacactgttgcaaggacgtgttaaaaaataaatattggtctttgtccctagttcctggcacacagcttctaaaattcttggaatccctgctaaaagctagggatacttcaaagaaaggaaagccaaggacttcacttttatggagcttagattaagctccatgtgtatggtaatgagatgactgatggctgagaacccctccgtagcatcaggatgggggctggtcaccagaaagaccaaggcatgattagagggttgaactttcagcccctcccctgaccttccagaatgagaaaggggctagagattgagtcaatcaccgatggccaatgatttactcaattatacctaagtaatgaaaccttcataaaaacccctaaatgatggggtttagacagcttctggattggtgaacacagggaggtattgagaggatggcatgcctggaggaggcatggaagctcactgcaccactgcacctccctcccctcataccttgctctatgtatctcttccatttggctgttcctgaattttatcctttataataaactggtaatagtaagtcaaccgttgtcttgaactccataagccgattctagcaaattatcaagccttggggggtggagtttgtggaaacctccaatttgcggtcagttggtcagaaatacaggagacccaggacttgtgattggcatctgaagtgtgggcagtcttgctggactgagccctgaagctgtggggtctgacactaactaactggggtcagtgtcagaattgaatcaaatttaattataagtcatgcaattggtggcaggagagttggagaattggtgagtgtgaggaaaaaacccatacatttggtgtcaggagtgttgtaggtaaaaacagcccagagaggtaaaatcattcattgattcatttaacaaatccttatagattaactattctggccaggcacagttcttggtgtggtgcatgaatccaatacacacccctggccacatggagcttgcatgctaaagggataataaatatctaaagtttatgtagcatttactatatgctggcattgttgtgttttacctcaaataactcacgtgcttctcatagcagtcctatgaaaggcatatttttatccccattttctgatgaggcaacaggcatgaagaaattaagtaattattccgtgattatacagctagtaaatgtaaaaatccagtttcaaattctggcagtctgttatagtcagtctgtattttaatcactgccctttattttctctgcttctgaaaaatcacctagactggtcctgactgctataaggggaaccaaagtggaagtcaagagaccagttaggcagtagtggtcagagaatgggatactggaattttcaacaacactgagtagatattattattcccacttaataaatgggaaaactgagctttgattcacacatctgataagtagcagagcctggatccaaccccaagcccatttatctctaaaacccagtatctttctgctaatgcctccatttcctacagaattataaagcttccactcctcccctcctttatgaccaagagaccaatttgaggtatgttttagagtcaaaattagaggactgggcgtctaaaaatttttttttctcttggtaggcatttttataattgaaaataaaataaaatataaatatactgacatgcagttctgttttctcattttcttttgcaaactttaaattgagatatagtacacataaggtgaaatacaaagatattaatgtacagcttgatgaattttgatgaagtatacacccatatagtcaacactctaaagatatgtaaatgtgtgcacatagtgtacttaaaattataaatgaggtgccagttttcatatcatgagtaatgataaagacctctcccactctctttttctctcatcccttcctgcttctcaattgatatttttgtctccaattcatgggggttacacagaataccaggtgcaggtcaaaagatgactgtgtcaaaaggaaaagaaagcaaaataaataagagaacaactagccatttcttaatgcgtgttgaaggaaagtcacattgatatattttctgtttttctatggaggggtcacgtgcctcagcccacacattagcatgtgaacttgttgttccagtcaaatgagtcagagttcctcaggaaggcagattcctgtattttagagctatgtgtcagcatctgtaaaaaaaaaaaaggtacagtgtcctgtattgatgcatctcactgatacacacgtgctcgtctcactccaggtaatcacacctgctaataagcagcagaagtaggatttgaactccagcctagggcactcaagaatcaggctgttttcatgacagggagaatggtaccactgagtccgaatgtagggtttgcaatggcctggagtcagaagtgggcttgaattctggttttactacataatggctttatgaccttgggaaaattacttatattctctctattttcagttcctttattcacaaagtggtgatagatgatctgtgtcctaatgtccttttgagggttaaaaagatcatgtacttaaaataatcagcacagcacagagtacaaagcttaaaccagtaaaatggcaatggcagtggtagtcggcccctaagtcaacagacaccacagtgttttttaaccatatacccccatcagttaaaataaattttgagtatgcatcctcagtacatgaaaacctatttatgaaaaagcatgatgtgctatactgtgttcatagattatttactctataaaacaagtgaaatatagctgaaccaaagtatttccaatgtgtttacctgtcatgatggcttcatgctaatattagcaacatgtaaaagtacactatatgtctatggccaggtgtgtttttaataattttaaaatgatttttgatgatttttaaatgattttgtatgtgcctatgtatcgaaatctaaggcaatcttcttgataattttgattattttcccaatccttgtcttatttgactaggtcttcattgtttttaccttacaatatgaggagctagtactgagtaaatacatcaccattttcttgtttacttgaatctgaatggtgaactggtgataattatctccatcacgtgcaaatccattgactgaatcttttttagctgcttgtccattttgtgagggttagtttaaactagttaatacctattaatcactaacctggaacatgcaaacgacaacatgtagcaattctggaagctgaggacatataagggagtgccatagggccatccctggagttggagagctcccactctcctcacaagaacctcacacatcttatgtgactcatgactgactgatgtgtggccaaactgataaattgtctagtaacaatccatatattaaatgctggtaaagtgtaattaatttcttaagaccaaaaaaagtcatataaatggcacttccagtattttcttctggaatcttaatgagaattccctggagtttatggatgccacttaagaaacactgccatcactttttcctttggcaactctgcaaacactaaccaagcacctgtaagtgctaggactgtgctagacattaggcctacagtgatgtgatttctgccttctgggagttcatatatagcttgtttccaccacactaagttctgctatattctcccctatagatggtgactctggaattgcccagcttgcagtgccctgtagtaccttgggctagactactgacagtcttccccaaaaggcttaagcccattattccccttcctcagggtaggggagaaggtactagatcttctgctcccaaaattgccaacatcagtaagtctaccactcatggaatccacatcttttccaagggtactgaagaacccatggcttcctttaacctcatttccctggtaactcactccaacatggcctacagccctttggtagctcccaggccaggtcattacagtgagaattgggtgtttcccctggccacatgcaggcctggctgttgccagtgctgccacaagagaagtggtgagcagtgtgtgctgattagtatctcagcctcgacacaccagggaagggtcaaacccatgaatgcagtctttcatggccgtggtacagggcccctattttttcctccagaaacccttcacttgctttcagaagtgatgatcaaatgtgaactttcatggtttatttatagctctgccttatagagagaaagaaaagaagtgattaaaatgctattttacaaaatattttgtttttaaaaagctttcattgtgtgggcaaaaggaaaaagaaaagtcactgtattaattgtgctgtctagactctcaaacaaagagggtagcgtgctgcaaattaagattgtccggctcctgcctgctgacaaaaagtatgaatttggaggccaacttcaaataaaccctttggaacagaaatatattgtgggggtgactatatttagcatgtgtcagcatttccatactaaattcatattgttatgttgtggtaatttcagatttcctgcagccaagtgggatcatgagatttcagttttatgttaattatttggagaaattgaaaaactcagcagtgctgtttctgatgacagcactgattctcagggtattctccacgttgtgtcagggacccataatgagccctgcctttcaggaaaggggaaggtgagcccgagtcattttgactgtctttataagcataactttaaatatatatatatatatatatatatatatatatatatatatatatatggcattacatgttttccctacaaatacaaaattaatatatgccactgtagaaaatttagaaaacacaataagcaacttgacaagaaaaaaaaattgttacccatgctatccaacctgttaacattttaatatatattgatccgatctttattatgcatatataacttgtttttatatgcatatcttgtttttaacttgtttttaacaagttatatggagcaaacaaaaaattatgtagcacaaacatgattattgagatagaatacaaaattataactttattttctattctcattatccctttgcatttgtgcagtagagctagtttttccctgctctggttaaaaatcctggtggttccattacttttttagataaatataaagtcacttagataatataacctttatggtcctttaagttgtgagatgtagccaaaattcagaaattcaaatatcaaagaatatgtaaaggtaaaggtaagatgttttccagttcttccagctggagtctgccagaaacgagacatagccctaatcagattcttctttcttcctcattcactttctctccaacatattagcttttttcttgttcctctgaaatggttagaaagtataagggaagaaaagttagtggtgtaggaaatttcttatctgatcagtactgtcataatgggcttcatgctctcttagccttataggtgtttacagctagctctgattctcataaggcacatcatagatttttggggagaccccctgcctctgaaaacctctcgcctgaaatattgttgtcttggttaacacctgtctattctcatagattgctcactactcttctcttaattcctcaggaatcctttccttttttttttgttgtttgtttgttttggtctcttttttgtttggttttgttttgagatagagtcttgctctgtctcccaggctggagtgctggagtgcagtggtgcaatctcgattcactgcaacctctgcctcccaggttcaagcaattcttgtgcctcaccctccccgtgggaccacaggcacatgccaccatacttggctaattttgtatttttagtagagacggggtttcactatgttggccaggctggtcttgaattcctgccctcaagtgatccacccaccttggcctcccaaagtgccaggattaaaagcatgaaccactgctcccggcccaacctcatgcttctttatggtgactgctccacctcgttaggtggccatgttggacaggatctgagaacccctggcagctctctcatacatgggccacttggggtctatgggaaacctttgtcttttggatctggacagactctggcagtgctggttgatcccagggtaacctctacttcacttttacactgcagctgtcagccagcctgtctcttccagacaggagtcacatacaagccaccatgtgccacaacctcagggacatgcagcagattctctgctggtctgtgtcttcctgactcctgaagggagaggatctcttcatacttcaccctggaaggaggcctgatgtgcagtaaaccaacagctctttcctaaaaatccatctctgtctgaccttccacatcaatgaaaggtttaagagttgattaatgggtcctcaggcacccttcttgcacattcttcagggtggtctgtttccagttcactttggtatcttatatctgtcatctttagatctcagccaaaacttccattttaacattccgtcacgtgtattatccttaagttcattcattccgtagacattccctgagtgcatacgatatgccagatgccgagtttggcagtgaaaataattataacaattcctgctttaaggcgctcacagtctagttggggaggctgatctgttaacaaaaaaatatggtgccatgtcataaacgctatgatagacggaagcagaagttgctgttggagcacataactcaatataggtgggaggcaggcagcggggatgagtcagaaaaaaatctcagtagagctgatacctgagctaagtttaacatttaaatctgtactttctgagaaacagcataacctctttttaaaccattgaaatctctcttgctgatgtttgcttctcaatttatttttaaaacaagcaaaggtaatgtggagaaaggagggaagaattccctgatgtctgccgtttatgtgcacatctgttgcagtgggaaggaaaataacatttatggagtaccttctataatagaagtttcctggatcccacccatgagggcgatcctggaatgttgtctcaagtgtggggccaaagcacagccaggaggagcattccctgagggcagtttgaagattcagagctggcaatagaaggcaaggtcctccctaaagcacagcagagcacaactcaaggaagagacgaaaaggacaaaataagaatgagtggcacggttgatgatggggattgctgagaccatctcaacaataccccggcttgctctaagggaatcaggacttcgtctttgaaggaaactgttctggggtaagcagagctcttaacatacctctgctaagtggaatggcagcatgttcactaagatgtgtttgaccatttggccctccacaaaatgactccagacagcccttttagtcttcctctttctccatggtttctttgtcaataatttttcttcattaaaaaaaatctcctccctacttaaggctgccatttctttctgttgtcattgtgctggctactcttagcatctctgatctcccaatcagcacattcacatccattgagagctgggaagctagatgtctagttcagaatgcacatgctatccttgtggaagagtccatagagcaacctagcaggagtggaaattcgtgtaagctagcagatgaaagaaccatcaggttacctaacccttgaataactactgaaagaagtttatccgcttctagcgtagtatttatcacactctattttgatcacagtaaatgtcttttccactctatagtgagctctttgatgaaaggcccatgcaatcttcctctctgtattccatgtagattgagtgttatgcttggcacgtgaaagggaggcaatatgttttatgaatagtccaggtgtcgagacttagtagtaaacagacaagtccttgccctgtgtagcttacattccggttagggcaaggagtggagaaggcagacaacgaacacataaaccagtaaatatacaaagtggcagaaggaaattagtggcatgcaaatcagtcaatcagtcacagtaaggtggcaaagatggtcaggggaaacacttggaaatgttttgaagatacccaggggctctcatattctgtatggtattcagattttttttttttttttacattttttcctcccttactagtatgtgagtttctccaggataaagagtatgtcgtatgcaaatctgtatccctagcagagtgtgtggtacatagtaagtgattaataaatgtgtagaataagaagttgtacacatgtgatcccagaatgactgcatccttagcaataggaattcaatagccgttcctaagactgagcctatgctgtagagctttgtcgtgctgttgcttgcaatcttccctggccaggtctgttggactccaaagtttactttctcatggccttaacagccttaggagactgcttaaaaaaacctaacccttctgctcatatgggagccaaaacaatccatggttaatcttgatgctgcacctaccataccatgtctacccagatgctgtaacatgtcatctgcctgagtgccccattgtaaagaaaagaatgtcctgaagtcacattccagaactcaagtcacttagactcagcccggaggtctcagtatgtactcacaacttcagagattgctggaaaaagagctgaagttgaattggagaggtcttaaatattttatcctcaagtacaggtgcgaagtgagttccattccgtgattgctatctttagggaagtagacaatgtactcagcggctggttatgttccctgcttctgccctgtgtccagatagtgaggaggggaaataattcttcccacttacccctggaggcagtcacagaactgctttgccttttgggttgtttatgccccagaggcctcaatacacaagtatttattaagcccaggaggtgtggtcataattgaaactttaaatgttcactgtgttttattcctatttttgtgttttattcttattaccaaagaaaagtaagttgaaaaaaaagaggactaaccaaatatcttaaagggaagcaaattcaaattagaatgttttgcctgtgacaagcctcgctttggatttcgctttccaactcagctgtctatgttgttttccatttaataggaagcaatggcaaaaatgagcaaagttgggaaagttgtgttcccgagactacaggataaaaagtaagtgtgtattttttatatgtacagtgctaaggaagtgagcacatacacacacacatgcaactatagatctggaataaactcaggtggtcaactaatccagtcctttaatttgtggttaagaaaactaagttccagggaggtaatgtcaccttcacttacctaaggctgcagaactatgtagggccagagctgggggtgaatgtaagcttctgaactctcagaccaatgttctttttcccaggtaattggcagcaaatctgctcttctctgttctaaagtagggatctcttatatctccatcaaaggacccagtagaatctgctcattcttttactctttgtatcacttggcatcaaaggctaaaaaatgacattggtcagtattttaatcccaattcaacaaaatattagtttactgaattcctgctatattcaaggcattatgctgggctccaggcaggtgttacaggggaataaaacacaatttaatttaggcacataagattattttagaacaacgggataagttccacaattgaagtattgccaggtgacaaagttgcccaaggaagaaagagatgggagcctgtagagatgagagaatgcttttgggaggaggttatgtccaagctaactttaagctcttgtaagaaattggtagacaggccaaggcaagaaagaacattcatagtagaaggaataacatgtacagttataaaagtgggagcagcatagtacattcaggttactataaacaactcataatccagaaacacaaagtatgagatggggaatggcaggaagtgggactagggaaggatagaattgggtagggggaggtcagctcataaataccttggaggccatgctgaagacctccaacctcatcctataggcagaacagagatgctgaattctaagcagtggtgagatctggtcagatgcagatcagaaaaatccctcttaaaggatccagtacagggggctcagggtagaaatagagggtccagataaaaggctttttcaagaatccaggctagagatgtaaaagacctctattaatttgctggtagtgattttgaagatgaaggggctgttgtggaagtgcttttataattttagggaagtattcgaggttaagacctaaaagcaaattccacttaacatgatgaacaggcaaatgtgcagatcccactgaagcaggatcagtatttaacagaattggaaatgttcatggaaaagcaatccactttcttttcatttcctttaactccacatagagtcaggctgctaaccctccgaatataaacccttctctaaaggccagggtggaaggtacaggcattgcgtaggggagctccatgcaggaaggtggagagatctgagttcccactggcagtaggagctatgggctgctgtccctgtttctgttccctggaggcagctggagcatccctctttttgtgaaattagaaagattgtctttctccatctcttccctgaccctcccaagacttttcagggaagtttttaagttttttccgtaaaccccacgtgttcagagagtcctccgctgcttgctgggagctggcagctggcagctgttctctgcgaaggaggcggcacacacggtgctttagcaccatctgcaggcaacccagagatttgcaaggagacaggagaagccagtttccttctgagccaacctcatctcattgcctaatagatcacactgttaacgatgtgggacgacatttacttaggcctctgccacacagaagcagggactgagttgaggcacattttgaagagaggggattcagctgattttaaaattcacagtcacggagagtgtaatttagtgactatagtttaataataaatgtttaggatgaccccaaattgcattattatgttcagtccaaatttatatgtggctctggaagagtcacttaaatgtgctttgagaaatttggtgcattgaaagacactatcaacagagtaaaaaggcaactcacagaatgggagaaaacatttgcttatcatacatccagtaagggattgatatccagaatatataaatgtataaagaactcctaaaactcaacaacaacaaaaaagcaaaaacaacccaattcaaaagtgggcaaaggacttgaatgaatatttccccaaagaagatttataaatgaccagtaagcacgtgatagggtattcaacagcactattaggaaaatcaaaactaccgtgaggtaccacctcacacattaggatgctactattttaaaacagaaaacaacaaatgttggcaaggatgtggagaaattggaagctctgtgcatagttggtgagaatgtaacatagtatcgctgctgcagaaaacactatggccattcttcaagaaattaagaatagaattaacatgtgattcaggaattgtatttctgagtatatacccaaaagaactgaaagtagggtatggaagagatatttctacattcatgttcacagcaacattattcatgatagcgaaaatcatgagagcaacctaagtgttcattagtagatgaacatataaatgaagaatgatatgtgcatacaatggagtattattcagccttagaaagaagcaatttctgacatgccacacatcagtgaaccttgaggatattattctaagtgaaataagataaccacaaaaagacaaatactgcatgattccacctatgtaaagaataaggccagtgcacaaagttgtggcaaagttgtcagtattaacattgtaaatcaagtgtgtgtgaaggggtgctcaccttagctcccttctagatattttgagattctaaagtcaagaaatctatctcatgtagtgaaagaattccttaccgttatattgtcacagagcatcattagtaggagcaaattgttcctaaaataattctacaactaataaatttggatgctcatagagtaggtcttagtagtacctacatatagctatattgatgatattaaaatattaattatctaaaatttagtaactagcatttatatcacttattatgagtcaggtactgttctaaatgcttttcatttatttccacatttaatctacaacagctctgctgaagtagatcccataattatccccatttacagatggagaaatttaggcagaaatagtttaagtaacatatccaaagtcacacagctaatgttaggccacattaagattccaacccaggctttggagttcgccttttaaccctgtgcttggccccgtcacaactcctacgttaccagaatgcttacagtctaataaatattgggtaggggactcctactaacatagctatgtgtgacaagtagaagtccctgtgtgtatccaaggttactcttacaacctctctctgccaatgcacaactttgcaccaaaatttcatcatgaggactccttttcagagcaccccagaattgagcaagacatgctaaactggcttcttcaccccctcaccccatgtcagcttcccaaccaagaggagtaaggacaaagttgcaaggctgcaagtataatttgtctcggttcctattattcctttcaggattatgatgccagagcagcttcagctgttctgctgtctgattcatggccaataccagttctaacaggtctaacccaaagagtcagccagataggacagggagagcaacggccactgtgagatgtctggaaggcgagcacagctctagaaaaggcattagctacatttccatggggttttgctcctggataaagcaggtcacaagggaaacctagatgtggaatctgcaaaagggcaattaaaatgttcagtctttgtccttggtcaggctgtgattttaggccagtcatcaaacctggggctagttatataggaaatacttattgaagctggcaatgtgaaagagtctccattaagtccggcctttttgtatatacagtagaagctttgaagtcagacagacatgagtttgaattccagctctgccagtttttatctatactactttgtatatgcctctcatttaggaatttttttttttttttttttgatggagtctggctctttcacccaggctggagcgaagtggtgcaactcaaccacttcacagtgaacgggggacggttcactgcaacctccgccccccgggttcaagcaattctcctgcctcagcctcctgagtagctgggattacaggcgtccaccaccatgtctggctaatttttgtatttttaagagatggggtttaaatgttcttatttctaaattggagataataaaacttcatccaggtcacatataataggtctgaaacatgctaattcattgcccaggatgctgtaagcattcagaatctaggtgtcagcatcaccaccacacatatatttccattcttctaaatgtacagggaagccctgtggcagttttgtcttgagatcattcaacatatttatatttctcccacagatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgaggtattgtttcatcatttctgtattgtctttcaataaagaaaacaaacatgtgcaaccagaa

SEQ ID NO: 342 - DNA, 384633 bp, Homo sapiens
agctggacgagcggcagcagctgggcgagtgacagccccggctccgcgcgccgcggccgccagagccggcgcaggggaagcgcccgcggccccgggtgcagcagcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggtgagcgcgcgcgcgcagggcaccttcccgggcccccgagggcagcgccgcgccagggaccccctctccgcgccctctgcgccctccgcgccctccgcaccctgggaccccgcgtctccggactcccggctccggaccctgctgcccgggactcccggatggacagtcctgccgttgccctgtccccaccctggtcccagacgggccgccgcggggcgcctcctgccctctcctgctctcaggcgcctctagagcgcccaggggcggcgtcgcgggagcctttgctccacctgactaggagcgcgcggggtctgtgcctgccctggagggcagcgcctcgggtgctctccgacccggggttccctatctctccgcctgcttccgggcgcgaggagccctcgccccccaccccttgtttccggggggggcggcgccctgggtgtccttctctatctccctgcgggcatgggacatcctttctcactcctctgtgcctccgggcagcgccctgtgttatctcccattgcccctccccgagggcctgggttcccctttccactcctcggtcacatcactgcgggcccctttcttccccagtccctccagtagtggggcatcctttcctccttcccagtccccctcccagaggacaccaccgccgcggggtcactctcgccctccctctgaatgcgtctttatctcttctcttttcccgagggtgctcggggcatctatgggtacatctgtcgcctgccttcagcccctaccccgacggaaacgctccccactatcccgccacctggtggtcgcagcctcctctcttctgcaggagtgaaggcagatgggggttacagccgagctcccacctacccccacaaaggcggaagactcttgggcacccgcctgtggctgggagtttgcacctggggtacagaggcagggaggaaggcgggtgactctgtgggtaactagctggaggctgggccccccgggctgcctgacatacacctccttctgcttttgcaggggcttcgggaagcagggattccagtgccaaggtaggctctggggctttggggatgctatttgtgggaagagagggtgaaaaatactttatagaagaagttactgagttaggcagagagtgaaagaatcacgttggtcggagtgacctcccaggctaggaattcttcaccacaacagggtcctttcaaggggtgtgtgtgtgactggggccgatggcgcttgggagtcttacatgccaaggaagttcacctacccttcctgccttcccggctctggaagagtcaaagcggtctcctgaagcaatcctggcatggtcagttccgctgggggagaaagtgttttcccgggacgtttctgggagaacctgtcctccttagttcccctttctctgcccatgtcccttccttatctcacccagggaggttctgcctctccctgccttgcagaggtctctgcaggtggctgccgctcctctgcagatggtgcatcccctagaaaggcgactgtgtttgtcgcctgggcctcctctctctctgaaagaagtatttccagagggagtgtttctcagatcctggtttaaatcaccctatcttctgggttgaaacagaaaggtctccagggcactggttacctgagttcttgcatctggcttgagatcctggactctaaccaggggtatcaaacctgctggtggtgagttgatcacgtgtaaagtgtccccctcccccgtctttggggctcatgtctaaaagacagattgcaaattggctctccaggaccaaaagttacccgcagctctgtgtagcccttagggtgtcttacttgtgaatttgatgtgaacgttttagaactgggagatttcacatacacatcctaatttccaactttaactttgctgagaaatggtctcactttcgcttgaaaacaatcgtttggagctgagagccgtcgtcgtagatggggaacagccttaccattttgtctcagttgatcccagtggggaacacttcacccatttctggcccctgtgggcatttaagtttgcaacctctcatctggaaagtttgtgtgttatgttttctttttaatttaaattttaatttttcactcttgggcttggtaagattgagtttggtaagaaacggcacatttctggggtattgtatctttaggggcaaagtgaccaccaccctggtgagctgggtttaaatcaaaagaaagtatttgagtgtggaagagtctgacgtgatttagcactgactgacagttttgtggctgcacctccaccctccagggaaaagtaaagtgatccctagtgagtgtaggtggcatcgtcagtggtgcagaatgtttgcttgctggcagcatggcactgtgctcctctgagactcttgcatactcttctgagatcggggtcccggtgggctcagtgagccctgccaacctacccagcctgtcttaccaagatttggatcctctgcaccacaccagaggactcctcaagtctctttaagtggcaacaacttaggccctggtgcaaacaaatttggattgttttctagaactttgacccctcaaacaaaatgccaatggtgtcttggcaccggaatgtgtaatttcttctttgaggttgcctttcacttccatgaatcagtttcagtctttgtctcttgctgagatcgggggcgatttttaaacatttttaccacggatcttctatgccacctgctctgctgttattgatggatgggaaagtcactttggaatgtgcaaggcatgacacatttgaaataggagatcctttaactcaaagtctggaagataataggaattttctgatgttaagagaaaaaggcagaattaaagtttgtaatgaaatatgggcgctctagagataggagtgtcttttttttttttttgacagggtctcactcttttgccccggctggagtacagtggtatgatcagagctcactgcagcctcaaactcatgggctcaagtgatcctcctgcatcagcctcctgattaattgggactacaagtacgcaccaccatgcctggctaattttaaaacaacttttgtagagaaggggtcttgtgatgttgcaagactggtcttgaactcctggcttcaagcaaccctcccacctcagcccccaagtgttgggattataggtgtgagccactatgcccctctggagtgtctattttttaaattgcctttctttttctcttccctgcctccccaccaagaggcagcgtagagaagtgggcatttgcacaggctaccaggcaagtccctgtcggtctgaatcctagctttgagacttcccaggcatattacttagcctctctgtatttcagcctccttgtctataaaacggagtcagtaacagtaccatagtgtggctgagcagctccaactcattgcaatatccaagattcttggaccagagcttgacacagagtatgctcagaaaatatctgctcttatgattgtccccagactaccccaatggtggggcagctggcacgagagaagactggctctgcagggttgctttgctatggaactgcctgccaggtaagagtcaaaactcagccatgaacttctggtcactctgtgtagctgctttgacagcatattccatttgggcagcagtagggaggagtgaggggaggggcagattggcagtccctgaaattgagatgtttagaatgggaacatataggaaagagggaaatttatccctggtactcagcattgcctgggactaattctggaaccactgaggagttccttagtatctgattgttcttggtatcagatatttcctctgaaagtaaatccacttacgatggaatcaacagtttatacaaaacacataaggttttatgatctcacttaagtcagcaatccagagcccagggcctcaggttcctttgagttttctgctccactatccctggggagtgacaattatctcatggtccaaaaaggatgctagacgctggagtcctcacacccttctttcagctagcaggaaggaagaaaggggtaaagaagggcatatagcacatgctcggtgtcacttgtttaagttgctcaagatccttctacctacatcctcttagctagggtttaatcacatacccacaccttgctgtgagggagcatgtgggaaatgtagtgtttatttcaggcagccactatttagaggatgtttccatttcaaaaatacaagcagagagaggatgttgtctctgccactctggtaggaggtgtgtaggatgatcgcaaggcaaagaaaccattgagagtaaccttcaggctctattacattgtcatggaaattggggacactgctatgggttgggagaggaaggatggaaaactcataaaccttgggaaattatggatttctgtgtgctcaggggagcttaagaatagattttcttgctttcgtatgatgataggacgaaactctaggttgactgcctcataatttctccctttttgtttccactctgtctatttcttataaaaccactctctgggaggtaatttaagaatgtgtttgatgacagggaactggggctgaagatccctattgtaaaattgcctaaattctagagtagaagtggaactcctttgacaagcaaggcagatttctctctatggcatttttttctttgccttttatttatttatttatttattgagacagagtctcactctgttgcccaggctgcagtgcagtggcaccatttcgactcacggtaacctccatctcctggggctcaagcgattcttctgcctcagcctcccaggttgctgggattacgggggcctgccaccacgcctggctaatttttgtatttttagtagagatggggtttcatcattttggccaggctggtcttgaactcctgacctcaggtgatccacccgcctcggactcccaaagtgttcagattacaggcatgagctacagtgctggctgtttctgtggcattctttacaggaacttaggacctgcatttgagctttaattttaattaaagtcttctctaagaagatttttggtagagagaaaaaccttcttcttttattttaaattttgtttttagagacagggtctcactgtgtggcccaggctggagggcagtgacatgatcatagctcactgcagcctcaaactcctgggctcaagtgattctcctgcctcagtgtcctgagtagctgggactgcaggtgtgtgtcaccacggcccttttttttttttttttttttttttgagacggagtcttactctgtcatccaggctggagtgcagtgacgtgatcttagctcactgcaacctccacttcccaggttcaagtgattctcgtgcctcagcctcttgagtagctggaactacaggcacgtgccaccatgcccggctaatttttatatttttagtagaggtggggtttcgccacgttggttaggctggtctcgaactcctgacctcaggtgatctgcccgccttagcttcccaaagtgctaggattacaggtgtgagccactgaacctggccaaatacatattttttaattttaaaattttttgtagagatagtggatcttgctttgctgcctgtgcctggtctcaaactgccagcctcaagccaggagtctcattctgctttggcctcccaaagtgtttgttgtttttgtaaaggaagtgactttggtagaaatagagaggcaataaaatatagagattcagaattcttagcaatgagttggagtccagtagaattgggtatgtatctctgatggagccgcttactccctgtgtgaccttgggcaagtcgtcccccagcagcaactttggtctcctcatctgtaaaatggggataatagcacctaactcatagggttatggtgaagaataatgaggtggtgcatgagaaatagccacagcaagtatcaatgactctaagtgagaccatcagtattacttgattagctgtaggaaactgtgtcaaagtgggacggagttcattctggaacttgttaaatgactaggcctctttcatgtacttagatagtttctcttcttgggtatatttcttcctgggtattgggtaacaccagtgagtgctcagttcagtgtctgggcccagaaacccatgcctggttagcattgtcttttcttctgagaaagatctgaacttgccatggactctctagaaaaaccccagtgtacaaattttctatgaaaagctagaattgatgattataatgagtaagttggctcttccttttcccatgtagattagaaaacatgtttttaaatcttctaattgaaattattcttaaaaaaccccaaagtctgacatgactccaactattgttgttttcatcaatatcaatcctatcaaatcaaagtttattttagtgtgtaattaacacatgtagactagaaaagtttgcacttttttatatcacaaaaaaggttaattttattttctatggaaagctagaattgatgataatgagtaagtcagctcttctttttcccatgtagattagaaaacaggtttttaaatcttgtagttgaaattattcttaaaaaaccccaaatcatgacatgaatccaaccattcttgtttttatcaatattcaccctatcaaatataaagtttattttagtgggtaattaacatgtgtagattagcatagcatatgtgtatttatataacaaaaaatgaatcaaaagttaattttattttgggcagtgttccctagaaacttataatatggccccatgcacttcaggttgaattttcttagtaaaatcataaagaggtccattttttcaaaaaatcaccaagtcaggctgcaagtttagaggttacttctattgtttcacttctctttcttcccagaagcagaccccagagacctgtgagccaaactccactcaccttttagcttattctaaatgtgtcctgcgggcttctctgtgaataaaaggcagaggctttttgacttcgtgtttgatgatttggcttttttcttttttttaccacctgacgggggatttcaggctcaatgtcccaatcgaaataagaatctttgagtgggttaacattgagtcttaaaaaggagggctgatttgttggagaggcaacaacgaattcatttttcactgtagagcactcaggaggagtctgaagctttgtcactgggcaacagaatgcctttctaagtaaatatggaaaatatgacctttgaaaatctagctgatatgatatatagattcttaggatataatttttaaaaaatatattatttccaagcactaatgatactccagagatactgcccacaaccagatgcagcatgtttatagtgtatctaggccaaaaaaaaaaaaaaaaaaaaaaaaaaatagaagatacagaagaaggcaattggtcaaaagattaactgaaggtttgaaaataattttatacacatttgtactgttggggtctctcttctctctgtctctgcttatccttctgtctctgtctctttgtttccatcacacatgcacacacacacacgtgtatacacacacatatatgtaagtagatcaatatgttataattttcacaatacgcatcttcttttgctacttttcagatacaggtcattaaattactaagtataatttaaaatatatggtctggccttttaactctgcagttcaattaattcttgggtagatagggggatctgctgaaaagtttgtctctgacgccttcaaaggtaagtcccttatgttctggcatttgctctaataacatgaattctttgacttcattcatccaatctcttcattgaaattgtgtgaaattccatagatagaatgttagcctttttacagagaatacaacatccacagtgtttacatatggcatttggaggtgtgatggctgcttgaaaatccagtaggaaatttgtctattcaccacatacattcatttattcatccatccatccctccatttatccacccacctctctattcatcatccgtttttctgtttatctatttgtccatccatgcatccatcccttcactccattctccttctaaaagttcttttttttgagacggagtcttgctctgtcgcccaggctggagtgcagtggtgcaatctttggctaactgcaagctccacctcccaggttcacgccattctcctgcctcagcctcccgagtagctgggactacaggcgcccaccacctcgcccggctaattttttgtatttttagtagagatggggtttcaccatgttagccaggatggtatcgatctcctgacattgtgatcctcctgcctcggtctcccaaagtgctgagattataggcgtgagccaccgcgcccagtctcttttttttgtttagacaaactctcactctttcgcccaggctggagtgcagtagtacgatcttggttcactgtaacctccgcctcccaggttcaagtgattctcctgcctcagcctcccaagtagctgcgattacaggtgcccaccacctcgcccagctaatttttgtatttttagtagagacagggtttcaccatgctggccaggctggtctctaactcctgacctcaagtgatctgcccacctcaacctcccaaagtgctgggattacaggagtgagccaccacacctggcctcactgattaagttctatgtgtcaagttctatttgtcaggaactattttaggtgacagaatacaatggtgaatgaaactgagaaaatttctgttgtcatggagcttatgatgtagcggggggagataagacattctacagatcatttcactcatatttaacctcatttttattaggtactttgaagaaaatggactgggtaccgggagaatatataatgggaagctaacctatgtaatggctggggatgcagtcagtggtctgggaattaaaaaaaaaaagcccaacttctcattctcattttctgaggtaactggagaaagtctgagttgtcaaggaactagagctaaaaatctgtattgtaaaactgcccatatcctggataatatatgcaacagggctgaaggcagtggctcatgtctgtaatcacagcactccggaaggccaaggcaagaggattgcttgaggccaggagttcgagaccagcctgggcaacataacaagaccctatctcaattaaaaacaaaacaaaatatgtgcaggagacttatctttgtgacattctatggagaaaccgtaaatatttatttgtatcatggctgcaagtaagatgagtaagtatttggtagaactagcctgttaccttgagatggcttctttcccagtttgacagagaacttcatctcctcttagttaataactcagataatgagctgacttcctttttgtttagggtttacagtttgaggtggctgttctaaagaagaaaaatcagacaatttcagaggtggaggagcaagtctgggccaatagattgaaaataaataaaaagagagagcacggcatttcagtgagaggcattttgagctgaaagtcagttttcagggagcacaagattactcacattgcctgccaaataccttcctcaccctgtgtccatctctgatatattacaactcttcattcctttggcttaggcagtattttctcttgttcagaagatactttttaagtagtttaacaataaacagtgttgactcacttatagagaaaggacttttgtcaagtctgtctttctgatttcattaaggagaaagtctcagttggtgttaatatatctttaacaaccctctaacacaaatctgggcacttagtagatatctgttgaatattctttttttttaattataaaggaactacagggaattatgagaatgtaaaactatgggctgggtatggtggctcatgcctgtaatcccagcactttgggaggctgaggtgggtggatcatctgaggtcaggaattcgagaccagcctggccaacatggtgaaactccttcactactaaaaatacaaaaattagccaggtgtggtggcatgtgcttgtagtcccagcttctcgggaggctgaggcaggagaatcgcttgaacccgggaggcagaggttgcagtgagccaagattgcgccactgcactccagcctggcgacagagcgagactccgtctcaaaaaaaaaaaaaaaaaaaaaaaagttagtttctacctataaaccaacttttttttgagtcagcgagggtacacttttacctaatgttgagcctggttctgttctaccctgagcttgattctgtactggctattcctccttgtgaacagagaagggaagttcagtgtctttcctggaaatttttggtgttgtaaggatgctcagtgttcctgaaggttgagaggaacagcaaggacaggatctggtagagatgtcgcttttattcagaagtgctaagctgttaatcattaccatggttgttattaccttttaattgccatttgtcctgcttgtttgtggtctcctgggcatctccttccccctcagcccacaagcagaaagttgccctacagagtcaggaggagaactcaaacccagaccagagagctctgatccactcctatgggtcttggaactggctaagtagatggaaattaactgattcaagatatgcaacaccattagttcaaccatagctgtgttcctggggtgaattctagctttcttttttctttcatcttgctacttcccagagaccagactttgggcctctagggaaggagtatcaaattgggcttgagagttcaagctcaaaacagacctgattttaaatcttggttctgcttctccatatcttcatgacctttgggtgggtaaaatatgatcctgcctctatctatctatctatctatctatctatctatctatctatctatctatctatctatctgtccatctatctatctatccatccatccacctatccaccaatacatccatccgtctgtccatccatccatccatccatccatccatccatccatccatccacccagctattcttccattcattcatccaaacatccacccatccacccagctattcttccattcatccatccaaccatccatccatccatccatccatccgtctggctatccaaccgtttttccattcatttaatatatatttattggatgcctaccacatatcaggtactgttctaggcattggaactagaacagtgaacagaacagcatcgctggcttcatggaatttacattctagtagaataacagtaataagtgaataacatagaacgaatatattgtataatgtcaggttgccatatgggctttgaagagaagtaagacactgtcctcacccttaaagatcttcctggtcttttaaaaggagaacagcacatggccaattagttctgagacataatgtaaagtgctacaccaagaatgtaaaaacactttggatggcatccctactcctcctcggaccggtgaagattccacagaggaggtgacatttgggaacagtcttacagcaggagtgggagttcccggattgacaaggggatgagggcaggggagggtgtttcaggcacaggacaggacaacgcagttgagatagtgaggagagagaatagggcacatgcagggaacaggaagaagagggtgtgagggagggaggagcaggtgggaggtgaacgtcatatcagaggggttggcccctgtgaaggcagtgtagtgactaggaagtggttgttgtcactgttttaaagtgggatgtgtgggggtgagtgaaatggccaaatgtttgaaaaagaggagcatgagatgcctttggcaacaatacttgccatgactcaaatcctgaaattctaggcctgcagtgatggaagtcaggcaggagaaactgaaatggccatttagaagcagtgggggtgccttaccggagcacctcgtggctgttgctatttttcacaccctaaagagacatttggaatttcatgtcagtcatattgttgattgttctattttgagggtggttactagttatttttatggttctaacaatagggacatctctcttcactgtatccttagacgcggagggccgtagaaatgaattttcctctgaaaggcatcctcccactccctctccctctccactgctgtcacccagtgggtacgtgtttattgagcacatgctgcacatggtggtgaagagttggtgttttggagaaagaaaggcttcgatttaaatcttgacttcttgctgtgggaccttaagcaagttacttaacctcttcgagcttctgttttttcatagctaaaaggatataataataaaacctactttatgtgaagtgtttcttagcaccctacctgacatatatacagtaagcacttgataaatggtagctatttctgttcttcctaggactgggcactgtccttgtccttactgagtttataatcctgttggggaggcaagatgaatgctcttgaatcaaggagacgacgcaagaatggatgtgcttacatgtcgtggtcaatagcattagctgcaccttacagtggatcttagagagaaatgcttggttggggccggagaggtgatttgagtgtgagtgagcacagtgctttctgagaaaccctttcctggcctgcaacactttaatttgtgggaaacctcaggaagtagaattgcaatctgtgatcgccccatcggctgacctcacttcaaaaatgtattggtagcatttcaactttaaatagatttgtgaccatttcacccttctaaatttgggttcccttcaccctttgggtggagtgtttatatcccttttcggttgaagaagctgacagatagtgtaggtgaaggtggagggtgaagtctgaaggacggtcgcttgtctcattgggatagtcagggcagtgatttttgtgggatggccctatattgaagatcttctttccctccctaaaggtagagaccattctttagagtttagtgagtgctgcaaatgaagatttgatcgttatttggatttttttgcatgtgtatgtgtggattttttttggtagttatccagatacattttgtggcaaaatttatggctgagggtattgataattgtttctgagacaaacagtgcacttagggaaacaggattgacatatagagtagagaaggacttctttttatttcagttggatattcatcttttggtggctagctttttttaaaaaaactattaatattatttttgattgacaaatcataattgatggggtacaatgtgatgttttgatacatatatacaatgtgtcatggttaattcaaactaattaatataaccatcagcttgtttacttattttttatggtgagacatttgaaatttacttagttatttgaaatatatgatacacttattattgactatgttaccctgctgtgcaatagatctccaaacctattccccttgtctatctgaaactttgtatcctttgatcaacaactccttccctcatcccagattctggtaaccatcctcctactctctacttctatgactacgactttattagattccacatatacgtgagatcatgctgtatttgtctctgtgtttctggcttattttacttagcataatgtcctccagattcatgtatattgtcacaaatgatataatttctctcttttttttaaagtctgggtaggattctattgtgtgtatacaccatactttctttattcattcatcctctgttgaacacttaggttgattccctatctttgctattgtaagtagtactgcaacaaacatgggaatgcacatattctttgacatattgatttcagttgctttaaatatatgcccagaagtgggattacttaaaaaaaatttaatttaattttttttaatttgagactgagttttgctcttgttgcccaggctggagtacaatggtgcgatctcagctcactgcaacctccacctctcaggttcaagacattctcctgcctcggcctcccaagcagctgggattacgggcatgcaccaccacgcctggctaattttgtatttttgctagagacggggtttcactgtgttggtgaggctggtctcaaactcctgacctcaggtgatccacctgccttggccttccaaagtgctggaattacaggtgtcagccaccatgctcggtggtagttcacttttttgtttttttgagaaacttttagtactgtttttcataaggctatactaacttacattcccaccaacagtgtatgggtccccttttctctacatcttctccaacatgttattttttatctttttgataaaagccattctaacaggtgtgaggtgatatctcactgtggttttaatttgcatttccctagtgcttagtgtgctgaacattttttcaagtacctattggccatttgtgtgtcttcttttgagtaatttctgttcagatcccatttttaaatcaggttatttgtttacttgctattgagttgtttgagttctttgtatattttggatattaacttcttatcagatacagcatttgcaaatatttttcccattctgtgggctgtctcttcactttgttaattgtttcctttgctgtgaggaagctttcagtttgatgccctcccatttgtctccttttgcttttgcttaatcattgcccaaaccaatgttgtggagtttttcccttatgtttttctctagcagttttatagtttcaggttttaagtctttaatcaattttgagttgattgtgtatgtggtttgtaagataaaggtctaattgcattcttctacatgtggatatccagttttcccaacaccatttactgaagagactgtcctttccctcattgtgtgtttttggcacctttatcaaaaatcagttggctataaatgtgcaggtttatatctgggctttctatcctgttccattggttgatgcatctgtttttatgctagtaccgtgctgttttgattacaattgctttataatgtattttgaaattaagtcgtgtgattcctccagctttgttctttttgctcaatgttgtcttggctatttggggtcttttgtggtcccatatgaacttagggattgttttttctatttctgtgaaaaatgacattggaattttgataagaattgcactgaatctgtagattgctttggctagtatggacattttcacaatattaatttgtctagtccatgaacacggaatatcttttcatttatttgtgttttcctcagtttctttcatcagtgttgtatagttttcagtatacagatagtttgcttccttggatacatttacacctaagtaattttttttttgctgctattgtaaattagtttgttttcttaattttctggtctggtagtttgttattagataagctagtatataaaattagaataattagataatctaatatagaaacactactgattgtatgttggttttgcatcctgcagttttattgaatttgttgatcagttctaacagcttttttagtggattctttagggttttctgtatataaaatcaccttgtcaacaaatagagacaagttcacttcttcccttcctattaggatgccttttatttctttctctttcctaattactctggctgggacttccagtactctattgaaaagaaagggtgagagtgggcgtcctgatcttagaggaaaggctttcaacttttcagtgctgagaaggatgttagctacgggtttgtcataatagagcccatagtgtttattgtgttgagtgcatttcctttataccttattgctgagtacttttttcatgaaagaatgttaatttttttcaagtgcttttttttcctgcatctattgagatgatcatatgatttttatcctttattttgttaacatgggtatcacatttattgatttctatgtgttgaaccatccttgcatcccagggagaaatcccacttgatcatggtgaataaaattcttttaatgtgttcttcaatttggtttgctaatattttgttgaggatttttccatctatgttcatcagggatattggtttatagttttcttctcttgtgtttttgtttggctttggtatgatagtcttggataatgagtttagaaatactcccttaattttttggaagagtttaagaagaattgattgacatccagatcaagaaacagaacatgctggtaccctagaagcatcatctcacaatccctatcaaccgtatccttcaggagtaatcactatcctaacctctatcacctatgattactttcatctgttcctgaacttatgcccacttttctgttatgcaactccattgacttatgcccatttttctgttaaaaaatttaaaaagtgcagagctttaagttactgaggctgagcctgagaaatgttagctgggacttttttagttttgcatagaggaagtgaaatccgtatgggagacaggcaccttctggaatcacccattggggaatggtgccgtttgccttctttggggaacatctgcttcctgtttcaatgttgcccatcggttccagactgttcaacaaggaagccagggcattctgacagtttttccacacaataatttagctctgtaaatactaggaaaacttgagctcacaaactatttttagggcttaacatttcaaaaattctgtattagtaagaatctattaaagctgctgtaacagacaaaccttgaagtctctgtggcttgacagaagggagtttatttcttactcatgtcactaaccagtgcaggtggtcctggtcaggacatcttccacagagtcacacaggaccccagggtcctccccattgggccagtggaaggggaaagggaaattgagaaagcacactcatttcacaacaacttcagctggggaaggaagtcacatcacttctgctcacattctatttgccagaacccaggcaaagaggcaaccaacggaagggggtcctgggacatgtcgactagctctatgtccaggaggaaaagaaaacaggttttgatgaactcagtaaatctcactccagtctccaaagccataatttcctttgtctttctttgcggtgatgtatctagttttatctctcacttgactggtaaaactaagatgcaaaactctggacgtctttatcttatcaaacatagcagggaaagagtgagttctatttgtgttcctaaaagtgaaataaagaagcacttttcttgtttttagttattagaacaatctggctcttgtcagactttctagtttttcaatcagtcagaattcttgcctctctggttgcctgttgtattaatccattctcatgctgctaataaaggcataactgagactgggtaatttataaaggaaagaggtttaattgactcacaattcagcatggctggggaggcctcacaatcatggcagaaggcaaaggaaggtcaaggcacttcttacatggcagcaggcaagagagcgtgcacaggggaactgccctttataaaaccatcagatctcgtgagacttattcactatcacgagaacagcattagaaaacccacccccatgattccattaccttccgccaggtccttctcatgacacatggggattatgagagctacaattcaagatgagatttgggtggggacacagccaaaccatatcacctgtggacatcccaagcagatctctttgaggccgggttagttctcttctaagctgacttgttatatagaagaatcctttgttggttctacttccagatatttgactggacacccaacaaatcaattatctattgctggatagcacataacctcaaggcttagtggcttaaagtagccactgttttatttagttttagtttctgtgggtcagtaatttgggctgggctcagctgggtggtctgtctgatctgggcagggattggctgttcttggctgggctcatttaccttcctggggcctcagcagggatgtctaggacaactggggcctctcttcaggtctttcatcttccagtgggctatcctgagcatggtcatatgctgatgggtgcattctctgggcatgagcaagggctgcagggcttcttgaagccaaggctcagaacatgcataacatcacttctgccatattccctggtcaaagcaaatcacaagcccaccccagaagtaaaggaggaaatagagaagagaatagagatgcctcctcttgatgggagaagctgcaaataatttgtgatattttttggaacccaccacactaatttcagtgtggtcctcgcaattgcttggctgtctaaaaacatactccagtctagtgtgcatttctgaaaatgaacttgatcaaaggcaggccccaaatgagtgctcaacatttacacctgataataatactacctacctcctagggaaatggtagggccagatgagatgctgtatgcaaaggatacggccaggacttagtgcacacgcaacactgaatactaccaccatgactactgaatactgccatcaaatactaccgttactaccacttggcactccctaaaagcttgagattcagagaaaggaagacaaagcccctgtacttgaggagggagagaataaagagagccggcgggggagggggtggcaggagagagagagagagagaggcgtgtgagtgagttcttgcaacacagtgtggtcagtgtgatcacagagctgtgatggagtgcggatgaggtctgatgacttactggtcaagagcatgggttcaggcctcagttcctccccaatcacatgtggggtcttaggcatctttctttttaatcttcagtttctttgtctgtgaaatgaagataatggcacagagcctacctcccagagttctatgtggattaaatgagacaggcaaacaacaacaaaaaccacaaacaaacaaaaaacaaaaatgaaaacaaaaatcatgtgattgcttattaaatgttagttatagaaaaaaatataagttcttaaatgtgcccttgtaaaaatgtcctaaagacctcatctttatttagttcttctgcaactctggctagcatcattgataaattgtcttaaaagatgaagatttgtatgcaggtggtttattggggatgtagctcttgggaacaacatctataagggatagagggaagcagggaagaggtagttgaactgtggtgcaatagttgtaatagaggccaaagccaattccatggctggagctgagacggcccttcagaactgggacaagccaatgcatcaagtgggcattgattgtgggctgctctttggaaggcagcattaccttgggcaaagcagctcccttcttcaggggaggagtcccagggaggacacagctgtgagcaattggttttcccagcagctgggggaatgagtgccttgtccctatagatggttttgagggggctgcatttgggggaatgccttctggggttcactgcgtgcttctatgtctttcttagaggttcatttcaaactataccttggttcattcacagtactgatttagttactatccagattcatagactgtacttgctggcactggaatatcatggacagagagtcctaatctgactaggcctagggaatgacatgggaatagcttgtcctgggtcatccagctaccagagaggagagctgggattcatatccaaccaacgatactttatacctcacattacttctgttatgctacacactcctgagtcacaggagattccaacttgtatttcaagcccagactgcatgacttcaatgtcctgttgcccttaacccctgtatcagattgcagccccactctggaaagttttcttgaattcttctatgtatgttttttaaactgtgggtcatcactcattagaagttcatgaagtcaatataataggtcaagaataccatgaagaaagcagaacagaaaatatcacagtgcatcactctcaggaagggtagatattgtttcacgaaactttttttttttttgagacagggtctttgtctgtcgcacaggctggagtgcagtggtacaatcatagctgactgtatcctcaacctcccaggcccaagagatcctcccacctcattctcatgagtagctgggacttgaggcacatgccatcatgcctggctaatttctaaaactttttgtagagatagggtctccctatgttgctcgggctggtctcaaactcctgagctcaaacagtcctcctaccttggcttcccaaagtactgggattataggcatgagccactactcctggcctcatacaatttttatttgatataaacatatatagccatgagtgaactgggtcaaaatgtaaaatgtgtctcttactgcaggtaactgtcaatgtagttcgaatatcactgtgaaatatatagagaagaggctctgggggctcatgaacttggcccatggactgttgaggctttttttttaatctttagagatgatataaatgtagtgctttgaattctttataattagaagttttattcttaccccatcaccatgtcccaagataatttttattatcatctttcagctttaacatatcacagacaaaagttatttttccaaatagaattttaagtatggtataagaggtttttagaaatggaatgattggttttggcggaactgcctggcctgacctgtcactcgggtgaagtgtcagagagctgtgtcgaatgctggcggagaactgtccctctcctgcagagagaaggagctgcttatcctgggggataatgtgggttgagaaagaagtgttttatgagcagaatcagcacagagggagggaggaggaggtgtttaggggctgcagagagccgccagaagatgtgggaacagtatgccagcacggaggtgggtcagatccccatggtgggactctgctgagggttgcctccagccgagacttccaagggctgggattcagtgtgtgtttatgttctctggtgtgcctgataggtgggggcccacatgacagctggcctctctgtgtttcccttctggccgtctctgatttggggcccaagggccataggggggccagggcactccagatgggacgaaaagtcaagtccaagaaaaaaatgaaatccgggctaggcttgtccctgcttgaggatgtgagagagagagagagagtgtgtgtgtgtgtgtgggtgtgtgcgcacgtgcgtctgcagtccctagaaggatctctattcattggacagagaggccaagggaattttccatttcctggatgtcttcaaagatttcaaatgccattaacttgagctgacatttattgagtactcactcggtgactggcactgttctaagtactttacatgtattaacttatttaatcctcacaacagccctgtgtggctgctactgttattgttgccattttatgctgagaaaacagcacaaagaattgagaaatttttccaaagttacagttaggattcaaaaatagacttggttttaggattgtgtaacttcagaattgatggtgacaatgacgttgatgatgaggatgatgatgatgatgatgaaggcagctaatatttcagtgtctgcaatgagctgggcattttcacaaactttatccctttgaatctttaccttccactaagatttgctgctattcttatcccttttgtagataagaaagcaagcttagagaagataaaacatttgcttaagtaactgcagagcgtagattgaattcaggtccattcgagtcagactgtctgttcaccaaggtgaagggctccgggggtcacagaggagcaccatggtgaggaaggccccgtaagagtgtggcagaatggcaaccaggaaggatctggtatacgggatggtgataaggcccatctctcatggccaggaaagtgtgcctgccacagcaatgaatgaaactggcaacatttgacaggaaggggaaattctctagtgggaggaatacttccatcaaactgttttttttttttcccagtgggggagtttgcacatgtgtagatttttttagccatagccttgaataaggaattcagaaagtggcttctagtttgaggactttcattggccacgtgatcacagtaggctgatttcttcatgcctaagttaccaggctgggaggacaggctgagaactatgcaagctgttgagtcacttggaaggaagagggttacatacagcaggcactttcatggaataatacttccctgaagagctgcactaatttattgaggcactgagctggatgcttcacacacatgatctcattgaatgtccacagcaccctaggaggttgatctcattattaacttcatgaagtgactgaggcttagagatattaaatagcttccagcctgggaaacatagtgaaaccccatctctgcaaagaataaaaaaaaatgagctaggtgtggtggctcgtgcttatattcacagctacttaggaggctgaggtgggaggatcccttgagcttgtgagggttgaggctgtagtgagctttgatggcaccactgcactccagtctgggtgacagagtgagaccctctctctaaacaaacaaatcccaggagacattaattaacttgccactggtctctaagctaagtagttgaagagggcaacaaacccaggtggtctgactcctaggcttgaaggtccaggttcagctactccaccagtatccctggtcagtctttggccagggcacagaaggtggcatatcaagttgtggggtctgatttggaaagtgtgagatccctcctttgtatcttttccaaagtccactcagaagagagtagtgtaaaaggagtgatagcacagcgtggtctggctggcatagtcagccgccctgtgatgggcagggggaagctgctttctgtcctcaagcagcccctaaacttgtaggccagactcataaatcacacattgataactcagtgtgatgtgtgctgtaatggtggagaggggggagaaatgccaggagcagctcacctcccagggtcctggggaggctgcacagaggagcctgagttctcagttgggttttgaggcagaggaagcagtgaaagagagaggaagaatgtcagtgaggtgcggggagaagcaagagagagaagacacttggcaggaagaagtagttgaagtacccggggatgtttagcttgaagaatagaaaatttggaggaggcagagaaaaggcaggaaactttaaaagcaggagagaaagacctccaggttcccaaagggagcatggcacttctcaagggggtgaggttgacagcattaggagagagagagagagaaagagagagagagaaagagagagagcgagagagttgtcaaggaagggaaggacccatggaggggagagcacaggtgaaaatgagaagtgatgggaaaatgggtgggaaataaatgaagttttgaggccagttgagaaatcttgcttggtggtttctattttctttgtgaagcagaaaaaaagaggaattagacagacctgcattcaaatctcatgaccccaggcaaatttcttatccttagcttcttcattttgaaaaaggggtgaatgataataggacctacctaataagagttgtcaggatcaaatatgttagtgcttgtgtaagatgcagtggcaccctggcacttagtaccaaaaaaaagtactataaatgttgtcacctattgagggagtccgggtttgggtgcttgatacatagaaatatcatgaatagcagcagagaatacaagaagaagagaaagcttgggggagaagatagagaattatgcgttgggtatgttgaggatgaggtgcctgtgccatatccgggtgtaggtgcccaaaggcaactggaagtcatgagaagtcagggatagaggtaaatgtttgggagttgttaatacaggggtgcatttttaaaatatctgaagtatgttactggtggcactcaaagatttttaatgatgtaaggtattcaacaacatggaactacgtagttttaaaagaaattctcttgtaggccgcgtgtggtggctcacacctgtaatcccagcactttgagaggccaaggtgggtggatcacttgaggtcaggaattccagaccagcctggtgaacatggtgaaaccccatctctactaaaaaaaaaaagaaacaaaacaaatcaaaacaaaaaaaccgggcatggtggtgtgtgcctgtactcccagctactcgggaggctgaggcaggagaattgcttggacccggagtcagaggttgcagtgagccaagatcgcgctactgtactctagcctaggcaacagaatgagactcagtataaaaaagaaaaaaatgtttttttcttttaattcttcgggttaaggagagtgtcttagtttggtgctatcatgtcctaaacatctttctaatgcatgcaaatctcccttttaagctaaaagaatgaagcaatctcagactcagagctatgtacctgctagaatttaataatttaaattttcattgtgttcttcatactcaccttctatttatagcaagtgttactagctctccaattctggaggttgtttcagataggatgcattagttctttttttttttttgagacaaggtcttgctctgtcacccaggctggagtgcagtggcacaaacacagctcactgcagcctcaacctcccaggctcaagcaaacctcccacttcagcctcccaggtagctgggactacaggcatgtcccaccattcctagctaattattttattttttatagaaacagggtctcactgtgtttcccaggctggtcttgaatttgggctcaagcaatcctcacacctccgcctcctaaagtgctgggattacaggcatgagccaccatgcctgacctgctttggttcttaaaaacagaatatctggcgagcctaacaaggaggctggtggttccagggttggtttaatcaaagacttaacactgtcatcaagcgcctctcagttatttgctctgccatcctcaaaatgtgatcagtgtctcccttcttggtcccaggaaggctgtgatagctcccagaatcacatactcacagggcaaagcaggaaggaaggggacataggacaaaggatttgtgtttaagtatttcatgtcacatttgcatgtggtgcttggagctgtggcagctatgttttgaccatgagggacaaggttggcaagctgtaaatggcagtgtaaaaagagggagaggatctgtctccttcacaatatccttgagcccctgaattcactaatcttgatatagctctatctcttgaaattttgttttgttagataattctcttactgcttaaaacgtcttaagatgggttttctgttctttccagtagaatgcattgtatctcacacaatttgaggttattgcctcaacctactctgaatcattgctcctcccccttttttcctggttgattagcttctcttgagattgtgtcttatcttcctggttttttgtatgtcgggtaattttggattgtatcctggacactgtaagtgttgtgctgtggagactctggattcattcgtatttctctgaaaagcattgatgtttttgttttagtaggccattgacttggttggacagtagactgtctctgggacaccagctcagatgtcagttctgttttttattttatccttgagtcttctttgggactgccccatgcatgcatggttcaagagtcagccagacatttgggtggggtttagacacagaatttggggctcttctctcttggctgtctctattatggaattccttcctcactttccagaagccgtgagtgacctgaaacctgtcctctggttctgtacaccagaaagacttgaggcttcatgttgaagttttagctgacagcagcttgcgttcaggggaaaagctgtaaaatgaccattcccttcttccaagtttcaacctctctgcagaatctgctttcttttgttcactttcgagtaatttcaggaaaaaatttttttttcgttgagagtttttacttgttacctatggaaaggttgggtctagctgaagcttgcttgcccataacagaaacgagactcttttctgtctaacacatgggaaaactaacgcccagagaggtgaagtcatttccccaattgtcagaggcacttgagccagagtgactccatcttgagtaagggctaggaaaataagaccgggacttgctgggctgcattcccagaaagaaaggtattcctagcctctagatgtctacagttaagggaacagattgataatgtttactaaacagagccaggcttggcagtgtccagctatcccgatatcttgagaacaaaggcattcctaattttgctttaaggataataatattgattattgcaaaacagagtaattaagaaaattaatcctttatcacaaacccttgtagcagaacacatctctccatgatttttaaaatcatatatatatgatttatatatatgattatataatatataacatatatgatcatataatcatatatatgcatgtgtatgtgtatatatatacacatgcatatatatgtatatatgtgtatacatacatacgtatatatgtgtatatatacatacatatatatgtgtatatatatacatatatatacacatacacacacacacacacacacacacacacacgaatattttacctagggtggacgtgctccttctcttacttttaggaaccccctactctgtctatggagtaactgttctttcaccactttactttcttaataaacttgcttttgctttgcactgtggactcaccctgaattctttcttgtgcaagatccaagaaccctttcttggggtctggatcaggactcctttcctgtaatacaatgtcacagagctcttaagtggcagagcttggggccaaacttaggctgctgcacccgatgtcccagctcctctgccctatctagctgtggatttgtgcctcgaaatagaattgcattttgaatgcagtttcattttcgtatggaaagtgtctatcctgtaaatgtaactgtagcagccccaaagctgagctgggcagttttatggcagcctggagtcagtcttgtccgcttccaatcagggttcctggactggctcctatattaaaattggtattagtagacaatgttccaggcagagttttggatagaaactatccatcagcaccaagaatgtgcctgatttggtaatctttttaccaaagtaaaagtcagtagtaagttgtggttaaaagagaggaagttcagagttcagtacgttatttctctctctctctctctttgtttaaataaaagaggaagttactgctcttatttttgtaccagcccgtcagtaatgggtacagagtaaaatcttagctaagctgaggtcaaacttcaaaacttagtaataaggatctcccttgttcctttgtagggcgactaacatgaaggttctgactcttaacccatagagccacaaaaaatagtcctaggaaaatcatatgattttatttattttaggaacagaaatggtcccttccgaagtagaggcatttctacttctttcctaaacaccatctctgctcagtgagctctcccaccctcaggtactgtgtttcaggcttattgctgtattgctagaagtatcctcaccttcgagattaagaaaagatatttattgccgggcacagtggctcacgcctgcaatcccagtcttttgggaagctgagacgggaggatcacttgagcccaggatcttgagaccagccagggcagtatagtgagaactcatcttgaaaagaaaaatttattgagctcctactgtatactggggatacagcaataggcaagatagcccttgctcctcatgtaacctacagataataaacaagattacaaacaaacaaaataagaggtcgttctagattatgataagtgatggaaaagaaaaaacctgtatctacttcttatagcagagacctgcattgggagttgctgtgatcaaacaggaaacggaaggtggagtttgcttctgtatccctccatccctgagtggaggctgggtgcttctcacgaccagggcctctgagatttctttttttgttttttttaaattattttagattaagggagtacatgtgcagtttcgttacgtggttatggagcgtgatgctaaggttagggtttctattggtcgcgccactcacatagtgaacctagcatctgataggtagttttttgacccccttcccctatgccctctccctcttggggtccctagtgtcggttgtttccatctttatgcccctgtgtacccaatgtttagttcccacttcgaagtgagaacatgtggtatttggttttctgtttctgcattaatttgcttaggataatggcctccagctgcatccatgttgctgcaaaggacacaatccaaataagcacaatcagaaatgaccaagctgacattatgactgatcccacagaaacacaggagatcctcagggatgactatgaacacctctatgcacacaagttagaaaacctagaggaaatgggtaaatttcctttgcacacaacctcacaagattgaacgaggaagaaatagaaatcaagatttattttctgttttgtttgtgtgtgtgtgtgtgtgtgtgtgtgtgtggttttttgtttgtttgtttgttttttggacaggatctcattctgtcactcagactgaggtacagtagcacaatcacacctcactgcaaccctgacctcctgggctcaggtgatcctcccacctcagcctccagggcagctggaactacaggcatgtacaacaatgcccggcatatatatatatatatatatatatatatatatatatatatatatatatatatgtgtgtgtgtgtgtgtgtgtgtgtgtgtgtgtgtgtgtgtgtgtgtgtgtgtatatgtatatttaaatttttatatataaatatatatctatctttgtagaaatggggttttgccatgttgtgcaggctgaaattgagatttcctaatgtaagaaacagagccccaaggggctcttcttgggctggtcgctgtatttcatcaggtgcctctgtgttggacacttacttccctccattgcatagattggatcctttatgcttagcctagactctgccctttgggatgcaaggagctgagtgaaggttctgggagagtaggcttaagcccagaagagggaggcctctctctggatgtcatgctagagcctgccttttagtctttgtgtttccactctccatcctcctcttctggagttcagaaccccttcctggtcaaattgcccccgggctctatgggatcctgtgggattctatcctttgagtctaccccacccttcaagtacttcctgtcttttcacacctaagtgaaagaaagtaggataagaacagcagttgttaacttgattgattgtaaattgccttcattagaaaatgttaattatcgcccctgggaagggattaatcctttaggtctctaggttactagactggcaaaagccaagtgtgccttggttgactgtttctttctgagagtaaagagaaaacatcaggggaggtagaaacctcagtcatggggtaatcattatggccatgtttatccccatacacgtatcttctgctgattctggagtcagctagattttgtgacccagcatagatgatatagtgacattgtcctgctgtgttaaaaaatttaagttcataagaaatgcataagtacaatctcatcaggataaattacacaacatagataagattgaagaccttttaactcttttgacgtctcaatttagtcccctctaccttccccagaagcctattgtttgtaaatttggtgtctcttatagaactctgtagcattccaaagtctgaactttctcccatgcatatggccacttccctgttgatgaacatttagattcttttttggaggggttgtgtctattacaaacagcatggcaatgagcatctttctacacatctcatcaatatgcaagtgtttctcgtgttcctcggaagtataatggcttagccctggggtatacacgattcagcttttaataggttttgccaaatgttctccagaatagctggaccactgtatactcccaccagcagtgtgtgtttccgtctcactgcatctttcccagaccatgatattatcaggccttaacacttttgccaatctgatgggagaaaaatggcatttaattttaatgatcctttcctgtccccttctcttctcttctcttcccttcccttccccttcctttcttccttcccttccttcccttccttcccttccttcccttccttcccttccttccttccttccttccttccttccttccttccttccttccttccttccttctctctctctctctttctttctttctctttctttctttctctttctttctttcttttctttcttcatttcctttcctttctttcctttcttactttccgagtctcactctgtcgcccaggctggaatgccgtggcatgatctcagctcactgcaacctccgcctcccaggttcaagcgattctcctgccttagcctccttagtagctgggattactgccacctcacctggctgattttttttgtatttttagtagagacggggtttcgccatgttggccaggtgggtcttgaactcctgacctcaggtgatccaccggcctcggcctcccaaagtgctgggattacaggcgtgagccgctactcccagccacctcttcttactagtgagactgaacatctttttacatatttattggacaattgtatttcatcttctatgaatgtctccctccccacttttttataatttcatattgatttgtaataatttttatttcaatctactagacactgatcctttgctcgttgtttgtgtttgtgttgtctattttcatcaagtcctgggtcctgtgtcactttagtgccataagggaatgacagactcccttattattggtttagctcttgaagcctaacaaagtgtttccaaacagttcattattcccactttaaggatgtgaagactgaggctcagggtcacaacttgtgcaatcttgggtagactttgaatctctgagcagacttagaagtagaccaaactgctgtgagccacagggagattattattgctaacttttccctgttagccaaacacttctgcttggtccctctagagagaagtctttaattattcatctctttccaagtaattggcgacaagtcctgcagctgggagttggaataaacttggttgctaaaagcatccatcacacataaaacaggggagatctggctccaaagaatggtagatgtagatcttcccctacggatttgttttctgaagatctccttatacactgacctcagccttttgctgacctatccttgtgaactgaaggctgaaaaaaccaatgtagccatggtccacatccatttatcactttcagaaatggcccctgcactttatatttcttcaggtcctgcaaaaaatattgaaaatcctttacaaatagaggcaaggtcaggccatccctgtgggatttccagggagcagtgcactgacccgttttgcagaatgggaagcaaaaaataaaactcagacttagacagctggcataagcaaggacttccctattctgagtgccaaatgtcaatttgaaatacttgaacttttattctctgggacatgtactggcattagtaagaatttctatttattgagcatttatttggggcaggcagatgataagttatacacattaattatcttatttgattttcacaatgacctatcagttacataattgattgtctgcattttatggataaataacctgaggctcagttatttgacttgctcaaggtgatgtaacaagtaaatggcagagccatgatttaaataacaaaacgcatgctcttaatcaccacattaatgtcttgatatcaattaatagaaccatttcccctccattttctctttagtttcagaactggtaagagtttgtctaataagatttttataaagtggtgacatgaatggcttgtggggatggagactggggccggctgccaagggtacccatctcacacgaagcatcaggtccacttgggtttgtttttggctgattacaatcttgaatcaaacttttcagtacagctggtctcccaagaactttctaatgttgatttgagcttccctgaatgaatctcagaaaataagaaagggagagagaatgcctgtgtattgagcttgacccatttcacagatgccgaaatagaagtgaggcgacttgcccagggtccctgtggtggattgtgttgttgtctcaattatttgctcccacctcatacaaggattatacatttcacacatggctatgtgacatacatgtctacttgcagaagggacacactttccttcccactgatgtggagcattggccaatggaacgtgagcagacacaatctactctacatttaaacagaggctttgagaagctattgtgtggtttagccattgttcttcccacctctgccacaagaccaagaaagggctgttgcctcagctgcgtcctgggatggaaaagacacaggaagtagaatcacagagccacagacaactgcagtgacacgtagcacgagtaagagctaaacttcgaatattgtaagtcactagaattttggggttgcttattattgcacttacctaccaaaagctgactaatacagtcatatagccagtaacttgactaagctggagcttgagccaggtcgaactcccaatcctatccatggtctttttcttatttcagtcttccctaatattccattctaacttacatcatattttctgtgtctgtgtgctgtctgtccttttttcttttaaataaatctttttctaccaaagatatagaacaggaaataatatttttctttaaagagtctgttttttcatttcaacccatttattttgaaggaaattttatcatcgtataaatagaaaaacagtgtcatcacaaataattcataactataagcagtggctcacgcctgtaatcccagcactttgggaggctgaggtgggcggatcacctggggtcaggagtttgagaccagcctgaccaacatggtgacactccatctctactaaaaatacaaaaattagccaggcatgctggcagaggcctgtaatcccagctactcaggaggctgaagcaggagaatcgcttaaacctgggaggcggaggttgcggtgagccgagatcgcgccattgcactctagcctgggcgacagagtgagactccatctgaaaaaaaaaaaaagggtaatttaaacaatattatgaagttctagctaggtactgttggcagacaagaatctgattttgaaatatcgtctctctatgttccaaaaaggagtttggcaaatattagaatggtgttcaaaacatacaagcaccaaactgatactttctcctttgataaatcaggaagattaaaaaagaatcagaagaacaatttcttcctagtatggcttggtgtgatgagtgtcatctgtattccatataaaattctttcagatatcaccaatgagtgatatgttcattacaatggggggtgtccctttctttggttcatgtataataactggaaacatgtatatagcatgtggtatgtgccaggtactcttcaagatactttagttatttaatctattgtcagataaggaaacagaggcttggagaggctaaacaacttatcctagctagaaagaggcagaattggggcttcaagtcaggtctgtttgattccagaggcaacatcctaaagcaaagtttccttctaactgctcacttgggacttttaaacgaagccattaggtgcttcactttcttgtggcatgccagagtggtagctgcttcagggcatcagcctggggccacatcaggacctacctgcacgtaggttgatcaggaccctggcagggctgtcaggtacagccacaaagcaagctgtttctgactgtgttcccacactttctcaggcatccaccctggtgtatgaatttgcttcttctttataacaaactacctctaaactgcactctagtctacagatcagctgggcaatgctgttgatctcggctgggcttgctcgtgtgtctttggtcagctagcaggttatctggggcctgattggtctaggatggcttcacttgcacatctggcacttagatgtgtgttagctggagcaatagggggcctggaccccgtgggtctccttttccagcaggccacttgggcttgttcacagggcagatgggcccagttcaaagggtctgagaacacaacggtactgcaggatgagctttggaactgctgcaccgtctcttccactgcattctgcatacgggccctaaacaagtcccaagccttctcagattcaagacatgggggatgggctgtatctcttatggagagagtcacatagcaagggtgtggctctagggaggaatgaagagtggtcaagtgcagcctgccatgctggctccttcaccagcctgtcagttatatgagccaatgggctgaatcatagtcatctttctctccacatgcctggcccgtgaaggatttgcctgcccagcagagaccgtggaatgaatgtgtgctccaggcactctgccttctctctcttctttgacttctctaagctcgttcctgcccctgtccccctctgtctctcttccccaggatcatggcattagtcggatccttcccatcattttcattttagctccagtatcacctctttgagccttccctgactacccttccagcattctctaatcccatcaccttgttttttttatcttttctttttttttgagacggagtctcactgtgttgcccaggatgaagtgcaggggcacaatctcggctcactgcaacctgtgcctcctgggttcaggtgattctctggtttcagccacccgagtagttgtgattacaggcatgtgccaccatgcctggctaatttttgtatttttagtagagacagggtttcatcatgttggtctggctggtttcgaactcctgacctcaggcaatctgcccaactcagcctctcagcctcccaaagttatacaggttttttttttttttttttttttaaatcttttcatagcatctgtaactgtttaaaatattagtttgacttccttttctagaatgtaagctttgggagagcggggtccttgcctgtcttgttctctgttacttctccagctcccagaatggtggctggcactcagggggtgctcaacacacataattgtcaagaacatgctacatcaaggcctgagtggctttgccacggctcttcttgtgactgcaggccttggtgccagcagccaccccagttccaagaaatggtctcttgctggccaacttagcaggaagaactggcagcgttcctgttacagcacttccaggtggctgcttttccctgagtccatgtggcttctccatgtctctctgttggagtcacaagttgtggaaattcacttaggccaacttagaccaagaagtggaatagttaatagttaaatgtcagtctgggcaacatagcaagacttcgtctttacaaaaaatttttaaaaatattagctggtgcggtcgtgtgcacctgtagtcctacctactcggggggctgtggtgggaggatcgcttgagctcaggagttggaagctgcagtgaactatgattgtgccactgcactccagcctggatgacagagcaagaccctttatctaaaaaacaagaaaaaattaataaataaaagttaaatataaggtctctggaggtatcctgtttgggttcagattctggctctgccacttcctagttgggtcacttttgggaagttacttaacctctttgtgcctcagtttttcacctacaaaaatagagcaaagtgtaaaaatatgaactacctcacagggttgtcaggaaaactaaattttgtgtatggaaagcactgattgctgagcagatggtgagcatctctgagtaggagctcctgctgccattattattattattattattggaggttatcatgtgtgattgaagagcaggaacttcagctgggcttcaggagcaactggttagaaaaacggaagacttggcccggcgtggtgtctcatgcctgtaatcccagcactttgggaggtcgaggcgggcagatcatctgaggttaggagttcaagaccagcctgaccaacatggtgaaaccccgactctactaaaaataaaataaaaaataaaaaaaaaattagctgggtgtggtagcggatgcctgtaatcccagcattttgggaggtcgaggtgggtggatcaactgaggtcaggagtccaagaccaggctggccaacgtggctaaaccccgtctctactaaaaacacacacacacacacacacaaaaaaaaaaaaaaaaaaaagaaaaaaaaagttagctgagtgtggtggtgggcgcctgtaatcccagctacttgggaggagactgaggcaggagaattgcttgagcctgggaggtggaggttgcagtgagccgaaatcgtgccattgcactccagcctgggcgatggagtgaaactctgtcaaaaaaaaaaaagagagaaaaaagaaaaaaagaaaaatggaagacttatcgggaatgcaggcagctgtgcgatttcagcttctctttgtttttggaccatgggttttctggttcttctttggttcctgcaggtctgactttctcctttttctgttgatggtctttcttggcctgtgtttgcaatgggtcaaccatgtgctttctggccatacttcacacttacttcccaactgggacagatagcatttcttaagtctaattccaaacttctgggataatctgattgcccttcattgagtcagaagccagtggatagggacatggaagatgctatagctgggctccacccttgcaggtgagaggagcagtttcaggaaagtctgccaggcatgagctgagaccttaagagatgtcagctagaattagccactgtcagtatatctgcttctgggtcccactcttcatcctgcttttcaaggttttcaaatatacactcctactcagtctcatgaaaattattatttttaaaataccctttagcacatttacctctaatgatactagattcttgcctcctgcctctgtaaatcactcggtcacttcccgatcttatatttggctgtcaagaatgtggaaatctcacagaacccttgaatttcaaagttggaagggaaaattgcttgtctatgcttataaaaaatacacacctacacccacgtacacatgtatttactaaaatagtattaggctaaatattcagttgtacagctttctgatttcattaacaatgtctgtctttccgtgtcagaagagatagacatttgaaaaaacggcagcgtaggattttgttctatggatgagctaaaagttctttcacctgtccacaaacttccacctagtccgtgtgccttataaaacacaaattctgaaatcccatgtaacgtgtcagctagattctgcctatcactgagtagagatgaaccatcacatctcatgttctagatttggggttacaaattcaaattcctacaggggccaggcaactgtcttagatgtgtgaaacgtcctagatataagaaatgcctgtaaatgaaaccttaagagtttttataagcatacaaataagtatgtaatattttgaaacatacttattttttggtgtacccacacaggcctagcatcaccagattcttctctctttttttttttttttgttttgccccaagagaggcaggaaatgagtatatttatgggagctttcctaattgtgaagtgttggtaagttcattatttttaaaaaactaaaaaccaacttgcaggccaaacaaaatgtgggccaccaatgtgtaatcactgatgtagataatgcacttcaattaatctaaaatcatcaactattttggcagccctctcagactgctgactcactgagcttttcatctgatgaaatccttaagtgattcacaaatacttaatctgaaaacctcttaatctaacttgtgttcctggacttgtaaattgggtttctggaccttaatacttgctcatgttaaatccattctgttacttatgtttaaggtcctacatctgtcttccagcctgatcacccatcttttcagccatgtgttgtttttgaattcaactcatttgatcctttctctatgtcctttttttttttttttttgagacggggtcttgctctgttgcccaggctggagtgtggtagcacgatcaggactcaatgcaacctcgacttcctgggcttaagcgatcctcctgcctcagcccccacaagtggttgggactacaagcacgtgccaccacacctggctaatttttttgaattttagtagagatgaggtctcactatgttgcccaggctggtcttgaactcctgagctcaagtaatcctcccagctcagtctcccaaagtgctgggattacaagcgtgaaccaccatgcccagcctctctgtgtcttatgataaaaaaaatactggatgagacaagactgaggaggaagacccagggaccctttttagcagagcttaccagcgggtgtccaaggattgaatttcccttcctagacatgttttgcttcaactaaaaagatatatatatatatatatatatatatgatgtatatcacacacatatgtgtatatcacacacatatgtatgtatatcacacacatgtgtatatcaaacacatatgtatatcacacacatatgtatgtatatcacacacatatatgtatgtatatcacacatatatgtatgtatatcacacatatatatgtatgtatatcacacacatatatgtatgtatatcacacatatatatgtatgtatatcacacatatatatgtatgtatatcacacatatatgtatgtatatcacacatatatgtgtgtatatcacacatatatgtgtgtatatcatatatatatatgcatgacccatatttaaaagtaggatatttcataacgaaataccagtattaggtatcttttgaaaaagtgtcgtaactgacagcccaagtctgcattccttcatggcaccagggctagaactgagaagtagctgactttttggggtggatatgggctcccctagtcatgctatatgcctcattttatgtgactggccgggccccataggcgtttatgtttgccactcttttagaggtccctttaaggttgacatatattcattgattgatcaactcatttacacacgcatgcagtcattttttggacccctgtctatgtgctctgcacaatgcgaggtgtgggatataatggtgaccaagacagattccaaccactcactcacagatcccacagcctaccagggaagccagatatggaacaattatatacgtaattttacttgtaagtgccacaaagacaaattgtattaagtagtaccatgtggctgtggaagtttaacttgtcactaatccaccaaactctgagaagacagcatattttccgtcattcccaaaagactatcacaggcaacattgaggaatgctttgttaaactccagggatatattccacatcacacttcccccgtccaccagattagcaactgtccaaggacaaaacaaaacacacactaaaaaggaaatggggttagtccgatatgtctccatctccttatgctggttcttttgtctgcagaagccacggtttctttttctttttgaaaaaaaaaaatgacatttgcgtacctctctgcgtttctctttctccaggattcttctgggatcctaggcagtgtggtttggtgatctcactggtgagatctcttggagccctggaatgcaattcatctgggccagaagagttgaactaatttaaggacatctgagtgcttcactgatgtatttgttctgctctgtcccttcaaaataccactactcaaaacaatgttcagctggagaaagtggttaacactggaattttctttttttctgagacctaagtgacagggaagggtggatgaaggaaacatatcctttgaaaatcctttagttagaatcctttggttgcaagtaacataaatgaactctgattaatgtaagcaaaaaagaatttgttagaaggatatggggggggagggatggacagagatgtgaaggaaaagatgaagaaccaggctttagaaagtcctgaaaccaaatgaattctagggatctaggaagcagggactaatgactgtttccttcaggacaccagagatggggtgaataactctgtaaaagatgcaaatttcccacctgggtaacatagtgagaccctgtccttaaaaaaaaacagtagccaggcacagtgcctgtagtcccagctatgtggaggctgaggcagaaggatcacttaagcccaggagctcaagactgcagtgagctatgatggcactgctgcaccccagcctgggcagcagagggagaccctgtctcttaaaaaacaaatgctaaattttagagagaatagagagaatcttttcttaaaaaggtgctaagtctggggaaggagcttctgattgtcctgccttgagtcacacgaccatctctgacttgttgacccctctacaatcccatataagactccccaagagtagattctgagcaggtaaagcccatgggtgttcccaaaagtcggcctcaacctgaagccacttattcactctgagctcatcaccaatggcatgccgcactgtcaaaactctctttctgtgcatttgtctgggccactcaactcaggaaagttagttgttctgtgtgagtccccatgttctcactgatttcatttcagtctttaagctaaaaatctgtgtaaatggtaatggagaatggctacatcacacttagtatgtgtcaaagcagtatcctaagtgccttagtggtatcagcttatttaagactgacagtactctgaggtgcagtcacttctttttttttttttcctttttttcaaaacagagtctcactccgtcatccacactggagtgcagtggcatgatctcggctcaccgcaacctccgcctcccagggtcaggtgattctcatgcctcagcctcctgagtagttgggactacaggcatgcaccaccactcctggctaatttttgcatttttagtagagatggggtttcaccacgttggccaggccggtcttgaactcctgacctcaggtgatccacccacctgggcctcccaaagtgctgtaattacaggcgtgagccaccgcacccggcctgtcacttcttgtcattcacagtagttatgttctgtaaagtcactgcaaacactgaattaataaacactgaaccattgttcctaggtgaaatacaaagttgggttcctgtgagcctttggtcacagcattttcatccactgatcaacccgtaagcttattctgtgtgtgtttctgtttaaagacaccttaatatatattgttgactcattaacatctaactcactgccaacagcactccaactcgtgcctgatcaaagcttatataacacacgcatgacacatctcggactccttgcacttaggaacaccagatagcacttcaccattaccctatgggaccattttacagcaacgtcaccctcaaaaagcagaaaaatgggaaaaagcatgctgctaatataccacagagagaatgcttgtttacagcatgagagctgaagtctgaaggtagaacatggttttgttcatcctcagctgggaacacatgttggctgactcaaatattttgccactccgtacatgtccgtgagtgatcatgaaagaaccttgagtatggatttggcggttataaataaattttagcaagaggtgaatttgcaaataatgaggattgactataacccctgttattagctctagttaacagatgggggaatggaggtaaacagctctctgcaggtcttgcagccagggagtgtagaggaggctttgtcattctgggtgcacagcctgcgtccttaagaggcaatgtagtgttggctgggtgtggtggtggttcatgctgtaatcctagcactttgggaggctggggtgggtggattacttgaggttaggagttcaagaccaggctggccaacatggtgaaaccccgtctctactaaaaatacaaaaaaatcagtggggcgtggtggcacgcgcctgtaatcccagctactcaggaggttgaggcaggagaatcacttgaacttgggacgcggaggttgcagtgagctgagagcgtgtcactgcactccagcctgggcgacagaatgagactccatctcaaaaaaaaaaagaggcagtgtagtggttgagtgcagtgtagctcctgctgagagctggttttcatgttttgtgggcacacaggaagtagagaatgctgagagctgggcactgaagcagtaggagatatgggagtgggaaagtggttttctttagtaagtctgggctgttttcatagcctaggatgaagttcagcaatactcaaccttgaggttttccaggcaccttctccttgacatgaatctcctgcaaacagatgtcatagtaatctgggaataaacctttgttgttggtcctttagctatccttttttttttttttttttttttttttttttttttttgagacggagccccactgttgccaggagtgcagaagcatgatctcagctcactgcaacctccgcctccccagttcaagtgattctccagcctaggcctcccgagtagctgggattacaggcatgcaccaccatgcctggctaagttttgtatttttagtagagacggggtttcaccatgttggctaggctggtctcgagctcctgacctcaagtgatccgcccgcctcgacctttcaaagtgttgggattataggcgtgagccactgagcccggtgccctggtcctttagctttctaagacagcagcatagtagttcagagcataggctcttgggccatagcttcctgagttcgaatcctagctctgctgttttttaaactctgtgaccttgggcaagtcttaacctctctgtgcctcagttttcttgtctgcaaaatgggattaataaaaacaccgatctcataggattgttgtgaaaatcgagtgagtatgtttatagtgtttaggaaagttcctggtacacaagacatgctctgaaagtgtattaatattatttgtccttagactcagtagtactctgggggaatcgaatccccacccctaagccaggcagcatggtagaagctaggtcagctggcaggctcctgggtcttttccattctgctgcaggagatgcctgactcacctcttgtgctcacacagatgacagctaaatagaagggctctttcctcctagtattagcttaattataggggctccctagaacagtggggaaaatgagctttgagaatccccccaccacacacacaaggcccacactagcacctgaaagaggagtgaacattgcttcctgcctccttctccccctccttctcacatatgcctttgtctctgtgattctgcacgtttaatttttaatcccgggatgggttctattagtttttgtgtattttctctgccctggtttgagctccaaaaggtctgtttgggtctctgtgggtgtctgacagcctctgcaggcctttctgaattatataactcaagctttgtattttctatttgttactgggggttctttctgtgctataattttactcttagaaaatgaagtagggtactagaattttctctgggatcccctagggtttccttctgaatattttttcctgccatattttcttcgctaaaacatttttttttcttatttcagaagcaatacatcttcattatagaacattacaacaagatgcagagaaagaaaataatcttatcaagcagaaatgttaataccttgctatctacccatgtctctctgtctctgtctcctcaaacacacacaaatggggtcaagatgacataagagactatctgcttttcaattcacattttacgatctttttttttgtatggttctgtagtctccactgcttggcttgacgatctttaacaggtgccctccggatggtcatgggggtattttccatttctcactgttacaagcagtgctctgatgaaacaccttttgctggcattcctaattatgtcctgagagcagacttctagaagttttcagcagtgaggttaaagggaatgtttgcctctcctcttcactctgtgatgctcctgggggcccaggcccatgagtctctgtgtccatcttcccaagatgaaagacaaagaatgggcagagcattgacagggccctgtgttgactccttttctctcttttcccagtttttttttttttttttgagacagagtctcgctctgttgcccaggctgaagtgcggtggcgcggtcttggttcactgctacatttgcctcccaggttcaagcaattctcccgcctcagcctcccaagtagttgggattacaggcactcaccaccacacccagctaattttgtatttttaggagagacggggtttcatcatgttgcccaggctggtcttgaactcctagcctcaagtgatccactcaccttggcctcccaaagtgctgggattacaggcgtgagccactgcaccctggcccattcccgttttttaaaaaaatattttattccttttagactatttagccacagttttccattctattccttgggataagtgaaaacttgatttttaaaaaataattacaaaattttaaaatcatggtaaaaaacacataacataaaatttaccatcttaactatttttttaagtgtacagtatcattttaagtacatttacattgttgtgcaacagttaggacttttcatctcgtaaaactgaaactctatacccactggcaataacttcccatttcttcctccccaccgagcctctggtaaccaccattctgcttcctgtttctatgagtttggctattttagatgcctcatgtaagtggactcttgcagtatttgtcttttcatggctggtttcttcctttttttcttttcctttctttctttctttctttctttctttctttctttctttctttctttctttctttcttccttccttccttccttccttccttccttccttcttcctttcctttctttctttcctttttttttttttttgacagggtctccctgtttctcgcaggccaggctggagtgcagtggggcaatcacagctcatggcagccttgacctcctgtgctcaagggatcctcccatctcagcctcctgagtaactgggacttcaggcacacactaccatgcccggttaatttttttcttgatttttaatagagacaaggtcttgctatgttgcccagggttgtctcaaactcctggcctcaagagatcctcccatctcagcctcctgagtagctgggattacaggtgcacactaccatgcccagttaattttttttcttgatttttaatagagacaaggttcttgctatgttgcccaggctggtctcaaactcctggcctcaagtgatcctcccacctcagcctctcaaggtgaagggatgagcctcccaaagtgaaggcgtgagccattgctcctgggatgactggtttatttcacttagtgtaatgccctcagagttcattcatgttgtagcatatgtcagaattttcttcctctttaaggttgattaatattccattgtatgaataggcaacattttgcttatatattaatcggtcaatggacatttgagttgctttcacctcttggctattgtgaataatgctgttgtgaacatgggtatacaaatatcttttttttttttttttttgtagagatggggtctccctatgttggccaggcttgtctcaaactccttggcccaagcaatcctcctacctcagcctcccaaagtgctgagattacaggtgtgaactactgcacctggctgagactccacttccaattcttttggatatagatcctgaagtggaattgctgatggtagaaactgtctcgggaagatttttctggggatttggcttctaactgcaccacagctccagtggaaacatctattcattaaactggcatttattgaggaccagctttgttccagtcactgaacaaggctgggggcatagcgtggcttacataggtccccaccctccatggagctgatattcagcaagaagccagacaatacacaggtaagcaaattgaaaaaaacaggatgagatccactggcgataaatgtcatgatactgaatcaggatttgacaacagagtgatgtggtgagtggctactttagatcagaaaggccttcctaactgggtgacaggtgacctgagaactacaaggtggggaggagctagccacacagaatttgggaaaataccattctgggccctgggatgagcaatggaaaggtcttgaggaggaaagtggctaggcgtgatccttgttgctggggcgtggtgggtgtggggccagatcataaggggccccacaggatgagcctctgtgctaagtgcagtgggaagccactggagagttttaggtaggcgagatgcaaaggatcagatttgtatttaacacaccttccattggctgccaagtagagaatggattgttggggactggagcagaagtgggaggatgagtcaggagtcaattgcagatttctaggtgagagatggtgtctttgtctgcacgggcagcagtgcagagggagagacacaggcagatttgggaggtaaaaggacttactggtaaatgggatatgaattggaagagggaagcaaatgcacagctgggcacctggtacactttacatatgacgtctttgaacttcgtagcaatcccataaccacattttgtagatctgtgttgtccagtagaaatataacatgagccataaacctgagctgtgtatgtaatttaaaatgttcttagcaatcacattaaaatggtcaaaggaaacaggtgaaatgaactgtgagaatgttttctttaactcagcatattccaaatattcccatatcaacatgtaatcaatataaaattattaatgagatattttacttccccgcatagcaagtcttcaacatttgatatgtattttacacgtacagcacatctcaattcaaccacacttcaagtactcagtagccacatatggctagtggttaccatattggtagcacagttatagatgaggaaagagagtctcagagagtataagttcttatgcaagcttatagaattaggacttgaaccctaatttgactctggcacccgtgttgtgctcaaagcactgcatccacccccaatgatgaagacattttcaatgtaagcaaaagtcctggagatttccccacatcatatacatggggacataggaactaacatttgtcatatatttatattttcctttccaaagcagatcaaccccaagttaccttcccttagctctcgttttctgcctctctttgcaaatatcacttcattaaaaattgtgaacattctctttgccttcccttatgggcttcctgtttgaacaccacatccagggcaccctgggaactgaaccatctccttttctttttctttttgagtcagggtttcactctgtcgcctagactggaatgcagtggtgtgaccgtagctcactgcagcttcaatctcttggcctaaaacaatcctcccacctcagcctcctaagtagctgggactacaggaacacaccaccatgcctggctaatttttttatttttattttttgtagctgcaaggtctcactgtgttgcccagactggtctcaaactcctggactcaagcagtcctcccacctcagcctcccaaagtgctaggatgacaggtgtgagccacaatgcctagcccatatctccttttcttttgtggcattctagtagccctttggttcatgcgatcatttagttgttcagcaaatatggatgattgaatggatataataggtgcagggcactcccaggttctcaagatggatgatcttgggcaagttatttaatttctctggattttagtttccttgccagcaaactcaagataatagtaatgcctacttttaagtagttattgtgaagattataaggaattaacaataacgataataataagtaataatgatacatgttgtttattagagcctgctatatgccagacactaactctatgatttaaccttctcctgctaccctttactcttattatttctttaggagtgaaattcactaatcattaagctttttaactaactgaatcaattctgtttcttaagcagatgggagatcctgtggctttttaccactatccacagctctttttttctttttcttttcttttttgagacggagtcttgctctgtcacccaggctggagtgcagtggcatgatctcggctcactgcagtctccgcctccctagttcaagccattctcctgcctcagcctcccgagtagctgaggttataggcgcccgccaccacgcccagctaatttttgtatttttagtagagatggggtttcaccatcttggccaggctggtctcaaactcctgacctagtgatctacctgccttggcctcccaaagtgctgggattacaggcatgagccactgtgcctggcctatccacagctggtttcccctctttgcccccttttctggcattctcttctgattcactctcaactctgatttccaagctacccagctccttcccctagtgtgaatctgtatttgcactggatttatttttaaatgggaaatgaaagccactgtgtgctggaaaatatatatttcagacacgaggaagctggcggggaaatattttttggatgtctttctagatctcttaaaaatcctgtgagccatcaccaggttgatcttgtagtaaggtggccttggccttagtgtatttctttttgactcgatattgggcggcaggaggtttgaggattgtgatactaacaacattaacaacaacaaactttcattgattgattgccatgtgctggaaatgtgctaataaattacatttattttctctttgaatcctcaaaccaactctttgagacaagtgtgttgtattacagctgtagaaactgaggtcctaagaggtcagtagatttgctgaaggtcacagagctgagatccaaatctaagcatcacagcaagaagtatccttaaccatcatctttgctgttggttggcattagtctggctgtgctaagaaagtttcctttgacttgcagatggatcaaggcttttcttgagagaggcttctcttgcctggttctccttgattcttttactctaggagactcagttcttctcaaatccctgtctgtgggactttgggcaaaacattcaacgtcatctttacctcttagagtcactgcgagggttggactatggtgtgttaggtgttttttttttttttttttttttttttgatgaagtctcactctgtcgcccaggctggagtgcaatggcatgatcttggctcactgcaacctccgcctcctgggttcaaccgattcttctgcctcagcctcctgagtagctgggattacaggcacgcaccaccacgcctgactaatttttgtatttttagtagagacgaggtttcactatgttggccaggctggtctcgaactcctgacctcaagtgatcggcctgccttggcctcccgaagtgctgggattacaggcgtgagccaccgtgcccagccgtgttatgagttgaacagatttcttggcttcagcaggggctcagtatgggcctatcatcattttcatttatctccttttatgcctcatgctctatctgtccccttcatctctgcctgtagcagccacagaccctctctttccttggtgcatgtccctccttcccactttcctaatttcagcctgacttagttctctacctgtcagcttggacttaaggaaaggaagttctcttttcttggggggtcactggggccatgggcgtctttccactccatttcttttccaaagctgcctctggaacgaatctgtaaatcccagggcattgcatgagttttcttttctttctttccttctttctttctctctctttctttccttcttgctttcttgctttctttcttgctttcttgctttctgtcactgaaagcaaatattgtagacagatatgcttgtaggatagaaataaaatgccccattctttgaaacatattttgttttttattttagattcatggagtatgtgtgcaagtttgtcacatgggtatattgcgtgatgctgaggtttaggcaatgaacttgttacccaaatagtgagcatagtacccagtaggtagtttttaaaccgttacccccttctctccctcctttccgagttcccagtgtctgttgtttccatatttgtgtctgtgtataccccttgtttagcttccactataggtgagaacatgtggtatttggttttctgtttttctgtgataattcacttaggataatggccttcagctgcatccatgttgctgcaaaggacatgatttcattttttttatggctgtgtagtattccatagtgtatatgcaccacattttctttatccaatccattgttgatgggcacctaggtggattccatgtttttgctgttatggacagtgatgcaataaacatgagagtgaaggtgtctttttggtggaatgatgtgttttcctttgggtatatacccagtaatgggaatgctggattgaatggcaattctatttttagttctttgagaagtctctaaactgcttcccagaggggctgaactaatttacaatttcaccaacagtgtaagagcgtccttttttctccgtaatctcaccaaggcactgcataagctatctgagtggccagcaggcagaatgcttgaaggattctccagctgggggtgctgggcccaaaggctggcagctgtatggtcctggcctttttctctccagcagggtccccatgatcttcccaggtctagttttttcttgagcacacctgcatctgacagttaattgcaagaatctgacttgctgaactctcatttctccctcctcctttagcgcatcaagtccccttctttgttttcccagcttggttcttgcaaggactacctagaggaggacttcaggcaatccctttctccctggtgggctgctgtgttctcaccaataaatcaatgctctctctagtttcaggctgcctcttaggacagatgctgataccaagtgacttttgaggttgttgagttgagacacttggaccaaacagcggaaggcacagcttggctcagctaaaggaagctccgtgaaagctctctgagtgggcctattggctccatgagttggcaggctggccctcctctaggagatggtgggtcctcatgggctgtagcagggccaggccacaggagcagactgctggaggagaacatttagggccatcttccttgctgcctttctgtgatctcttcacccaggaagctgaatgctgttggcaagcaaaagggtgcttggtaaccatttcttttttaagtgtgtgctggtgccagggagggagaaatcctcaaaacccattgtgtctgactcaggcaccactggtttggccataaccgctagtttatcctccctccctctgccaccctcgtcatgtttctcgaccacaacctgtctggaccttccctgggttggccagggcttgataatctttttctgtaaggagttatcccttcctcatctgccaggatggggctactgtgcagggactgggtaacaggcttgaagttgcaagagggctggaagggtctcactagcaagcacacattatgtcttatataggtccctggccttgtgcttcagaccctatcacagcttttccacagctggggctgttgagaatgtaagtggtgacatagctggatggctaagatggggggagtatgagacctgcaagcgtgtgagtctccttttgctagcagagtgtgaatgaaatgtatttattttcccaataaattcgacatgactgatcattcatccacccacttacccacccatctactcactaacccacccactcagtcatctacacagctgttcactcgtccatccatccatccatccatccatccatccatccatccatccatccatccatccgtccatccacattcaatgtagtgtaatgattaagagcatagagtttggagttatcctgcttaggtttgaatcccagctctgccactcaccaagcatgtgatcttggttcagttttaaaacctctccttgtctcagtctcctcagctataaaatgagattgatgttgaaattaataacagagcctaccttacggcattataaaggttatgtgagtcagtatgtgtaaggtgctttcagtagtgcctgggtcatagcagtgctatctaagtgttagctattagcattatggcatctactcacctgtttatcatctataatagtcattaaaggtcttcaataaatatttctggtctttggccttgcaggccaatggtaggattgcactgcttgcctcccttgtgggtaggtggggccgtatgagtagctctgaccagtgagttgtgatccaaagtgatgtatgttcacttttatgctgggacatgtaattgctggttctagattatccagaaaaaatctttgagttatggctgctctatcaacttgctcctggagacatagaacttcttccttagctgatcaggcatgaggctgtagtatgtgagaaaaacaaacttttacctattttgagggttattactgcaggataacccagttctatctctgtctctctcatctatcatctatctatttacaataattccagtctcattttatttcccttcccttttctttttggcacctattactagctggcattttcttatattttttggagtttcctcccaaaatttatttgttattaattataagaatatgttttccatgagaaaaaggacttattcacttatctaattccaatagttagaatggtactttacacatagtagacactcagcacatatttttaaaacaataaatcagttaatgaatggatctacttgacttttagtaggtcctattgaacactgcattccacagctccttgaaaatccttactgaggcagctaatatttaagaaggaacaccctgacctttcactgtccagttttattgcctgaatcaagaaaaatatccctgagatagacctcactgcctctctgcaaacctcttaatacccttagtcaattgtaagaagctgcttggaaccctgtaagatggtctttggccagatcaagtcttgctcctcttcctctgaatcttgtaggggcctttaatctttctgtaactgtgattccccagaacaggatgcctttgttagcctagcatcttttctgttacttctatgaaacaaggagagacgctccctgggacccttaactatttctggaagcaaaatgacccttgccccactgaagacttaggagcctggtcacttccaaccgggcttttcatctttgtgactcccagtcatgggcaagaggctagctagctccaatcctaatgcccgtgccatcaactgcttcatttctggtttcttccttgcttttgtgataccctcattgactctttccactgtaccctgtggacttgcctctatgggacacttcctccccatcctgcctgaagaggaaagagcctgcctttcttctgggaacatcatcccattcagaaacaacaacctttctggagtcaggagtttgctttcctcttgttctttattgctgcttcctggagattgcattcttgtttaaaagctcacctgtaagactctgatcaaatgtccattcttccctctcacttcatccctgaagatgaatgggacatttatctttatatatgtatgtatgcctaggggaaaaaactgaaggaacattatgtatatatataatgcgtgtgtgtgtgtgtgtgtgtatatatataatgtgtgtgtatatatatatataattttttttgagacagggtcttgctagactggagtgcagtggagtgatcatggctcactgcagcctcgacctcctgggcttaagtgagcctcccaactcagcctccctagtagctaggactacaggcatgtgccaccatacccagctaattttaaaatttgtatttattattatttttggtagagatggggtctcactatgctgcctgcgctgttcttgaactcctgggctcaagcaatcctcctgtctcagcctcccaaagtgctggaaatacaggcatgagacactgcatccagtctatgatattcttatgtttttacaatgtgcttattattgagtagggaaattatgagtgatgtgtgtgtatgtatgtgtgtgtatacagatgtatgcatctgtgttcaatttttcctgttgagagtgagtaaacaaatatttttgaaaataataaaatacataaatgaggggcaggggctctcttggacacttccaaaagtactttgctcaattttctatgttaggcctatctgcaagaagcataagggtttgtcaggagctattatgattatttattctacaaatcccagttcaacaaagaagggtgaggcttgagtgttcaattagagaagctggccagttgtggtatcatatcagctctacatccaatgctcagttttcaaggggtcatgttgctctgaaaggcctggtgaggttgatgagtgtcttaatgaagccacttgtgaaagataatgtgacatgtttgtccatcacattgacgcaggaaaggagctttcacaaaagacagcacagaaattttgcaggctcggaccagaagggaatttgtcagtgtttagcttggctgacatcccacaccctaccttcttgtgcagttagaatcccttctagtgtaatgtgtgaaaaaccataggccccctgcccacaccctcctagagctgtatcaccaacagctttcaagtgtgtgcaaattgggagacggctggatcccacatctctgggtgacatttgctgaaacaaatgcctgttaataagtggcacgattcccttggtctcagtgataaagatgtacctgttactgggagcccttgagagaaatctttggtgaaggccttcacactcattttaattggtgatagacagatgtgttgagaaaacttacattttttttctccatccgtctcaattagaatgttatgaaatagcaccccctttgctcttcgtgctttatgccctagactttaaagactgacaacgagtggttaaaaaatctccattgcttcaggatgcagtatcagctgatttggtggattaaatcgttttaaggtcctgagctttaattcttacttcagtgattctcaaaccttgttttgcaaaaccccagagctttaatcttaagggatgagcctgctatttccaagacaacaaaattatttctacttcatattaatacaaaacattaaaatatacattgtctttgtaatatagtttattaattcaaagcacttgcattcccatttatctggtcttcatacaaaaccatgtatgagtgagtaggcagatggtcttatttattacttcgttcaatatatagatttttgagtgcctaccggtatacagcactgaacgaaagagaaaaatactagtttggatgggagctcaacacaatctgaggggatatattggacccattttgcagaggaagaaactttggttcaggaagggaaagtgaactctgaagtttgacataaagttagcttcagaactagaatatctgccttctgatctcagcctatcacctatctcaggttctgtctccacgataccatgtgattggaactggctcattaacctggggatggatcaatcagcatcttttttttttttttaacaggattggatggaaatctgcattccttgatcactcagtctatagggtgaacttacaatggccctcatgcttaatcttgaaatacagggatggtctgatggagtgtgctggagaccctgctgagatctttggacaactcctctccagtccactacctgaatcctttctcttctcctcaaaaaaatctgagactatccaaatgaagagtaaataaagggagaagtaagaaggaaacatgagacagagaggcagcaggagcagaatgaaacttggggagcagagggagaagccaagaaaacttactggacttggagccaataaattggccatggcatgaaggtttctgccagcaatatggcagcccattccagctctttccattttcttttcccagctgtgctgccaagcaccatgcttaggctggtttaacagagattatgctaggaggattttctaacattcatgtcctgattaccccttatctgattccttagcagtagccttcagtggcctcagagaattccaggttcagctgtctgaacagttcaatgactgtttgtaagttctgacttacgatcaaggcaggaaatgtgaaaagcatttttaaaaaggaaaaaaaccatccggcgttgttaacatttttgttattccagtattttcccatgcatataaatatgtgtacttcttttatttttcacaagagtactctcacaccataatattgttttataaccctcttttccactgtgctctagtgtaaacattttactgtaccaaatctttttccacaaaaggatttttaattactgcatagatttctattgaacggatgtactaaaatttacctaaacagctcttattattcaacatgattcaaccattgttacaaataatatagttgtatatttatctttatggaaagctatttctgaatactcctaaggataagttcatgtattagttaggttttgctgtgtaacaaatcatcgcacaacttagtggtgtcaaacaatgactatttacttacctctgcaggtctgcattttgggccaggtagttctgctggactaggctggaatcagtggacataggctctggttacttatgcatttgcaatcagctgggggactgcatgggatgatggtggtatgtcatcttccagcaggccaggttgtttccatagcagttagagttgcaagagcagcaaggaggcaaaccctgatgcacaaactttttttcaagttttggttgcatcacatttgcttctgtcccataggccaaagcatgtgacatggccaagcccggagacagtttgagaagacattaccaaaggcatggctacaaaaggcatgaaagtctcaggaccattgttgtaatcaactcatcacagtccccaaaatgggagtttctgggtcaaaaagtgtggccatttaaaggttttcattgtcacattgctctccagagaaattgtaactaatttacacaccacctagagtacatgcatttccaaattcacttgatcactggatataatcattggtttaatttccccccagaaaataatattattgcttttgaagagtacatgctttgtgagggaagctgtcttgaatgtccagcttccaggtgcaagcgcctgcatgtgtgcacaggtgacaccatgtagaaccgaagaaccacctggctgagtctagccaacccagagaattgtgagggaaaagaatatttttttaaggcagaagaaaaatgtatgttcattgtaaaaacctgaagcaatgtggtacctttatcatcaatatcttccccagtatttgattcattctgacattatgttgttgggttacatttatttctattacatttaggacctttgagtctatattcattagtgaaatttgtctgccatttactctttttttttggtttgctgtctttgacaagtttttgctattttcatcaaaacatctgggaagtcttccatcttttcttgttttttaatgcttaggaagagcataaatggcaaaggatttagaatattttttagaagtttgagtggatttaccatacccccaaagcaaaacaatttctgggcctggtgccttttccaagattagttatttgataattttttctggtgtatttcatgatcatttttggtatactttcaaatgtgttatgtttttttaagaataagcatttaattgagtctctaatttattagcataaaactatatatattgtcctgtaatgatgtgaaaaattgccttgccatctgcaattctcttttctcattcttactgagttcctatttttagtttttgaaaattttcttatgagctttgccagagtgtcactgttttatttttcccctcaaacaaccacctcttaaatttattcttcagttcaacttttttctgtttccagatgcattaatttctgctttttaattatttcctcagttttatcactcttcctagtttcttgagctaaatgtccctatgtactttcaattatatctactgatttgtcaaaaattggatagtatgctcgtctcctactatgatagtgatttttcaacacctttgtatttttttaaacaaattttgttttgtacatttctaatgtacttttatgttataggagttagagtttcatgattctccagtcttattgtgaagttactcagatctgagttcaaattctcctgtgctgcctaccaaatgatgaaccagttttagattctcctaaaagcttggtgataataatgccagtgttgcttatttttaatacttaaattaaatgatataattgatgttaagtgctcatcatagtgccaggcacatggaacacacactgctattggttatattgttattattgatgtactctttatgaatacaaaatatccatctttgtcctatgtaatatttttatgctttacattttatttgtctgataattaatatttctgctcatggcagcttttcccaccttttcattttcattttggatcattttattttcagcaagtctcatgggaaccatgtatatttgaattctattttttctttaaattatgaatctttgtcctttaatgggataattcaatccattcacattttttttttttgcaagacacagcatttggcaagtgtttacttctttcttctcccaatccactttcctgcctttgaagattttagaaccagaatttatgaaaaaaaataaatatatttgatttcccatgaattgctattgacacatgcattatttcatgcaattcaagacttttttaaagatgtgactctcaaacttacttcattactcactttttatgttttttggacccatttccctcttattgaattaattgattgattcattaattcaatcaacaaatatttattgaaaacatactgtatgcagacactgtgctagggtctgagagaaacgtatttgatgtaaacctggtctgtgtcttcactgaatctacatttagattcacaaaattagagacacaaaaatagatgacaaattaaagcagatataaaggaaaccaataagggtctcaaggagagattagtgaacgtgcatgtgagtatctatttagcaagtttaatgaggggatgctttttgtgaaggtgacatttatgctggcagcttaagaagtggcattagctgtgtgaagagaggaaggaagaaaggcattccaggcagaaggactagcatatgcaaagggcttgaaaggggaaagagccttatcctaatgttttcatagaaattatttttaaatactcaacaattagcttttgaattaaaggaatgcacacaagtgaagttaatctcttataggcaaaaccaaatgaaggattggaaaatgcctctgaagagtcagctggaaggctcttcatccatccatccaaccatccatccatccatccatccatccatccatccatccatccactcatccatccattcatccatccatccacccacccatctacccacccatccatccatccattcacccacccactcatccatctatccattcatccatccatccaataagcagtcattgagtgcctactgtgtgccagaccctgtgccaggtgttgatcacaaataatacaagcacctcctggagagtagagcctagttgtgtacatgggatggagggcccatgataataaagctggtacttctcatggagtgggatgggccaggggcatggggaaggcacacgtgctgtgctctgtagagctctgagcagggagggacgcagtgggaaagagctgagaacaattcctgccagatggctttattctttcccctgaaggaagtggggacttcgtgctgtgacatgatacacaagaacagtgtttcctgtgggtttgcaagggcattttgaatataaacactacagctcgctgatgtgtgaaaaaattattttttttgctttttcagactttgtgaagggataatcagatcaattttataagtctggaaaacaggtatttggggtgaattttaatgcacacattatagtggctggaaccctaaccaaaggcagctgtcacctgttggtgggttctcttaggcacgttgtttgttcatctagctgtcacctggcagcttatgccctccagttcctggaactgaccagttatctgcaactgactaagttctggtactggatcctgtgtgatttgactctaacctccaagaaccttactgtctttagctgtgaaatgcggagaagactggactacttgatctctcaacactctatatatctttaaagttaaatcatttgttcagtcatttgccctttcttctgccatttctctttccctctctcccatccatccatccatccacccatccacccacccatccatatatctatttaatatttatattatttatgttatttatttatttatttattttgcaatggagtcttgctctgttgtccaggctggagtgcaatggcgtgatctcggctcactgcaacctccgcctcccaggctcaagcgattcttctgcctcagcttcctgagtagctgggattacaggcacatgcaccaccatgcccggctaattttttttttttttttgagacagagtcttgctctgtcgcccaggccagagtgcagtggtgcgatctcggttcactgcaagctccgcctcccaggttcacgccattctcctgcctcagcctcccgagtagctggaactacaggcgcccaccaccacacctcgctaattttttgtatttttagtagagacagggtttcaccttgttagccaggatggtcttgatctcctgacctccagtgatccgcccatctcggcctcccaaagtgctgggattataggcgtgagccaccgcactggaccctgtctaatatttaattgagtgcctgttgtgtgctaagtactgtgctgggttctcatccagtggccagtaaattagacaatcctcccatcatagagcttgccatctagtagggagacagacaagcaaataattacacaggtaataatacaattacagttatgataagtattacaaatgagaagaatggggtaggtgagcatgtgtattaaggctatcggtctcattttgagggccagagaactctttcttgacaaaatgaagtttaaacaaaaactaggtgaagattggcagaaaagcatcccaggcagagggcacagccagtgtgaaggccttgggataggaaggggcatggccacatcaagggaggtaaaaatacataacaaaataataatatgagtaacaatggcaactactactgaaggaggaccgcctatttgccagggaccatgcgatccttaactgtgtggttttgatcaaatcatctaaactccttgcaccttggtctatgcatctataaaatggggtgatagtgatcgtgtatacttcatcaggttcttctgaggcgccaatgaagtaacgtctgggaaatccttaggtctatgcctggaccataggaagtgtttaagagacagccgttgtgactgttatttttatgaatggtattgggtgagaaaaagttcgtgttgcatctcagggcttgccttggaccctgttgatgatttctatgttgaggtcactcttggagtttctgcagaagtagaactcttggaagtctgctattcagcagatgagtgaaacaagtgcttctccctccgctcccacagaaagaggggcagagatgccagccacagcttggctttcaggcagcaggcacattgggatcagtgattggcatttgcaacattggttggcatcacagagagcatggaaggtcaaggtaataattatcaaggacagtttaagggaaacagtacattccattccttatccattgtaagaccagtacattccctgttctttaactcttgggaagacatctcccccagatctctctgctgaggatcagggccatttctctgttaaaaatgtcaaacagcaacttaccagaggaaacagaatggtggaaatgccatctcagcattcaagaagccccagtaccaaactttgcatgtatatacgtttgaaacaagctttgtaaattacttttgttcatttgtaattacttatccataagaactctctctctctctctctctctctctctctctctctctctctgtgtgtgtgtgtgtgtgtgtgtggtttgttgtcacctgggctggagtgcagtgatgcgaccatggctcactatattcaaaatcctgggctcatgcgatcctcccacctcagccttctgaggagctgggaccgtaggcacgtgccaccaggcccagcaaataaaatttatttatttatttatttatttatttatttatttatttatttatttatttatttattgtagagatagggccttgctatgttgctcaggctggtctcgaactcctggcctcaagtgatcctcctgtctcagcctcccaaagtgcagggattacagttaggtatggagagagaaggaaataaggaagacacagttattactctttaggacccataatttaactcaagtgattttgcccccaggtggtatttggcaatgtctggagacattttgtttgtcacaacttggggtggtgggggttgctactggaatctagtgggtagaggccagggatgctactgaacaaaatatacaagacagcctcacaacaaagaattgaccagtccacagtgtccacagtgccatggttgagaaaccttgatctaactgcttatgacataccacttccataaagccgagagatatcaattcttatgcagttatcactgtgtacaggaaattgtgtgtttgtacatgtgtgtgcatgaatgtgtagatataaagggataaaacctttatcttcctttcctaggtatttttacctctgtattatcaattgaaataatttgtttttgaatatacaatgcaaagtttgaaatcctacaggtacaacaaggtatacagtgaataaagaatctccccattccacttctgtcctcaagtcttcagttctctggaggagtactactgtcattagtctcctatatattagtagagagacattccgcatatgaaccttatacccttagtagcacctcacacatatttttttccttgttgcctttttttttcctatgtgatgacgtatcttagagatattttcatatcagcgcatatagagcagcctcattcattttaacagctgcacaggttttttttttttttttttttttttttttttttgtggctgtcccatacggtcttctgttgatgggcataggttatttctagtcttttgcataacaaacagtgctggagtggatctccttgtacctaactgtggacacacatgtgcaagtacgtctgtaatccaaaatcctgcaagaggaatttctaggttaagatggcatgtgcattttaaatttggctagagatttctgcagtgatgtctgatcctgtgcaccgtgcattcatcatgtgacccatttctagtccttcttgaccgccccctctcctatggggatcctgagctgatagggtcacttctgtctctcccccacactggaacagctctctctaatctacaagattaattttttttcctaatcaaaacacaattgccaaggatagtttgaaaaatattaattgtgtctgtcatcctggggctctgagcacgtgagcgtttgggatataatctttgcaaattgcctatagttcatacagcacagcaagagcctctctctctgcagccagtcctttatgatcgatcatacccaccccctctcccaatgggctgtatcctaagggtaagtagacagcatgggttctcttgcttaaaaaaaatcgttaactcaacgggggcgcctgctgcttgattgggagtatgtcggcatttagagcctgctggctgcaatctcactacgcagactggaagttgtggggtgtttttatcagcaggaaacagctttgagagcggaaggggagtgagagtagatggatagatgagggaattcgaagaggaggaagccgtgggagaaatgtcttcttttaaagacagacaaggcagatttctccagcccatctctctggaatgtcaagtaggaatgaaatgggaagttgggttaattctaccaggcctgcccagcaaccagcctgttcaggttccccaggagttgcagcctgttgtctgagactgtgaggttctcttccctgaagtgtcttgtgggaattggctggtggcagcattttctctgaggtcccaaaaattcgagtggtcaagaagacaccctgcaatgatcattccccaacattggaggccataaaagtcagtctgggtttgcaaatacacactggaagtctcagagctggtgcagacatctcagagctggtgcagacagacactgtggctgagtgtgtgtgccttgttcgttatggtttcactgctactggattggtacctggtacacagtaggcactgaaaaaatattcactgaaagaaagagaaaacttgatggcagttgtaggtctgggtctgttggaatttttacccccaggaagagatttgattttaactcaaagccagttgataaacagcctcacccagcagacagagggcagcttgggggaaactggagggtatgtagggtggggtggggctcttatctgtatggacaatgccatatattttctgaaacttggatttttctccttataagggagaagatccaagaagacaatgaaaaaacatttgcccctgcctttagaaaaaataaccttttaatttttggaataatttcagatttttagaaaagttgcaaaacatttacagagagttccactgcatacccctcacccaaagtttccccctaatgctaacatcttatgcaactgtgatgcctttgcccctaccattttgaggttaacaattaagttagtataatacttattctgtaccgagctctattctatatcattttcctgcagttgtttatttgaccctttcagcatcctttgaggaataagcactgttatagcagtccccattttacagacggggaagctgaggctcagctagactctagctagtgttcgaaacctaagttgtctggctccagtctctcacccctcaccattattatctgcacagtaatgatggtaactgtcatctcttgatgataatgcgttcaggaactgagctcaaaagtttttccctccctcccttcctcccttccttccttccttccttccttccttccttccttccttccttccttcctccctccctccctcccttccttccttccttcctttttttgagatagggtctcactctgtcacccagtctggagtgcagtgtcacgatcgtagttcactgtaaccttgaactactgggctcaagccatcctcccacctcaacttcttgagtagctttgactacaggcataagccatcatgtctacctaatttttagttttttcttttctttttttttttttttcctttttctgtagagacaaagtcttgctatgttgcatggctggtctcaaactcctggcctcaggagccctcctgcttcagcctccccaagttctgggattacaggtgtgagctgccacgcccagcctacttatgttatttctaaaccctcccctgactcagagctgtggtaaagagccccgcttttgttgtcctgctcaggacaaaaatacatggccccaggcttttgtgagtaggatccggaagggaacttaagtgtgtgtgtgtgtgtgtgtgtgtgtgcacccacgtgtgtgtgggggagtgatagagattctcctggtttctgtcctagttttttctaagcgtatggagacaggtctgctccgtacatctggggattggtattaccacatcatttcccccctaacagcagcaaagattctcaaagcttcatcagagcatgaacaatcagaaatgccttaattttgttagtcacaataaataatactttgattaattagcaagcacatgccttgggaatatgagaaagtaaatgatttctaccctagatctttcagatagctgggagggaagagagtattaaaatacgcttttaactatgggttttggatggagaagaggagaatgccggagaggggaaagcagcagtggaattgttcttggagataggagaaactgaaactctttccacccagggtctttgcagaaagtggttcccactgcctggaatactttttcttctctttacatggtgagctctcactctagtctcaacttaaatgtctccccctttgacaggcccttgctaacatcctgtttcaagttccttctggatattgattaggatggtaagcttcatgaggttaaggatctctgtttcatccactgctccatcctctggtgtctgcaacgacgctggcacaccataggcccttattaaatatgtgtcgactaaatgaatatgtggtcttattaaatatgtgtcgactaaatgaatatgtggtctatttcaagtcctcgtttgtgtctgccctagaacttagcactgtttgccattagcttgtctatttccttgtgaatagctagattccctcatgagctataagggccacgatggcagggggtgtgtctaccttgttcaccaagggtacccaggatgaacctggcctgcagctaagggggtgggctctagggtcagattacttgggctcaaatcccagatttcctatgttccagctgtgtgatttctgctaattgtcaagccactctgtgcctcattttccacataggtgcaagaggggtgataatagcatctatctcttggggttgttgaaagaattaaatatgtcagtattggctaaaacacttagaggaagctgggcgtggtggctcatgtctgtaatcccagcactttgggaggctgaggcaggtggattgcttgaggccaggagttcaagaccagcctggccaacatggcgaaaccccatctctactaaaaatacaaaaattagccagacatggttgtgggtgcctgtgatttcagctacttgggaggctgaggcagaagaatcgcttgaacccgggaagtgaaggttgcagtgagctgagatcgcactactgcactccagcctgggtgacagagcgagtcttcatctcaaaagaacaacaacaacaacaacaaaaaaccacaacacttagaagagtatctagcatatagtaagtgcttcagtgctttatacatgtcagttattggtagtactcaaaatatttgggatttaaaagttgggggatttttacataaaaggcacttttcctctttgagtggtaaaatctcccctaagaaagaggcaaggacagatggagatgatctgagaggcccaagagatccttaaaaccaggctttttaagaaatctgatgttttatttctccgtattgtcatggaaaaggccagcttttagcatgcctggtgtttctggtgttttcttctcttcactgttttctacatttctttctttgcattggtcctttttttttcttttttttttttttaataaaaaaaaaatagcacagctcggagtcttgcttgctgacttactgctagagtgtgggatccattgcttccatttagagaagcagccggccctggaatgtggccgcagggctgccaggctgactctgtgagctgagctggcgaggaatgcactttgcagcttgcactgagtttggccttacgtctgtggaatttcttctctcttcttactcattcgtgtcgttaaataaataacaacacaagcagtgcatcctcccggttataatggcaaacagtacaatgtgttacaacacacagtagcttgaagaggatatctctctcctgtggtagatgcttcattccccagaacttcactcctcacccccagaataggttgcccagttaacaggatgcctggttcagtctgcattttgggtaaacaaggaacacctttttagtataagtatgtcccaaatattgcatagcaccaacttatcctaaaacactatttgttgtttatgtgctattcaggtttaactgggcattctgtagttttatttgctaaatctgacaactccagagagtctcctagaaccagtttcctgtattttcttccagtaattttccaagcatgtgcaacctatggatatcttggcagacttactcctggtagaattcccatcacctagaacagtgcttaggacattgtaggtgcttaataaatatgggttgaatgagtgattgactctgtacccaccccatttttcttcacataagtggaaatatattatagtgttgtttcatatgtagcttttccttttaataatgtctcatggggattgatacatagagctgcctcatactcctctaagggtttcctagcattcccttttatgatgcataatgtatttaaccagtcccctgatgatcgacattggtgctgttgagagtctttagctattataaacaataaggtagtgagcattcctatatatgtttacctctgtgggtttgacgacgtgcaaggataggtgtcgcattggaatcatgaggacggaggatatgtgctttaaaatgtggattgatgttgctgaattgctttctgtacaggatctgttcacacttccctcagacagcttgttccccatctccttaccaacatagaatattatcaaactttttcattttgccaatctgatcagtgaaaaactagtatctcgctatcatcttaatttacatctctttgcttatgagaacatttttatgtttgaaagctctatttctttttctgtgaactgcttcttcttttttgcctatttttttctacttattgatttttaaccggtttttgtttgtgaaagaacatgtctgttagcctggcatatgttttatatataatgtaatttataaaattggtgtttaactttgaaaaagtgatttattatggattttttaaactctgtagacattaaaaaattcctcagtagtcaatttatgagtcttttcttccacatattctacattttgtgtcttgcttagaaaggcctcttactcaatgagattatagaggaattctcccatattttcttttactactttaacttctttttttttgcatttaaatctttaatccatctggaatttattttggttttaggagggaggtgaggatctagctttattttttaccagatggccagccagttgtcccaataccatttattgaataatccatcgcttcccacagaattgaaatgctgcctttatcatatattaaattgtggaggagggattttatactcattttctgacagcctccagtgccagctaggcagcaaggattttagggggtttcagctgactagaggcaaagatcctgacctgaaggataaccgcaatttattaaaccagaaatactctgtgtaggaacagtgggtttcctgggtggggacagggttggggtgggggaaagtgagtgtcccgtgctgggaggaatttagttacagcaagatttctcaaccttggcattattgacattggggggtggaataggtctttgttggagcctgtcccatgtagtgtaggatgtttagcagcatccttggtctctacccagtatacaccagtattaacttcaccctgatttgtaacaatcaaaaatgtctccaaacattgccctgggtggcaaaatcatcttcagttgagaattactgctttatcaagcctgggtcgagcagacctcccatccatttcttttaaacagaggcagggtcttgttccgttgcccatgcagtgcatgatgtgatcatagctcactgcagcctcaaattcctggctcaagccatcctcctgcctcagcctctggggaagctaggactataccacatgcccagctaattttttagtttttgtagagacagggtcttactatgttgcataggctggtctcaaactgctggccacaagcaatcctcttgcctaggcctcctgaagcactgggattatgggcgtgagccactgtgcccagcctgaacagaccgttgattagatgcatgtgaggccctttcttgttctgagagtctgtcatcagcagtatcaatggctccagatgtctgggaggcaggaagggaggtgcctatctatctcagagaccagaacacccagatttctggtatgagtgtggggtctgtggggaaagggtggaaccataccggtcgactccgggaggaacagaggttcccacctagccctacaggtgaatcttgcaaaactccctaggacctgcctgggagcctagccattccccctgctaaccacacccccagacaacaaggcctggccatggatccaggaacaatgactctgagaaccggaggtggcagatgttttgtgatttaacagcatatcggtttattgtcttatttttcttaggagtaaaagagtccatgggtgtattgttgggggcagcaggaagcacacgtgtctattcggagatttggggcagcaggtggggagagaaagtccatctagacgagggaggtgtgggagtgagatggaagaggagagggaagtgggtggaatccctgggagctgggggaaggaggaaaacacagagaggagctggctgaggtttgagcaaggcctctggagattggtgagagctggggcggcggggattctttatgacagtgctgcagagggaaaaaggattgttgctgagttgggtggaggtaggtaggagtgatttgaagaaggaggtccccttgggaagttgcattagtgggtgaatgggggttttataggccaggcagagaatatggggagggcaactccagcagatgaacagcttttgcaagacacctgtgtggagcatgtggcaccacctgagcgtcctccccaggtgcggctctaacacaggtgcaggttatgttgggagatagagagccagaactcaggagtgccttgggtgccttgctgtaagatttgggctttccctttatttctttttttttgagacggattctcgctctgtcgccccaggctggagtgcagtggcgccatctcggctcactgcaagctccgcctcccgggttcatgccattctccagcctcccgagtagctgggactacaggtgcccaccaccgtgcccagctaatttttttttttgtatttttagtagagacggggtttcaccgtgatctcgatctcctgacctcatgatccagccgcctcagcctcccaaagtgctgggattacaggcgtgagccaccgcgcccagcctgggctttccctttatttcaaaacactcctcacccactcaatatagaaaaccaaaaaatagaggtgagcaaaaggaagagagtgaagaacagcgtggtgtcacccacccagtggccacctccataaacgctgtccagtttcctctgcacgtccttagcatgctccctgcacacccactgggacaccagctttgtgaaggcaggggtttgttttgttttgtttacagagctaggcgaacagttggcactcagtaactgtgtaatgaatggatctgtactgcaaacctgatatcacttgctcttttcacttcgaagttcatgattcgcttccttgttagtagatacctttctgggacaggtttttaatgggcacaaattattggactgggtaaataggccacatttcacggaaccaacaccctcctgctttttatcagttttcttccacattcctctatcacaagtgctttcatttgtttgggctgctgtaaccatgggtggcttaagtgacggaaatgtattttctcacagttctggagctggaggtctgaggttcttggcgagaccctcctcttggcttatagataacctctttctccttgtattctcacgtggcagagagcagagagaggaaatcagctctctcatgtccctttttaaaaattcacatacatttaagttcaagtgcagttttattacatgggtatattgcatggtggtgaagtctgagctttttgagtaaccatcacccaaataatgtacattgtatctactaagtaatttctcatccctcaccctcttcccaccctcccaagtcactatcattccacactctatgtccgtgcacacacattataagctcccacttgtaagtgagaacatgcggtatttggctttctgtttctgagttgtttcagttaaaatattgacctctagttccttccacattgctgcaaaagatgcgatttcattccttttatggctgagtagtattctgtggtgtatatagaccacatttgcttcatccattttgagtcccttcttataagggccttgatcccattcagaaagtctccatgatctgatctaatctcatgatctaatcacctcccaaaggccccacctcctaaaagcaacacactggggggttaggcttcaaccaattaatctgtagaggacaaacacgttcagtccatagcaggaagcagtgccgccatggggaagagcattgtcgtgaaaccttttgcccctcttgttgagttttctcctccagcacaccctgaacatgctgacagtgtcaccttcctctttacttgtccctcttccgctccaagttgcctcctggcttcccagtgtctctgtgggcttgagaccagagcttgtcataagagatagatgacgtcacttgatggaaagagtcaagtgcagtgaccagcacatagaaggcggccatcaacattggtttcatcctttagagcaaagtttccccaagcgcctggtgtgcactggtgagatttggggacggggtggtacttaagacctggcactaattaacactagatcactgtgtgggaaacatagtcccttttctgttctcttcaaatccttctgatcgggctgaggagaaagcctcaggttggtgctgatgtgcttttttctcccagacccccatcctaacagaaacagagcaggtctcaggctcgggccgttaggcaatgatgtcaagccagaatgaactaacattattttgttctcgttgtgttttattttcatgggaaacttagagttatattcagagatattgatttttttaatcccatttaaaaataatgttttaattgagataaaattcatataatgtaaaattcacattttaaccatttaaaatgtacaattcagtggttttaaacatatttataatgttgtaagccatcaccactatttaattccagaacattctcatcacccccgaaagaaaccctgaaccccattagcagtcgctctccattttttttctctcttccctgcggcccctggtaaccaacaaactaattccgtttctgtagatttgcctatcctagacattttgtataaatagaatcatacaatgaatgatcctttgtgactggcttcttagaataatgttttcaaggctcatccaaggcatgtatcagtacctcattcctcttaatggttagatcactttccattgggtggatggaccatattttgtctatttattcatcaattagtgagcatttgagttgtttccactttttggctgttataaatagccataaacgtatatatgctttttttttttttttttttttttttgagacaaggtcacccaggctggagcgcagtggcacaatcacagctcattgcagccttgaactcccaggctcaagtgatcatcttccacctcagcttcccagatagctgggactacaggcatgtgccactatgcccaactgatttgtttattttttgtagacacagggtctcactttattgcccaggctgttcttcaactcctgagctcaagtgatccacccacctcggcctcccaaagtgctgggattacaggcatgcgctaccatgcctggtccaattttttgtataagcatgttttcaattctcttgggtgtcttcctaggagtggaattgctgggccctataagagctctgtgtttaacttttgcaggccatttcctgagtgactttaagttgaaaagtaagtcagtttaaagaaaactattaatcatattgcagatggtgtgtggacatgacaaacgtcataaacgtggtttgcagtgatggaagagtagaaatcctgcttggacatgacctcctccatcaactgtttcccactcacctttccagcctgtggtgcctctgttcccaggagcctcagtgcagccacgctggcctctgaactgtcttacatgagatgtccttcttcaaagatactgccgtttgtcttgtcctgggatatgcgcgacccacattttttttttttttttttttttttgagatggagtctcactgtttgcccgggctggagtgcagtggcaggatctcggctcactgcaacctccgccttctgggttcaggtgattctcctgcctcagcctcccgagtagctgggatttcaggtgcgcaccaccatgcccagctaagttttgtatttttagtagagacggagttttgccatgttagccacgctagtctcgaactcctgacctcaggtgatccacccacctccgcctcccaaagcgctgggattacagacatgagccactgtacctaactgcgccacccctttataccctccagggagctggacttttcagagatcatctttcacttagaatctaccgtttaacccttaattgcatttcccctcatattattatactcactaatgattttgttggagaatcttttgcctctgctataagccacttgagggtagcatctatattcaagtagtccattgttcctctcatagtgcagcctcacctgatcaatggtgaacagctgctgatgaacagaaccttccctggaggcccctgttctactgaatcttggtcagccccgtgtcctgatgcttgccctgcttgctgttactttttgcctgtggttttactgtttagttaacttcttcttttcctttctttctttcttctttttttttttttttttttttttgagacagagtctctctctgttgcccaggctggagtgcagtggcgtgatctaggctcactgcagtctccgcctcctgggttccagcgattctcctgcctcagcctccagagtagctgggattgcagacgtgtgccacctcacccggctaatttttgtatttttagtatagatggggtctcaccctgttgggcaggctggtctcgaactcctgacctcaggtgatccaccctctttggcctcccaaagggctgggattacaggtgtgagccaccgtgcctggcctttatttatttatttatttatttattttttgatatggagtcatgctctgttgcctaggctggagtgcagtggtgcaatcaaagctcactgcagcctcgaactcctgggctcaagttgtcctcctgcctcagcctcccaagtagctgggactacagatatgtgccaccacgcccagctaattgttgtattttttatagagactggtcttgaactcctgggcttaagcgatctgcccaccttgacctctccaaatgctgggattgcaggcaaatcagattgtttcacagacttcagaatggaggctgaggttcaaggaggtggacaccaggcagccctgggaggccatcttccatccagtatgtagagtaaggaacaggaaagcaggtgtaccgagaggcaagaaccatgaatatggacaaggagaagccgagagaacacaaggggagacccaactgtcttccagttcccagttctcttcctttccttcagccagaccgaccttcctcctattgggcccaaatcatgtcaaaaaaaaaaaatctgactggccaggcttagtcaaggaggggatcatagagtcccagtgccatgggtgagggaggcagtcagtgtagacatcatatcactggggagataagccttcaatggtgcccactattgggtgaaaaggcagacctggagctctgaacttcagcttccccttcttcccaaggttgtagaagtgggaaagccaagctagtcatttctgagtgcgggaggagaataatgtgacaaaaatggttaacatcagactagctagccttgaaagcttgagtctgaacggtgatatcttaggagaggggaaaaaataagcatgaagctgtggctctgctccatttctggggaaggaagctcttctgacttttctggctcagtgcaggaagggttgaagaatctcttaaaatctcctgagtcctctttgtccttcatctcagaattcctgtgcaggtgatgtttggctgtatgctccacgaaaggaatagggaacttggctccctccctccagggactgttgctgctcctctgagtttccttagcttaagctgtgccccctgtgtgccatttgccttgggacagagatggcccccattttccaatcctgttgtaggggtgggaatgctccccagtatgtgaaaatatccccaagctgtgttttttttttcttttcttttggggcaggctcttgtgttgcccaggctggagtgcagtagcacaatcatagctcactgcagcctcaaattcccaggctcaagcaatcttgcttcagcctcccgagttcctaagtagctgagactacaggcatgtgcctccctgcccagctaattttcattttattttattatttttgggatgaggtcttgttatgttgcccgggctcatgtcaaactcctggcctcaagtgatccttctgcctcagcttcctgaacagctgaaatatccctaggcttttaagcctcagttacttaatcaacacagtggggccagtacagcccatcattggcatttgtggatttggcagtggtggttccttttctcattagctacccagaagatccttagcacagcatcataagtcactgtcttgaaactccaccctgaattggatgcttggtgagcatctgggagaggcagaatggtgttggaaccaagattgtgggctctggagtgagatttctctgtaagtctggacaccaccccttggttgggtgatcttgggcaaattaattaatgtctctatgcctcattttccttgcccataagtgcggatgacatagcacccacctcacaaggctgttgggaggtttaaatgagttaagacctgcacagcccttagaacagggagctttcaatatgtgttggccacagctcttgtgcccaatcgatttcactcatttgggcaatgcctgggttctagatgaagggggaggaggctgcctgtagtgtcttcttcatgggccagtccagctctgcagtggactgtactggtgatgtccaccgtgcctcagcttttaagcatatattctccttgaaaactatttaagcagaacacactggggtcaagccagtccaagccagatgtttggggtcctgggtgcttctgttttctccatgtctgtttacctttaacaagatggatgggggctgtgaagcccctctgggcagccttttctggctgtgacatgcaccagaaacccacttttggcctgtttgcactgtgttagaaaacagcaggtgcagttggcagcctctcccctaccccttctcccgttagcccctgatctctggggactccttagactaatgcagttttaatgaatacacattactgtttacatgactgaaatgagaggctggctgcttattttatgctgaggtttacagccctgccttttaaaaccctctctcccttgctctgcttctggccatggcgatattttctggcggcccctatgctgtccctccaaataaggaattcaccatgaagtcctgcagcagtgtcagagccattgccttgccccggaaggagtgaactgtgtagaacaaaagcagaggctgggagctgtagttcacgcctgtaaccccagcacttcgggaggcagaggcagaaggattgcttgagcccaagaggtctagaccagccctgacaacacagtgggaccccagtctctataaaaaatacaaaatacaaaaatacaaaaattgatgacctgcacctgtagtcccagctactagtggacactgaagtaggatgattgcatgagcccaggaggtggaggctgcagtgagctttgattgcaccactgcattccagcctgggcaagagtgagactctctatcaaaaaaaaaaaaaaaaaaaaaaagcagaaagatggattctttatttttttaatttaaaaatactttttacaattcttaaatgcttgcttatgatagaacaattagaaaatgaaggtatacaaagagaagaaaataaaaatcacctctaattccactactcagaaaaaactcgatcgttaacattcctgtttatgttttagcatattttaatcaatctacatttatatgtattttaaattaaaattagaaaccaaacttaatacatgttattcagaaatctgctttttaccctacctcacaattaatatatgatgaatgtctttccgagttaagaaatatagatctgcagtatcttttctttaattttaattttaattttttagagacaggatcttgctcagttgcccaggctggagtgcagtggggtgatcacagctcactgcagcctcaatctcctgggctcaagcgattctcccacctcagcctgccgagtagctgggactacaggtgcatgccaccacatgtggctaattttttttttttttttttttttgagacgaggtcttactatgtagcccaggctggtcttgaactcctggccacaaacaagcagttctcccacctcagccttccaaagtgctgggattacaggcttgagcaccatgctcgatattgcagtatctttttttatgcatcattgtatcctattctataattgtttctatggtctcatttgtagaaaggttaacattaaatttcgaatagttatatgtactcactggttcaaaattaaaaaggcacaagagctttaatacttttattgaaagatttctctcctatccctagcccttaggccactctgttcacctcctttttggcacccaatattcaactaataataccaatttattgtgtatacttctggaaatagttcataatgtacatgcacatcatatacatttatttttctcttcctcaaacacgtacattcaaatgttagcttaccttgctttcttcacttcacaatatcctgtatcttggtgtttgttccatgtcagtgcatatagaacatcctcattcttttttttgaaacagagtctggctttgtcacccaggctggagtgcagtggtgtgatcttggctcactgcagcctctgcctcctgggctcaagcaatcctcctaccttagcctcctaagtagctgggactacaggcacacaccaccatgactggctgatttttgtatttttttttttcattgttgttggtagagacagggtttgtccctgttgcccaggctggtcttaaactcctgggctcaagtgatagggtcacctgggcctcccaaagtgttggggttacaagagtgagccactgcacccaatgtctcattctatttttatttatttattttttgagacagagtctcgctctgttgcccagaccggagtgcagtggtcttgggtcactgcaacctccactttccaggttcatgtgattcttccacctcagtttcctgactagctgggattacaggtgtgtgctaccacacccggctaatttttgtgtttttagtagagatagggttttgccatgttgcccgagctggtctcaaactcctgacttcagatgatccacctgcctcccaaagggttgggattactggcgtgagccaccacgcccggccacctcattctgttttatgattgcatcgtggtccatagtatgggcatccctggggtgtttccaaaattgggatatattgactcagaaacccttcctgtggttctgtccaagctccttgttcatatgacctggcctggggtgactggaggaaggatgtccattcggagattaggagggactgcagctctcgattatgaatgggattggcctccacaggcctgagtgacaaggacaaagcagagctggtgagccccatgccaggtggcggtcactggtggaaggccatttgtgacttctctgcagttctccagatggaccacatttaaaacagaggcactgccattcatttctacttggttgaggaaaggtttcatcgcaggcccagagagaggatcagatgttttttgcagtttctggcaagacattagtgggtatcagagggtaagtgatctcgtaaagctgactcaaagcaagagaaaatttcgtgtctgtcttagaaacacatttgcctccaaagggaaggcagggtgtggaggactaatcaacgcatttcacatttggtttctttgtctttcttggtgatcttacgtgactagccctgaatattttgcatatgtcaaggaaacatttcaaattactaagatgagaggaaaatatggggaatgaataaaatggggtttatcagcaagaacagcaaaagacttcttagagccggctggggattgttttgtgaatctctaaacaagaggggcagtttgacttggggatgggggatgttttgacacttggagggatgggagggagccaacaaagatgtaaagcaaaactgggatggtggtgatggagaagcagtgggggtttctatgggaagacataggaaataatggtctgtccttcacagagtaggtgaggtctactagaagatacttatcttttccctaaatttcagtcaacttcacatgattaagtttccattattaaagacttgttctttgtgttacctttttattattattattattattatttttttttttttgaaatagagtttcactctgtcacccaagttggagtgaattggcgtgatcttggctcactgcaacctccacctcctgggctcaagagattctcgtgcctcagccacccgagtagctgggactacaggcacacaccaccaggcctaactaatatttgtatttttagtagaggtggggtcttgccatgttggccaggctggtctcgaactcctgggctcaagtaatccacccgcctcggcctcccaaagtgctgggattacaggcatgaggcaccatgccaggccttttgtgttacttttgtaagagatgaaatgaaactaatatctaatcaaatctaagcatcaagcaattaaaaatattttcttaaataactattgagttaaataggactcaaaagtacaattgcagagaggctataaatgaaaaaaaatagagtgctatataaaacaatggataagatcagccaatgctgtgcttgcagataagttcatagctttaatacttttatgattaaggattgagatgacttgctttgagcataatctggctattcacttattctaaggaacttgtcatggctcaaacatgtttctagtatcctctttagaaattccgtttagatacagttttctttattaaaccttctaaggtgactatttcaaagatgaaacattcattttgttgtttaaattaacacgtattttttaaagggttatgtaaatgtgttatccatcaagtatatctttgagccttcatcacagtgtgatgtaagggatataagttgttaaggatccagcagtagagaaaatttctgcacaaaagtaactatagctctattacttttggaatattccctaggatacatccaaaaccaaatcaaattatactacttataaaacacatttggaaagatactatgtgaatatgctttgaatactgaggcttatgttagaacagagtcatggacgaatttgcaaaaaaaaaaaaacctccaaaatttcctggagtctgacaaaaataccggatagggttcctgaatatattttcatgatctttgctatataaccagatatctctatattttgaaatggatcatattttattagtttttcttagtacacaagcaacatgctatcattgcagatgccagaaagtaggatcacattgttgtgctatagatctccagaacttctttatcttgcaaaactcaaaaactctatcatttctcaaactcaaaactcaacaattctccattccctcttcctccaccccatggccaccaccattctactttgtctctatgaatttgaatactataggtatctcatataagtggaatcatccagtatttgtcatcttaagatttctttctttgtgtaacgttatcaaggttgatccacattgttgcgtgtgtcagaagttcccttctcttttaaaggctgaatatttcattgctttatagactgcacttttttatccattcatttgtcaatggacagttggattgctctcatcttttggctattgtgaataatgctgctatgaacaggagtgtacaaatatctcttcaaggccctgttttcaattcttttggctatgaacccagaagtggaattgctagattaaatggtaattctatttttaatttgttgagaaccaccatacttgttttcatagtggctgcaccattttgcattcccatcaacagtgcacaaggatttttccacatcctcaccagcacatgttattttctttttctttttttgatagtagccatttaatgggtatgaggtggtatctcattgtggtttttgatttgcattttgctaatgagtgatgctgagcatcttttcatgtgcttattggccatttatgtgtcttctttggagaaattctattcaagttgacttctatgattttgcattatcacatctgtattgattcaagcaagccaactagaataaattctggcatttaaaccgattttgtggtttttctgcaaataaattctgcccccaaataacctccaactttctggaagcagtcagcaggagtacagttctgaagataactttctttaaaaaaggaaattcataaaatatcatgcatcttccttttttgacactaatggaacaatttaatgtaatttcagagggaagcagagcccctggaaaggctggtgtgataagggaaggttacccagctttcctgtcaggcggtgtgtgggagcagagagtggcattctctgcatactcttggggagaagagtgggtgagacaggctgctcagggctggggcagagcccaggggaaggggatggaaggggaagaacagcccttcaagagtcctgcagaaattggtggaagttatttaacagaagtgttcggctccacccagcacattctgttgccttctacatacagagtgtgttagtctgttctcatgctgctaataaagacacacctgagaccaggtaatttataaaggaaagaggtttaatggactcacagttccacatggctggggaggcctcacgatcatggcagaaggcaaatgaggggcaaagtcacgtcttacatggtggcaggcaggagacagcatgtgcaggggaactcccatttatgaaaccgtcagatcacctgagatttattcactaccatgagaacagtatgggggaaaccacccccatgattcagttatttccacctagccccacccttgacatgcagggattattacaattcaaagtgagatttgggtggggccacagccaaaccatatcacagggtaatgaagaatgtgtgcccaagtagtagagggcttaagaaaaccactcttgggctctgagtctctctaggtctcagtttcctcatctttcaaatggcaatattaataagacccacctcatagggattgtgtggggtttaaatgagaaaagacaggtaaggtgctggtaccttataagtgattaagttgccattaaggtattggggacttagtgcttgtccttgaagagctttcggtctcgtgaggagacagcctgatcgttataaactattatagaaaatgggaagaaataagggttgaggtgtgataaagatgtgctaggccaggcaagatggctcacgtctgtaatcccagcactttgggattacaggtgggcagatcacttgaggccaggagttcaagatcagcctgaccaacatggcaaaaccctgtttctactaaaaatacaaaagttagctgggtgtggcggcacccatctgtcatcccagctacttgggaggctgaggcaggagaattgcttgaatctgagaggcagaggttgcagtgagccaaaattgcacaactgtactccagcaagactctgtcaaaaaaagaaaaaataaataaaaaaagatatgctataccctcatatcacaataatgccaggaaatagatcattaattctgaaccctaattcttgggtgggcatcaaggcaggcctcacaagaagaaggcatttgagttgaatcttataggctcagctgggttccaacagcaaagacttagggaaagggcagagcaggcaggggaacagtaagagcaaaggcttgaaggcatggaagttcatgggtaattactgactgagatgtttggtgttatggtgcatagaacactatcggatgataatgaaaacattgaattccagcatgtttagaaggacattggctgataaaaatgacgtcttaatagttatctgtggacaaatttgtaaatgtaaaagagttgtagactcaaatcctacagaaattaggcaggagacctaaatgagtgaagtgggtgggtataaaacagaggtggtggcaggaacccatgttgaattgaatagtgggtgttttgtttaaaggggcaccagtagtaatttttcctctgttggaatatgatcctagggctgccagctcttctactttttcaagagaagccagaaatctggatttcatgcaaaatttcttgtttttctttttattaaagacatggtatggaccaaaaaaagatgtctctaggctagatctctgcaacctctcatctatactctatttgcatttttaaagactatatgcaaatgttatttagcagagctacctagtttttttgtgtgatgatagcatgtgaaagagctatgatacatcttggaaatgtcaactttgaaatatacagtgactgtgttggtcactacagaatgatctctgcagaaacttcagttacattttctctaaatgacacctttgctttgacaacacattttcaaaaagaaaaatagcaaactacccttcctccagggccttagccacagtagctcctgccagcataacacaatgctgcaccttactgagggatcaggaaatgtggtttgatttataattatggcttcatgggtagaatggtggccaatgtccacatgagccacactcagtggctaagatccagagggcatttaatttaggtagccagtgttacagacatagtttagatttttgcagccttgaccaatcttaatagatctgtctgttctttagagttacctttttttcctgcctcctagctacctacaccttttaatgctaaatgtagttagctagtgaatgctgttatttgaatcttaaaatttcaggttgggacagaaccttaaaattcatgtatttcaaccaccctttgtatgaggcaggaatcttggttatgacaggtgacagaaaattcaaactagcttaattcagaagggaatttattgcctttataaaaccaaaaagtccaagggtagctgccttcaggtattgtctgatccaggggtttgttatgtttccaggacatggtttcctttattccatctctgcttatgtattggctcccttctcagatggaagagactcccctcatcaaggtgagatggctatggaagctctactcacatttcctctaggttcaagtccatgtagagaagagcacctctttctcttgttatatctcacaggctctaaattagctactagggccagtgaaaaagcaatgtgctgattgaccacccttatctactcttggagttccggatggaattaacactacctgaattatgtggaccaagagtgggaaaggaatagttctccagaaggatatttggtattgttattaaaataaggttaattgaatactcactgaaccatctaatgcttgaattcccttcatagcacgccattggtgactgtccaatcttcagttactaacatgctacccccaaaatggtgtgtttgtgcagctctaataatgacagggtttctcctaatactgagatgatattggcatctccatagttccagacattatttctggtcccaaccataatcaacctgttttgacacgggtgaacatgtaagggaagggattgctcattgtggtcacagaagtaacctacccaatagaagcacaccaacttgaagcatgcttccatgatcactgagggaggaaaatgattggcaagtctcgtattggtccttgaagcgctccctataaacacttgtcactgccaagcgtgtatcactggccaaagcaagtcacattgtgatatgattagactttgtgtccccacccaaatctcatcttgaattgtaatccccataatccccatgtgtctagggagagaactggtgggaggtgaatggatcataggggcagtttctcccatgctgttctcatgatactgagtgagttctcacaagagctgatggttttataaggggctcctcccccttcactcctcactcttctctctcccgtagccatgtgagaaggtccaagcttgcttccccttcgccttctgtcataattgtaagtttcctgaggcctccccaaccatgcggaactgtgagtcatttaaatctctttcctctagaaattacccagtctcgggtagtatcaagatagcagtgtgagaaccgactaatacgcatggccatgcctaacttcaaagcggctgggcaagtatcatattgctgtgtacttgggaggaggggagaatcagaatatttgatctggcgaccaccacacaactgaacttctctatttctgtgttcttcttgttaaccatctagtttctgtttcctcttgtgacacatatattaattaatttttcaatacccaaacacaagcctctaatatttatctttgtttagttacttcctaataaactaagatatctctacatcctgatcctaaaattcaaaggctccacgtataccatggtgactagttaattccaatatattgcatagttgaaaattgccaagagagtagattttaagtgttctcactacgaaaaaatgcatatgttaaatagcttgatttagccatttcactatgtatacatgtaggaaaacatcatgttgtacactacagatgtatacaatttttacttgtcaattataaacaacaacaacaaaactgcaaagtctccttagacccacccaatcacatgttgtctgctcatttaatgagtaaatgctatataggttcattctggacctgggtaaaatgatttacggactgggaccaagtgggaggaccctatttcaattcattaggtaaggtcttccaggtcaatatttgaccattgattggcacatctggggtatagttatttaactgccttctagtttacctcaatatgacccctcagtggagggaaaatggagcacaatgactagaagaatgttgagagatgaggaaagagagaatgggatggaaagaacataaaataggaaagcattgacattgtcacttcttggctatttcttcctgtaaaattttgcctggagtgccctacaatggggtccccatcctctgccctgataacatcttagtggatcactcctctctcccttttcattctgcaggacttgcccattggggctctttcagacctgactggtcattgggtatctgtggccatgataatcactctcttcctggacgtgaccctcctctcgttaaccaggatgcctgtgttcttaaggttggccgtttccaaggacagagagcttgcatcccatttctaggggactggggatccaaggactccattcttgacattgtcttgtcagccttgaagtgccgaaacccagcatccctgtctgaggtcatcctgtctctcttccaaacatgaggacttcttaaattttttaaaaaaagtttttacttgtataaattgagaaggcacaagtgcaattttgttacatggatatgttatttagtggtagaatctgtgcttttggtatgtccatcacccagatagggtaccctgtactcattaagtgatttcttatccttcactcccccacccaacccttccaagaaggatgactattactcaacagtcattcagtagccattggagaatgactattattccatactctgtgtctatgtgtattatatagttcccatttataactaagaatatgcattatttgactttctctttctgagttttttttttttaagataatggctttgggttccatcctgttgctgcaaaagacatgatttcagactgggcatggtggctcatgcctgtcatattagcacactgggaggctgacgaaggaagatcacttgagcccaggagtttgaaaccagcctgagcaacttggtgagactccggctctataaaaattaaattagccaggcatcgtgttgtgtacctgtggtcccagtttcttgagaggctgaggcaggaggatctcttgagcccaggagttcaaggctgcagtgagctatgatcacacaactgccccccagcctgggtgacagagtgagaccctgttttagtcaggacttcaagaccagccttgccaacatggtgaagccccatctctgcaaaaatacaaaaattagctgggcatgatggcgggtgcctgtagtcccagctactcaggaggccgaggtggaagaatcacttgaacccgggaggtggaggttgcagtgagccgagattgccccactgcactccagcctgggcgacagagtgagactgtttcaaaaaaaataaataataaataaataaataaaaataaaatcaaaggtcttactcttttttatggctgagtagtattctattgtgtgtatgtatatatagatatacatacatataccacacacatacgtgtatatatgtatatatatggtggtatgtgtgtctatatacacacaatgatatgtatattaatatatatgtatatataaatatatatacattttctttatccagtcatccattgattgatgcttaagttgattccatatctttgctattgtactgtgataaacgtatgagtgcaggcatcttttatataataatttcttctttggatagctgcccaaaattcaggtaaaagatctcagtctacaaggcagctcccaagcttcaaaaaattgtcctgccagatttttaaaagcaagttttctcaaaagcttcgatgtatacattggtcgatttatttatccattaaagtatttattgaatacttcttactgcgtatggtggtggtggtgctgaggtgtctcacagtgaacacaacaggcgtagcctctgctattaccaaaattattgtctggtaaagaatgcagatggctaaccaggcaggtgcctgtacggtgagatatgtgctgtgatggctgtaagcgcatggtgtgagcgtagagttgggtgcttaattgaaggcatcaggaaggcttccaggactaaatgatatcaaagtcccaccttaaggatgacaggtttaactaagtaaaggaggatgtggaaagaagggggagagtgctccaggcagaggaaatagtatatacaaaagcacaagaggattgaagaaccaaaatcactttggcatggctggaatgaagggcatgtttgtgtattttcagggtaggggatgtgtttagggacaagctcagagaaaaggaagtaaggaaccctgtcataaagggctcatctgtcctatgaaagagtgtgtacattttattctgagagtacagagccttttcttttttctaagcattacatgattagatttgtcttttagaaaccactctggctgccgttaaaaatgaatttcacagtgacaaggctggaggaaggatcttgggttaggaggcggtggtagtaatctaggcaggacttgaggacgcctgagtggtggtgaggaaggagagaggtggatggaagattcaagagatatttagggggtgttattgagagaacttagtgattgatttggcgtgggaggaatgagaaagtcagggatggctccctggtttctggcttgggtactaggtgcgctggtggtgcttttgacagagatagaaccatgggaggaggaacatgttttgagggaaggctgtctcccttttagacacctagttggtgtccaaatggcacagaccagttggcgtgtggatatcttggggcttagggcgtggatctgggctcagggtggagatctgagccttagctgcacatcagtagtcattgcagtcatggagtgtgctggggttttgccaagagctcatgtagattcaggcgagaagagaggaggggcccaggctgggaatactggctttggaaatactcttgaaatatatagaaatgaaagaatgtatagggctgtttccacagacgtttattttttatttttatttttttgagatggtgtttcactcttgttgcccaggctggagtgcaatggcatgatctcagctcactgcaacctccacctcccaggttcaagcaattctcctgcctcagcctactgagtagctgggattatagatgcccacgaccatgcccggctaatttttttgtatttttagtagagacacggtttcaccatgttggccaggctggtctcgaactcctgacctcaggtgatccacccaccttggcctcccaaagtgctgggattacaggcatgagccaccgcgcccggcccacagacatttactgagcaagagcttgtgcaaggcactctggtatgcatgcagtcggggaccctctgatgaatggaactcaggccttgtataaggaagtgacctccatcagagggtggagacgctgtcagtgaacatccatcacagacaagtgactgagctaggagctggggtaaggtagaaagaggaggacagtgggcgatatgagctgggaaatgcacctctgttgggggactggggagggcttcctggaggaggtgattttggtatctagtggttttgttttgttttgtttgttttttttgttttgagatggggccttgctcttgttgcccaggctggagtgcaatggcatgatctcggctcactgcaacctccgcctcccaggttcaagcgattctcctgcctcagcctcccaagtagctaggattacaggcgcccacaaccatacctggctaatttttgtatttttagtagagacggggttttgccatgttggccaggctgttcccgacctcctgacctcgtgatccgcccgcctcggcatcccaaagtgttgggattacaggcgtgagccactgcgccaggcctgtatccagtgtttaaggagatgttttgtcagataaagctggagttttgtaatggagttttggagatggggaagggcagactggcttaagagggtgctgcataagagatggctcagaggagagaaagtgtacgatgttttcaggacaaattagtccttcaccatggcaggaatctaggcggccgaaggacatttgtgggaaattgtagcagaaaatacgaggaggactttgatgccaggccacagagtttgcagtcctttttggagactcaggggagttattgaacaattagaaactaaaggctgatgtgacctccacaggatactggctaaacgcatgaactcttgaaccagatggacctggatttaagtctggattctgccatttccttgctgtgtggtcttaggcagattattaacctctctgagcctcagttttctcatctgtcaaataggagtgaaatacctcatagagggttgtgaagagtgaagtaaactaatgtggagaaggcattctgcagtgtctggaattcagcgacccctcagtacatgttaacacactaatactttctacgtaatcatacctgtaacaacacagagacgatggtattatctttacagcttgttcgcttctgtatcctgagcatctaggacagtgcctggcatgtaatggatgctggagaaatatttcttgggcaagaaatgaattgcaccagtttctttttgtaagggatctatttttttcttgtctggaaaaatactttgataaaaccttagggaaaagatgaaattccctttcttctggagcctagatttcaaagaggagaggttgagtgctctgcaaagtagaaggagaagattttgggcagtgaggaggagagaattgatgagatggtggggcacagcgtactatgaaatgtgactcttcccccgggacccccgaaaaaatcttctgtaacattttatatgtgtaagacatctctctaccatctgctatggtcgaaatgggatttgtagagagctcatgtgattctcaaacctcctagtaactctgcttacatggagagacagctgtctccaagccagctgttgtcttttggaaagctttaatctgggggaagataacaccttgagaaaagatgtcaggattggaggcagatgttgacggagccagtttctaatgccccaaggcagccacactttgtatggattgtatggatgggcaggtgcacaaggtgagttatttttttccctacccagaaatttatggaagcctggcatggtggctcacccctataatcccagcactttgggaggccaaggtgggcagatcacttgagcccaggagttcgaaaccagcctgggcaacatggtgaaaccctatctctactaaaaatacaaaaattagcctggtatgggggtatgcacctgtagtctcagctactcaggaggctgaggtgggagaactacttggacccaggaggtcgaggcttcagtgaaccatgttcatgccaccacacttcagcctgggtgagagagtgagaacctgtctaaaaaaaaatatgaagttgctcttttgaagagcattctaatgacttatctggagattctaggaaagaaattaaattcagctttcaatgtctgtctttctagatttcttccttctaacgttattgttgttatgtcctcaaacaaaaacatttagtacttattatgagcttcatagggttgttgtggattaatacatgtaaagctcttagtgcaatacacgacacatagataacatttaattttattatcgttactgttgggtagcactcagttcatgaaattcccacacacagtcaagtggtaaatgctattactttgtaaatatcatcgatgaggaacctgaagctcacagaggttgatgacttgcctaggatcgctcagaaagcaggcagcagagctgattgccatggtaaccatttccaagcttcagtgcccagagatggacccagtctggcatgggcttatcccctggagcactgtgagtgtcttgacagataagtaaaggaagtctttaatttctgaaaaatgcccagctgtgattggcattgttaggggtcagtgaagacacgctcaaagaccttactgtccagcttttttatctttcacctttaatgccgctgttagccccaggagctaaccaaaggggagttttctttatcagttccaagagggatgccatggttgtcccaagattctggagctaaaggtgggaccaggaccagaattcagtttctgtgtttccaaattcagttctattctcctctcagtagaccaggaggcctccagacaagacagatggcagacagctacagtagtttaaaatagcctgagctcacttctgaggtagacatgtgcgtggagtgagctggaagacagggacccctgtgtgggaaagattttggcaaagagaagcccagtggggagttctgatgctaggctgagtgtcatcaggttggggtgagggtgtgagaagagacctgagcaggtgccaacctgaggctgagtggggaggagagaagcgagaggacaggtgccaggcaagatgcggcactgccaatcagtagaagcttcctccctcctttccagctgtgctaccgagacggggaggtcaggtggtcgttctgggagggctggtgccttttacttcccggccttctggcctgctgggtcttggagtccagtgcaaaataatgaagttcctataaagacagtttgtatagatccttttaggatgacttgaaagcctatgcatttccttaacaatgatcaattcttggctaatcctctttcatccatatccgcacccaatgcttttcactccatttccatactggatgttttgaaataaatcccagacaccatataatttcagtaattatcaatctcaatatcacagaaagtcaaatagacattatatatcttctaatatgatgcaaatagaagtggccaatgctatctatgcaatattattactaaagatctaaccaaatttacaggaaatacagagaatatgtaggaaattctacatagaaataacttgatttcttcacgaaaccaatggcatggaagtgtgaaaaaaatagaattaaaagatatagcaatctaagatagtgtgtggacctcatttggaaataaattcaaacaaatcatccataaagaaaacattgtgagataatcaaggagaaggaaacattaactgaaatataaaatgataataaagaattgttattgcttttactgggtgggataatggaattgtggttgcttttttgttgttcttatctgtggagatatgctgaagaatttatgggtaaaataaaactaagcgatgctaggtggggaggaacctatgcatttcctattttttggcaaaaaggccccaaggtgtagtccctagcacctatgttcgaacaatgtgacccagcattcctgctgatccctgactgaaccaggtatggctccacttgatcctctctctggggactgggagttagcattcagaaatgccagctagcctccatcaacagcagactggaaggatcaggcatctcaggaatcatgcaatgtgcatcaaaaaatagagaaagcttatcttcagagagacagacaagtgaagctggctcagaggtcatgtggaccagagggatgggggaagcagttgccttggttcctgacaatcctgcattgaagtcaaactgctgttcctttccctggtttctgtttccttgtaacagacttattcctttgcttgaactgggggcttttagtggggttctgttgcttgcaaatcttaagtactctgagaaacagctaaggagatgaagatggaaaactttgtcatgaagggaatgggttactggaatctttctggagggagaatttcagaattacgaggatgcagttctgattgaagggggtcttgtgggtatctgggatttggaagtgagaatgaatgctgtagcagatgctattagctacccatccaatggcgattccttctttgtttctagttttgttcggtggcaatgtgcccaggggacagtgcatgcatgacccatgattatttccctttcagtgattggtctggaagtgggcactggacccagtttgggtcatgtaggaaagactctttcttttcatcctttcttcctgctctggaggctgttaggtgaggacataattgttggagctatggcagccacattatgactatgaacaggtgcctagatttgtagcaacactgactgagagcactgtcattcttgagacactcatacctccttctttcagactttattattttggggatgatatttattgatgagccccttttggttaagttgcatatggttggctcttctgttaattcaagccagaagattcttaattgatacagttaggcttcataatttggaggtttgggaggaaaatgaggtgaaagagcatgcattgttggggaagataatattttaaatcagaaaattaacattttctaccagaagaccttcaattattatattatagactggtttgcagagccttttgagagtggtgtgaactgatatccatccatccatccatccatccatccatccatccatccatccatcatcttctgtttgttgattttctatccatccatccattcatccatccatctatccatccatccattcgtccatccatctatccatctatccactccatccatccatccatccatccatccatccatccatccacccatccatccatcttctgtttgtcgattttctattcatccatccatccatccatccatccatccatccatcatcttgtttgtcaattttctacccatccatccatccatccttccattcatccatccatccatccatccatccacctacctcatccatccatccatccatccatccatccatcatcttctgtttgttgattttctacccactcatccatccatccatccatccatccatccatccacccatttgactttctttttacgaaactttccctttgatcaatggaggatttccttcctggacttgcttggttctgtctattatcagctgggtataaaatgcttttccttcttcagttaggtcacgtgtagagaattgatattagatagctatggtgaggagtgaatgggattctgcctggcctctctctagggacactttgccttctgcagtgtctggcatttctaagaaacgttgatttttaggcattgaggaaaaaagctgttttttttttttttttttgacattaaaagctctagttttcccttattttattccctggagcttctttcaacatattcaagcactgttggcttcaggcgtggctttgtgggctggaaagggccagggtatgttttcagaggaatcctgtgggattgaattaggaatgctgccttcaggggataagtattattttaataggaagatattctttattttttgattcttaggaattgctgtttctcatgtagatgtacttacctttgttacattaataagttccataaaatattttcagcgtatagaatttttatatatctagaccattgtctgtttcaggttaggaattgtcagtgtttatacgtgcgcctaatcccttgtagtctgttcgttactgggatggtggtgatgggggcactagagggtggaatttgcgcacatggagagaggagatggtgcatgtcagtgtgttttccagttgaggcccttggggttgtgggtggggaggaaagaggaggaggaggaagccagtgtggtaggagtgtgatccacattctcaggaagaaccatatttgatttcatttagaaaacggaattcttacttcttgaacaaagttggcttttcttctctgaacgtggcctttgcaaatgcttgagtctttgagtatggtgatgactgagtgagaggagggatttgcttggggcagcaggcacatctggaaccattgaccacaaacctggctgagcacagagccacccggatgatgggcttaataggtacaaactgggaacttcccctcaggcatgccaactcaggaggttgtcaccagtggctgcagcttggagtgatctggggatcttttaaatgccccaatgccctgcctctacctctgtcagtgaaagcaggctgtctgggagtagaatcagagcagcagtattcattaaaggctctccaggtgactgtcatcagcatccaggtttgagagccactgtggggaaataatctgtactttctataaagccagaagcagtcagttttctgaacatcactgattagaccgtagccattttccagtatggacaaagtaggttctctcctgccatcccccagctgcagcaaacttctcactaatgggcatgctttgagaaacaccaaactgcagggacccaaaggagcatacaattaacgttaaatcacaccagctttgggcatatatatccctcctccaccccaaaatctcttttaaaatagtgttttaaatgtattttttgtagtatgttcacaggactcaaaaaaaaatacaaaatgctgcactattcacaataacaaagatatggaatcaacccaggtgcccatcagtggcagaatactatgcagtcataaaagagaatgaaatcatatcctttgcagcaacatggatggagctggaggccattattttaagcaaattagagcaagaacagaaaatcaaatactgcatattctcactgataagggagagctaagcattgagcacacatagacataaatatgaaactagacactggactactggaagttagagggaggggtgggtttaaaaactacctgtcgagcactgtgctcactgccagggtgacgggatctgtacaccaaacctcagcatcttgcattattcccgtgtaacaaatctgcacatgtacctactgtatctaaaatgaaagttgaaatttaaaaaatgtttaaaatccacacagttttaaagtctcttattctcttctgttctccatccacccatttcccacccccttctctggatatcttttcagaaatcttttccttcaccccctttgttgtcacacaaaagatgacatactgcaacccctattctccaccttgttttttttttttcctgctaatatttggctagtaagcaccagcatggtgtaatgactggcatttgttctgatttgttgagcatcctcagtgactggcagaagctcacatggtgctgccagtctttagatatttgaattacttcccctgtccaccccacgtctagaagatctctctaagcaatgcaaagacagcttccttatactactttttaaaatagatgtagagtatatatatatttgagacagggtctcgctctcacccaggttgcagtacattggtgcgatcttggcttactacaacctctgcctcccaggcttgagtgatcctcccacctcagcttcctgcgtaggtgaggtcacaggtgtgcaccaccacacccaactaatttttttttttttttttttttttttgcatttttggtagagacagagtttcaccatgttgctcaggctggtctcgaactcaagcgatccacctgccttggcctcccaaaatgctgggattacagatgtgagcctggcccaagtattcattttttaatagatgtaaagtatggataattcataatttattaaacaagtcctgtagggatggactttaggtgatttccaatttggggccattacaaacaatgccattaagaatagtgtggccaatgcatcacttcagatgtgtagaaatccatctgtagagttcccataagtgctatttcttggtcaaggggcatgtgtagagtatctttagcgacgggaaatttcacgaaggcatcacattttccagtttgctgtagcaggcagctctgcttctgaaattgtagtaggtacagggttttcttttctttttttccattggtggctttgaggaactttcagatgggatagttgaaaaatgtacatctaatggttttagaggagatgcttctggagctgcagttctcctagggcctttcttgaatgacctgcaggcaccatctggtgtttgttaaaaatgtggaccctgagccctattagactctttgaggcaaggcccaataaatttttaacacaagcttcccaagcgatgcttctgtgcactgaagtttcagaaccactgttctaagggatttgttgtagaacaatgccgtgagaggacatcttttcatatgattagcacagtggaaccacactggtttactcgggacaaagtctgcgactgccatgaacattgcaagctcaataatgccaagcaaagactgagtcttggcatcgggttgaaaataacatttggctatcaacctctgatgcagcatttacaagtttgccctcaaatgcccatagaataggaggaacagggtcaacaacactgaaaatagtcagataaccagttgctggaatctcagtgaaatatccattaactcaaaggcagatggcactggattggatctacccttcacagtcaacacctccaacaagatggaacaagaccaactggaaacagctttgtctatcttccactgtcctattcctagactaagagactcagcttcgtaccaagtgggaagtcactctcttctgctcaaaattaagtttttgaaatgaccacaggcctcttacgatggctaattttcctacattcattcagagaagccagcaagggaaggggaggcagttaacttgtgcagtggtttgtgtagggaactgctggtggtgaattgaacgttcagttgtgtggctgccatacgttaggtgcatagaagagaccgaaggaactagggtgtgagtgcattgtggaatcagagaatcagattgtggaggtgggagaagagtctgaggcagttcaagagagctgcagtggatgagtgcttgctaaaatcccagtgctatatgtgtagttctgccctccaaccatggcttgagaagaggactggaccattactagcgaaaacatcactaggaagggcagcctatacaaccaatcttctggcagacacagggcctggatatatctttccaaagaataacccagtacttaagacaatgcagctgcgtttacagagttttgaagggaaatgttatcatctacatatttgattctcagtcaaactgtcacttatgtgtgaaggcaacagaaagacagttttcagatataaaaaggcactgcaaatctaccaccactgaaaaagttaattgaagatgtactctgattgagagcagatccaaaattaggaacttaagaatgaagaagtcatggtatggaggaactgggatgagcacttccagtaattaaacataatattgagtccaaataattgttataagtctccaattaagtgtcagacaacaataattatttgtgaatgagtagctatatggtgtaaaattagcttcatgatctatttgagtgcaaaatcctagcatataaatgaagactgggaagtagataacataggagcaaggatatgaaaactttacttaatctatcatcttttattggttttacttaatttttcatctttcattgtggaagacagtcagaaaacatgctgttaactttctttaatcacaatgaagtaaaactagaagttaataacaaaggttataaaaaatcaatgacttaaatataaaatactttccttaatgaccctgggacgtgttcaacatagtgctgtatgttcctgttggtccttaccattgcaatacggcaaaaaagaaagaaagaaagaaagcatacaaagaaagaaataaaactgtatttatttgcaaacgacatgcgtatctgtgcagaaaataccaaggaatctataaaacaaaccaatcaaccataaacaagccatcctacaacacataagtgaattcagcaaggttgccagatacaggggaaacatacaaaaaacaattgtatttctataaactagcaatgaatacgggaagactgaaattgaaaatataatactattgacaattgattgctcaaaggaaaaaaataattagctgtaaatccaacaaaacatttgcaggacttatgtactgaaaactgtaaaatgttgatgaaagaaataaagaatatctacataaatgaagacatactgtgttcatgaattgaaagactcaatatagtaaaggtagcagctatccccaaattgatatacaggtttaatgtgattcttataaaaatcccaacaaaattactttgtagatataaataagattattctataatttatatgagaaggcaaaggaactagcatagctaaaacagttttgaagaagtagaataaaatgggaggaatcagtctaccgtagtcaagactatgtgatattggtggagggacagacacataaatcaatagaacagaatagataacccagaaatacacccacacaagtatgctcaattgatttttgacaaaggcacaaaaggagttcaatggagaaatgaattttcaacacatagtgctagaacaattggatatttattggccaaaaaatgaacctcagcccaagtcttgcactttatacaaaaattaactcaaaattgatcatgctattaaatgtaaaatataaaactatacaacttttagaagaaaacataggagaaaatttttggaatctagggtcagggaaaatttcttagactttacaccaaaatcatgatccataaaaggaaaaattgaatagtcggacttcatcgaaactaaacgctattgttctgcaaaacgctgttgagagaatgaaaaggcaaactacaatctggaccaaatatttgcaaatcacttatctgacaaaggactattatctaggatacataaagagccctcaagtttcagctgtaagaaacaaacaatccaattaaaaaagggcaaaagctatcaacagacatttcaccaaagagggaacacagatgacaaataaacacatgaaaagatgttctacatcattggcttttaggaaaatgcaaattaaaagcacaatgagatatcactacagatcaaaatgtcaaaaatgaaaaataatggtaatgccaaattctagcaagggaggctgaggaacaactagatcacccacacatggttgctgagaatgggaactgcagtagccactctggaaaactggcagttttttaaaacatgccaactgccctatgacccagcagttgcactcttgggcatctatcctagataaatcaaagcttaaaggctcatacaaaaacctctgtgtgaatatttatagcaagcaaggaaaaaaaaacccacaagagaaacctaaggtgaactggagtaagaatatagatgagaatatataatattttatattctgatgaaatatagtgttaggatatataaaaaggattgtgttgatacctctaagagttagtcctggaaaacagaacaaagcaaagcaaacaaaagagccaataaaacatctacttctaattatatatttaatcatatatatagatcatatatatatcacgcatatatttatgtaacatatacaatgaatatatatagcaaatatatatatgaacaacatgcaagttagaagtgagaaaggacttataaatccagagatagaaaaattataagacgagatgtgctattacaatggtgttcagactggtactctcggatttatgtcgtagcttttccactactgttttctgaccttgggtgattatttactctctcagtctcaatctcctccactataaaacagggataataacgcagtagttgtatggatttggttaaataatgcatgcaaatagctcaacccagtgttggatgcctcatagaactaggatgatagctgtttttcaatttttggtattaagtttgaaagtccaagaagacagaaatgctcaaattgtctaccataaaagatagactgcctagattaggggttggcaaatgttttcttacaggactagatagtaaatattttaggtttatggggcatctgagcaactactcaatgctactattgtagcatgaaggcagccgtggacaatttataaagaagtgagcatggctgtgttccaataaatctttatcaaaacaggtggcaggcctgcaggctgtagtttactggcctctagtctaaaccaataacaagaaggaagtaatgaaagttttcaaaatcctcaccaaaacctatataacaaatgatccttttggtttttaaaacatttctctagaccatagggaaaaaggacactgtctcacttctctcctcttaccctagcatcatacatacacaaaaatctaacaaagataaggcaaaaaataaagccatggtctaatttcacttataaacacagagaaaacagtcctaaataaaatcttggcaagttgaatcctctaggatattaaaagaacaatgcatcatgatcaaggaagcttcattctagaaatacattatgatttattattaggaagtctattaatacgtcccatcaatatgtcaaaggaaaaatatgatcatagatgcaaaaaaaagcatttgttaaaatttcaatatttgttcttggtgaaaattcttggagaaaggactaagaacaaaaagatactttttcagcatgatgaagactatatgtggccaaccagtagccaaaaatatacttaattttgagatacttaaggaattcccattaaagttaagaataaatgaaagatggttgatagcaacactgttatttgtcattgttttggatgttctagtcaatgaaacaagaaaagaaacatataaatactaattacatattggaaaaatgaataccaaattaacactattcacaggttatattatttattttagcaactctaaaggaatccattgaaaaactattagtacaaataacagaattagttaagagggctgattacaaaacatgtcaaccaaaatcaataactttcttagagagcatctctaacttggtggatgacataatggaaaaataatcccttttggtctccagatgccaccagctcccttttcctcctccgcatgcttggcagaaggccagaggaagtactgtagtcctctactacagagggaagtgtaggaaactggaatattaaccatggattggcaatctgtgtgtctaaaggaaagtggtttacattttcttttaaacgtcacacttggcatgccagatccccatggcgttggagcataccaaagtgatagagcgtgggcataatatgtttcaggcaaaatgtttagcatttgcacagttaggttctcaccaatggtgtgttccttccatagacatgtgagcctggagcttggagcattggagtttgagaaatggcttgatgagggcattgagaagcactagaaaggatatggatagcaactcgattcaaattttatttttgtctacttttctaagtttgtttacttcaagcacttaaactccacttctttgagcctttgttgccttgcctacatactgaggataattaaacctttctcctagggtcttgtagcagtaaatatgattggatgaaaaatacgaaagcatgtcaacaactgcttgttaaaagttagttacctttctgcttccttcttatgcttgactagctcccttgactctttgaaaacatcagaaagcctagccttaaactcctttttggaaactaagcattgggtcccagagcctgaggtttcttaacgtctgcccctagtctggttcagcttctgcctgtttctcaactttgctctcatttcaggaaaggagacaaatgaattattcacgattattgtctcttgaggggcagtgactgtctcttctatcttgttcttccactcccctccggagcatccagagcaactctagaaataggagtgtagaaataaaacccaggaaagagggactttagaaacaagaggcaatgccatggacaggggtggcagaactgttgcccttccagtctttgctctgccatccaccagacttgttgcatgggaaactcagtcaaactctgaagcttcggagtgttctccactataaaaggagaaaaatgatcatctaccttagggtggtgttgtaaaggtcacatatgtgtggccaggcacagtggcttatgcctgtaatcctagtgctttgggaggctgagatgggaagatcacttgaggtcaggagttcaagaccaacgtggacaacatagcaagaccccatctctacaaaaaaagttaaacaatactaaccaggctagttgacatacacctgcagtcccagctacttgggaggctgaggcgggaggatcactggagcccaggaggtggaggttgcagtgagccatgattgtgccactgcatttcagcctgggtgatagagtgagactctctctctctctctttttaaagatacatgtgtgaatgtgtcttatttaactatgttacacatacatataaatataaattctgtttattaatagctcatataatatacagactctgcgcctgtacaaatgtaaaggcaatgcattttacgtaggaaaaatggttgagtcgaatgatttaatttttttacaaatcacacaatacttgcatgaaatagcaacaggtgcgaacctcctaggcagataggagtgcagtgctttgtttcacagataccatcaagcctaacctttattgtgggcttactatgtgtcaggcctgttctaggatcttgttaatgaactgattcatttttttctcataacaacatagaggggaaaagatcacatggggaaggcaccaggtccctggactttgcctcgcgtgctcctggcattttgtagagaggtaaggacttggttccttatggacttttaagctcatgattggtttggtctggtttcaattctcatcttcatgtatgctcttagaaataatctcattttaggagagaaattcagagtcaacacggaaactgaaaagctctagtactgcctgaagtctcagaataaagggtgccttcattttcacttttccaaataatctatgagagggacttttagtagatccgtaagatgtgatactaacatagtatctgcatattgtgaaaaatttataactgtatccataaaggttatttgactccattgcctcaaagtctatataattagaattccatgatgtcatctttgagctttaatatagcttaaaattatccttctgtaggttgtgtttctttctgaaacattttaaatttagaaaattaacttgttaaacttttttaagttaaatctttagatttttttttattcaccctgctgtgggggagtcagaatgacaaatgcttgaatcatcaaagtcaaatgttagggcattttagcccctctgggaaagctaaggtctccatggcccaagaatctaactctacttatggggatgatgatctcacatgatctcatgatctctgtgttttgccaacattccttcttggcaggacttaggagtgcagatgggccccagagagcatgccttgctcaagccaggtccccctcctgctgccactttgggtggctggaaaaacctcacaaagggtgcagtgtctgcggttgggagactggtctcaattttcctccatcacctgctcataaactctcatgggtttctgggtcacagtgcagccctaggtcaatcttccaaaagctgatttgctgaatttcatgtgaattgactagcttcatgtcagcattttagggaacatttgattggtcttcatgcctgctttctgcctttgcaggctgagaaacaatgaggggagagaatgagggacagagagaggaggggactgaggggccaaggaggttccgatgagcaaaaatggaagagaaagaacgtcagagaggaggctattgggggatgaggagagagaccagagatcaagaagcatgaaggtattgagggccagagaggggacttctagggacatggagaggctgcaggacagagaaagggctaggggaacgggacagtggttctttcatttcaatgatcaaagttcccagctttttgacaccacaggggcaccctgacaattctggcaataagaacatgaaaggcctggtctttatttcactcaattcctgctatgtgtggtgagtgtgggtgagccaaggggaaggtgatcctattgtcaggaggtaatttaccatgaataggggatgatatggaaataatgtgtgtgatccttcccctgccactgttgggatgtctttttaatttccttccctcatttgtcacagccgtgaaaatactttttctgatatgatgaatgacagatggcagggtgccggcagcccttctggagggatgggaggttgtgtgtgtccacgataggggcccaataagtactggctgaatgagaaaatgaggagcctcactgtgggctttctttggggtgaatggaggtgctgagtgacctctcagcttcctagaagtcacaggccagaagccgtggaatctcagtggtggaaagtcctactgatttgaggatcagggagggagagaatcagcaatggtgtgctgataaatgtttagtagttggctctctggtaaaaaagaaaaagaaaaagaaaaagaaaacaaaaacaaaacaaaacaaaaaaaacaaacaatgaacaaccctggtatgcagtgcttgccactggtcagtttccatggtcagtttctcaccatgggcaatttcatgtgccatcactgaacacagagtagggaagagatccacgccattggctcacaagctggccctaccacaccaccaggaggaatatatattgggcaacgactaatagcaatagaaaaactcatgcttctttctcctggcatgacttcatgtatatgacatacatcctctcattttatgcttgtagcaactctgaaacctaagatttatttcctcattgcaggtggggaagccaaagctcagaggggttaaataatgtttctgttattgtacagcaaatcagtggcagagtggattctaagattcgtgccttctctactcacttcactgggctgtcagaggttaagggaagagttacataagccacctctgattattagagaatgacagggctggctaattctgcctggatagtattgaagaggagcttcattcaggggcaccgctttgctaaagagaccacccaaagaatgagtagttttgagtcaccaggtaccctgaagtggtacctgaaggtacagctggtatgatggatgacagatgccggtaccttgctgtcatccatcatatcagttgtcagttaccaggtagacctagcggtaaagggtaagttatatctcttgcctaaatgtcagtttcctcatctgtaaaatgggaccctgaaagtctactttagagggctatagggttgttaagatttaatgagttaagtccataaagaacctaacgtagtgtcagacacataatagatccagagaaatgctgattcttagcaggctaactttttctttttgaattcctctttaggccagaactgactagtataggcttttcaaactttagcgtgcagaagaatcacctgtggatctaattaagatgcaggttgtgatccagtaggtctggggaggggccgggcctggaatcctacatttctaacaagctgccagatggtgctgattctgctagtccatagatcacacgttttctttcattctttctttgtctttgtcttttttttttttgagacagggtcttgtgccgtcatccaggctgaagtgcagtggtgtgatctcagctcactgcaacctccaccttctaggcttaagcgattctcttgccttagcctcccaagtagctgggattacaggcatatgcaaccactgctggctaatttttgtatttttagtagagacggggttttaccatgttggccaggctggtctcgaacttctgatctcaaacgatccacctgccttggcctcccaaagcgctggcattacaggcgtgagccaccatgcccagcccatggatcacactttgagtagcaaggggctaagggatcctgacatagcattttggggtcctgcagcttcaacttactctgctgcctgttcccatgacctctaagactgctcttctcgagacagcatccttgttctgcactggttcctttggagcagctgctcagccctgctaaaggcatcttgctcagtgcaatattagtttgctgcggaagatctgggacctgggctcctctcctcattctccttgatcttagttttggttctgccaggactttgctgggcaatctttgtcatgtcctttcccctttttagattcaatttcttgatttgcaaaacaagacagtaggagagagtcactttctagtttaggcattctgaagttctgtgaatctgtgataccagctggttggtgcattttcctgccaggccataagcagtacttgcctttatttctgggctccagtgggggtcttcagagatacatagatgcatatagtcaggacaagagttaggaggagtaaaggtaagggttcaatccaaaccttttggaatagtaacagggtggcccagagagatgaagaatgattggggcacaggaatcttcttgctttggggcctaaacgacatctccagggaatggctactcattgggcacatatgagccaggcactgtgccaagagctaatgggagacacttgtcattctttctggccacacactctggagccgctttttttttttttttttttaatatttgtgaattcgccacctcataaacccatgtctctttaatgcacaactcagaaacccactcgcccaacctcccttgcagctagagcacagacatgtgacctaggatctgtcaatcaggtgagtccttgctggactctgaattggtggctagaagcagcagacactgtgtttgatctgttctggagggggaggtgttaagtatgtccagactgcagagtcagctatggtggggcttctagcaagatctgtcccttgtgaatgttgaatattcacagcatctgtagtgcagattgcctggtctggactctggagtggtggcagcgggttctgtactgtggtcaagatgtttcttctggctttctaaatgtgtcctaattggattctcagggcctcccaaagcttgtctttcctggttaaactggttagagtgggcttccatgtttataaataagaatcttgactgcttacaacactttatgtgtgttatctcattgaattctttttttaatttttgagatggagtcttgctctgttgcccaggctggagtgcagtggtgcgatcttggctcactgcaacctccacctccagggttcaagcgagtctcatgccgcagcctcccaggtagctgggattacaggcacacagcaccatgcctggctaatttttgtatttttagtagagactaataaggttcaccatgttggccaggctggtctcaaactcctgacctcaagtgatccacctgccttggcctcccaaagtgctgggattacaggtgtgagccaccgtgcctggccctccttgaattctcacagtaacctagtgaggtaggtgttattatcctcttcttgtaactgaagaaactgagtcaagaagagatgaactaacttgctcaaggttccactgtcgataagtggaggcccaggatttgagtccagatcctctggttccaaagcacacattcttaaccaccatgcatctcctgtcagagatttgtgggtgtggaaaggtccttgcaaatcacttgtcagtagtacagggtttcatgagatctacacctgggctgggcacgcctgttggttttttactgacaacgcataatttttcgaggagtggtaatcagaggcaaccgttctagtgacagtgattcaggcgtaaacacttggctttggcccagaggttgcactgtgtgagaccacaggtgaacactagaatgtttacactcttccggagtctgtaggtggatgccagggacagagaatgagattgtaacccagagaaagaaagaaaagaaagaacgaacaaacaaaagaaagaaagaacgaacgaatggacaaaagaaagaacgaatgaaagaaagggccagcccctggggcctccttagataaggaagagaaaggagaccttgcctcaagctcagaaactggttaaaacacgagcccagtcacctagtgataagcagtgcttggttctattaactctgacaacatagtactatcttgggcagagctctttggagaagcaggttggctaactggccaacctcagttgattctcatggtcttggaactttcctgggggtccaacttcctccgttctgcccctcttttttctctaccttctatcgttttattctttgtctcctttatttttcttcaacaaatatttttgagcacctattgttaacaattcaaccaatatttattgggtgtttgctcggtgccacttacagttctaagtgctggagatacagcagtgaactagccagacaagctgtcatagagtttccaatttagtggcagtggggtagtccagtaggcatgaagccaggcaggtaccagttgttgaggtggtggtagttccacccagtactaggaagataacattcttatccccattttacagatgaagacactgaggcaagagagcttaaattaattgcctgaggtctcacaggtaggctgggatctctgtgagatctaggagtgccagagccacttgggtccagccacccacacctcttccctgtgcctcaggctgggatgacacccagagcctctcctttctccctcacctgggcccagagaccacctccttccctctccttgcattgctgctgcccatgctaaccgaaggagcctcgccgtggggcggatgtggcctccccagtggcccacttcctcctgcttctgccaacagcagcattggcccctatgatttgaattttttttttttttttttttttttttctgttgatccctctagcggcaccagatgtgggtggggtggagggtgggtacacccacactcccttaagcctggaagtaacctaggttccagactctgtgtgtccctgaatggtaatagtgactctcttcttagctgtctgtcccactgggtcctcccactccccaactggtgctcctgcttttcctcagaatgggggacataaatctccttctagtcccaacccattgtcaggcagggcttcctcctggagggctgacttcccaggactgggccagctaaaagctaagcagtatgggtaagagcacggggttctggagtcagacagacctaagttcaaaccccagtactgccgtggacaagctgtgtggcctcagacaagttgattaacctctctgagttccttttaaaataggctgaggtctgtagggataaggtacctgaggtcttagtgcctggcacagagtaaacccacgtgttggctgtttccattattgggtagaacagaggggcctcctggcatcagtgggcattttgggcctgctgctgtcttgtctatctaggccttggttttgcctttcaggctggtgcctctttgcagtttcactttagcaagtgaaactttatttttcctgtttctcctgatctgtttcctccttattttccatagtgaataatcacacataagcctttcttttctcagggcaaggttgctgtctgtgaaggagtggaatgcctgagcatccctggtaggaaaggaagagtgaccagcatcaatggggtactctattccctgagtagcaagccctcttcccgccttgtccctggctcccacacctgttatcctgccggcagtcatctccagtatcccagaggagccatagggatgggtgtttgaatataagaacactctgcagctcagatatgcggcattacttttcctgtttgactcagttctgcagagggttgctgagtgactgtcatgtgcaaagcacgtgggaggaaagatgaataatgagagcaatcgaatgcccattcccttgcatccagggtgctctactagacctgcgttcttccatcattctttcagcccacgtggttgccaatactgggagttatcagtcttttccatttttgccaatctaatggataaaatatcttgtattaatttgcatttcccagatattcatgagattaggcatacgctttttgggcacttgtatttttttctctgggaattccctcttcgtattactttgtcaatttttctagtggcttttttatttgagacagggtcttcctctgtcacccaggctggggtacagtgtccagatcacagctcactgtaacctcaactccagtgatcttcccaccttagcctccctagtaaatgggactacaggcacacaccactatgccaggctttttttttttttttttttgtagagacagggttttgccatgttgcccaggctggtcttaaactcctgggatcaactcatcctcccaacttagcctcccaaggtgctgagattacaggcatgagccactgcacctggtcccctgtctttttttttttaattaattgatagtaactctttatatattctagatgccaatccgtgatttagtctaaaaataaatccccttggtctgtcctatgtcttttcttttggtttatgaaatcttttgtaatacaggaacgtcacacttccacagtcaaatgtgtcagtcttctaaatagatataggtaccttgtatatactccttgatatatcacattgattggtggtgacctgtttgtctccctggctgtcagactgtgagaaacttgagggcaggggctgtactttattcttctctgtctctctagggactagtgcaaagctgggcacagagttttgtgcctgaatgagttttttttgtgtgtaaacgtggtataaaacaggtcttgtgactgaatgagggaatgaatgaaaaagccctgtcctgccctccctgcagagatggggtctgctgcagagatgggagtgagtcagggagtgaatcacaagctcttccgtggctcagctgacatttcaaaagccctgagcagagaagcccccctcattccaagagagcctccgcctctttgagcaggcacagtgaagctctgctgattatcaaactctgtgtgtgtatgtgcacgcacgtcaggggtttagcagttaaaactcttagtgctgcatattctgcgtatgtgtgaacaaggctttaaaaaatctctcagaggacctgtgtatgtgtgtgggtgctgggggctgcatagagagagagttaaaagagatgagggggtgtttagaatcgttgcaatgtattgcatttgtttctgggagggtggggcgactggagggggttaaatagctcccagaggcgctcttgtgagcggagcttcctgaaatctctttatctgtggccacatgctgttcttggttgtccacgtggttccctggtgtccctgttgctgaaggcacttctgttttgttcttggaggcttggcttctcattgccattttctaaagcagtagagagtgccagttagattgttagacccaaataatctgaaatgtgtgaaaaaatagtaaatatttactgtaccttttgtggaacaggttattgccatggaaatgcactgtacacgaatctggatgatggagggaagctggctcaggagctatgggagtgtttggataccatgccgcctgaattggcaggtttaggagtgagtgccgtgggtttagaatcacagtgtggttgggtgaggctgaaacacttggtccccagtcaacctgtactgagaggggcatttattcattgcttcccacatgcagggtgcttcctagagcattctccatgcattattgcgtttaatcatcatgccaccccaatgaggtgccattatcctccctgttttacggagacacagagtgtttgatctacttgcttgaaggtacgcagtcaatgaatggcagagccccctgactctgttctctggagcttgatccttccctgctcagctgtttctctcactgtgatttaccctagagaaagctaaccagctgtctaccggggttttattttccaatattgacttcggggctgacatttagaaaccatcaacaatttccagcttctcttgaaaatgtgcacaatctggctactgtgtggggcttccctagtggctgctcccgagcagccatccaggttagccgggcatcagctctgcagttggcgctgggcatcctcctgttgcagctggggagaaagcatggggtatcacacccaggggctccttgaattaattgagaactgtctgttgagagctcctcatcctgttagacttgacatttaatttagctgttgttttcatttgccaattagagcttttgagattcttttgattttcttcctgtggtctcaaggaatttgtgggtggttgagtgaagatcttcatggcaggaaaggaaggctgcaacaggagatgtaatgcgtgagcacattcattcattcattcattcatttacttgtttattcatttgttcaacatattcattgagtattggatgttgaagttacaacagtggaagtatggcaataaataagacagacccagtcactgctctcaaggagcatatagtcaaagagggcagtcagacatcaactatgatgcacgttacagggaaggcatccatcttttttttttttctgtgtcacccaggctggaatgcagtgatgtgatctcagctcactgcaacctctgcctcccgggttcaagcgattctcctgcctcagccttccaagtagctgagattacaggcacccaccaccatgcccggctaatttttttttaaattttattattattatattttaagttttagggtacatgtgcacaatgtgcaggtttgttacatatgtatacatgtgccatgtagtagagacggggtttcatcatgttgaccaggctggtcttgaactcctgacctcaggtgatctgcccaccttggcctctcaaagtgctgggattacaggcatgagacaccacgcctgaccagggaaggcatcgatcttagactgacttagtggtgtctaggtctctgaaggaggtgtcagagaaggtctccttggctaatctttgtgaccaccggagctctgttagtttcataagacataagtctcagcaactgttgcagaaagacccttcctcagtaaggatgatgggctcctcgggctcttgcccttcccgtcctgggaggaaccttctatcaagagccatggctagtcatttcatccattgggaatgagcttactggctccatttatgagagttagtttagactgaggagtaaaggaggagtgaaggagtttgggagttgtcagtgataagcatgcacatttggagttgacaggacagcatggacactagagcctgaacaccttagttcagcttagctgcactgcctattatgtgatactgggctggtttcttaactgttctatgcctcagtttccccatctgaagttgggaataaaatactcatctcatagggttattgtgaagagtaaatgagtcaagctgggtgtagcggctcatgcctgtaatcccagcactttggaaggccgaagtgggtggatggcttgaggtcaggagtttgagaacagtctggacaacacgatgaaaccctgtctctactaaaactacagaacattagctgggattacacatatgcaggtgtgtaatcccatgaaacacatttcaaataattgctaaaatttttcaagctgtggcataagagacaacagtcctgaagaggactgaaaggtcttgggatgcaggggagcttaatgtattaaaaggtgacattttggatcagtagggaaaaaattacacacaggtgtgtgtgtaatcccagctacttgggaggttgaggcacgacaatcacttgaatctgggaggtggaggttgtagtgagccaagatggcaccactgcactccagcctgggcgagcgagactgtctcaaacacacacacatgcacacacacacacacacacacagccaggcaaaggatgaagagaagcagttaataaatgtgagccattcacgtgtgtattatgattatcacgtgatatcagccagtcctgcttgagactcacttttccgacagttctttcttcggtggactgtacccatgcccctgtgtgccatatatttgtgatttccagccttcctttctgataacttcaattcattgctcttcccaggcaagtccttcaatggttatggggtgccgcgcttgccctcatccccagctgagtgttctgcgtttggggacttgtgtttataagtgtgggaggctgtcccctgggggttactgcccagacagttagggttgtccataataacagaaaagtgcatggagagagaaggtgcaggtccgcctatttgatgttgggtaggatgtgctgcttgatgaccggtgaaacatttacttctcccaccatgggcgagaccttggatgtgtcctttacctctctctttgtcacttctgtcctgaactgcccatgagtgaccaggggcttccgacagaagtgtctcacaatccaaccacacagcagaaaggcattttcctttggatttgagctttgtccctgcactgactttttgtgtcatctcctcttcattcaatgtgagatactcaccttgattcatagaatgttttctcattccaggtttgtatttttttaatcaccaaaagaagcacttatcataaaagactgtgatgatgtataactgtgtatttagtttgaaaatcttcaccttatagaagcaataaacaatatttaggtgtattatcctgtgaaatttttataaatataagactttattacgaataaacaaaaaaagagatcatatcctatatactttttttataattttttttgagagagggccttgctgtgtcatctaggctgaagtgcagtggtgtgatctcagctcactgcaacctccacctccagggctcaatcctcccacctcagactctcaagtagctgggactacaggcacgcgccaccacgtccagctaatttttgtaatattttttttttgtagagatggggttttgccctgttgcccaggctagtaactttttcccttattaataccttatttagatccaccttatgttttaaatggctgcagagtgtttcataatatggccaccatattatttacattcatatttataatttgtctaaaacattagcaataggcatttggattatttccaagttttctctataatgaacagtgcaacagtgaacactcttgggcactgtagtggggatttccatagaacaattcttagaaatggggtgtttagggcaaaggatattaacatttttagttgtaatagatattgctaaattgctctcaaatgttgtgccaatttatgcacccaccaacagcgcacgaaagtgcctcttagaaaatgtcttttagaagataaaatacctattgttaagccatgaaacacatttcaaataattgctaaaatttttctagctgtggcataagagacaagagtcctgaggaggactgaaaggtcttgggatgcaggggagcttaatgtattaaaaggtgacattttggatcagtaggaaaaaaaatggcttatttaatacatggtgctggcataattgggaggccatgtggaaggatgctgagtttgattcctaactcatacaaaaataaattacaggtggagtaagctataggcagtaaaaaaaaaaaaaaaaaaaaaaaaaaagaatattagaggaagttttaggagcatacttctgtaaccttgagtgagggaaatccagaagccataaagaaaaagattagacagtttcaattatgtaaaaataatttaatcttttaaaaggagaatgtattcatgaattgcttatgtaataagaaagactattaaaaataggtccagtagataatgtacaatggtttccaatgtgaataaagttgaagttaataaagaaaagaaagttttaggacatgtcagggagtttttgttcaaggattgagattctgcaatgtttattctaaataaagatgaatgatagactagtgcacatgtagtaaactagtaaatgtgtagcccataaaccttgtaagccctggaagggtaaagaaaaagggaaggaaatgttgttttctgcctctttattttttgttgttttgagaaagttgagtacccacccaaagccccaggtgtcccaggagagagaagattgaaaacatgccatcaaaacaggagcttcagcctcagccacaagctccagtgtttactgggggccagtgcccttattcccacgtgaagcatctgccttttttgcccccttgaagtctgagtctctcgtctgttcctggagatttttagccaagcccctcctccccacccctcaccttagtatttgtaccaccctctgaatcaaccccaaagacacccctttgtactcttcccttcatctggccatcaccagggtactgtggtcattgaagctgagtgtgtgccctcactttccgtaaactcacagttcctttattctgcaccttcagggattgcaaatcgttaagggtatgccttcaaataccagccctctgacttcctagctcaataacctcacacagctctatatctcagtttcctcatctgaaaaacagtcatgaaatggcaccacctcctagcattaatgtgaagattgttattattatgtgttattaattattattatgttatcctattaatatatgagacagaatctcactctgttgcccaggctggagtgcagtggcacaatcttggctcactgcaacctctgcttcccaagttcaagggattctcctgcctcagcctcctgagtagctgggattacaggtgtgtgccaccacgcctggctaatttttgtatttttagtagagacagggtttcgccatgttggccagggtggtcttgaactcctgatctcaggtgatctgcccaccttggcctcccaaagtactgggattacaagtgtgagccactgcgcctggcctatcttattattattattattattactttttgagatgggatctcactctgtcacccaggtgggagtgcagcagtgcaatctcagctcactgcaatgtctgcctcctgggttcaagcgattcttctgcctcagcctcctgagtagctgggaccacaggcacccaccaccatgcccggctaatttttgcatttttagtagagatggggtgtcaccatattggccaggctgatctcgaactcctgacctcgtgatccacccacctcggcctcccaatgtgctgggattacaggtgtgagccactgcgcccagcctctttttattattatacttagcacggcacttggcacttaggaaatgttcagtatatgttagctattattggctactgttatttcttcttcttctcctcctcctcttcttctttctcctcttattcctcctcctcccccactcccttccaccccctcttcttattcctcctccttctcctcattattattttaagtacctccttaccaatgcctacagaaatagactgacctagtaccaggatctagaggagttcaatcaagttcgtctgttgccttcaaggtaacagcgtagtggtggttccgagccagatgccagacccagtctgcctttgttcaaatcctggttttacacttaatactgtaggtacctcgggcaagttacctaacatttcttcacctcaatttctccatttgtaaaatgtatataatgatagtacctaccacgcatggttgttaggaagattaaatcaattaatatttgtaaagtagagcagccggctcattgtaagtattgggagtattggttaaaataattacaaaataaacaatctcacttagatacatcccttaccccctgtggattatgtcaagggtgaaagaaacagtgtgcttgaaatcctgctgtgcgccgagctgtatatcagaggtgttatggtgattcgtcatcattctcctgaccactttccatttttcttttagagtcaacactggccaatctttagggaggagctctgatcattgagaaactgacactgtggaagggggcatttctgactctctcttcctagctccatttgatcttcctaaatctttcaataatgtgtcattggggtaggaccaaagaaaaacggggtgaatgtacggttgctgctttgtttcccatagtgggagtgactctgatgtttcacaaaggcaggggtggagaggcagcgcctcgcaggaaagccttcttgctaaatcgaggacttctgcacagaaatagatacaaacttgcttactgtttaaatagaatattagcgattatcttttatccagctggagtctcctcggtttggtactgcctcaaatgagcagcctgcaatcttgggtgtcacttcctcactggttctgctttccataactgtgttgaaatcactcccccagaaggtcaccaaaagggaaaatattagtgtgtgtttattggcacgatcttgcaggtgctgggctaagtgtagacatgatttattttcatttaatcttcaaggtagttctaggcgatgtccccccactttgcagatggggacactgatgtgcaggaaatgaagtgacatgctgtagcactgttggtgctctgctgtgtcccctcacccttccatttcattgcattctggcctggcttccaatgggcagcaactgcagctgttcacctgagggcttgctctgccgtagtccattcggtccataggcatgtcaggctgtggaagcacaggaggagaggtgagggatggtgcaggagagaggagaggatgattaatgtcccccagggcccatcctcaaccaatgacttatgggaaacaacctcctagagttgtattaagctccagtgacccagaatggtaacaagctcacaaacacttccttttttaaaaaatttcacaaaaatactttattatacccatacctccttgttttagcccatcccagtacggtggtatcttcagaacacttccactttcccctctcctcacctcttccctcccacccttgagatgtaatctttggaccacttttacttctttgctttctctcagcaccctttctcccctactctatggtgactttgtgtttttgaattgaagtcgtttcatgtctgtgtcttttttttttcttcaactgttattttaagttctagggtacatgtgcaggatgtgcagatttgttacataggtaaacacgtgccatggtggtttgctgcacagatcgacccatcacctaggtattaagcccagcatccattagctattcttcctgatgctctccctcttccctccccactctgacatggcccagtgtgtgtcattccccaccaccaaatgtccatgtgttctcattattcagcgcccacttataagtgagaacatgcagtaaaacactgcctttataggcttccttcccttcactgtcttacttccccactccctactgctgctctctgggatcacctctcacagaagctgtttgtactttaatcattgtctgagagtctggggtatcccaaactaagataattgcccaaggtcttagctaaattcaacagccctatttgtctttatcctccttgtggcaatgccactactaatggatgtcccttcttaaaattcttccccattttggcttttgtgacacgtaatagaattcttctacttctgattatttctttcctttttcattaattggcagctctttctttttaaaaaaatttgctagatttttgcttatttttttttttaagaaatgaggtctcattatgttgcgcagactggccttggaatcctaggctcaagcgatcctcccatctcgtcctccgaagtgctgggattacaggcgtgagccactgtgcccatctttcttttcctttctttagccacccagttttaggtacctccagtatcccagtattttagttgtaagtgacagaaaatctgactcaaattggtttatgtataacaaaatgtaagttattggatcacatacttgggaatcttaggataggtggcttcagggaagatatgatcaaggtgttcagcaatctgattctctctccatcatgattcagctttcctctgtattgcttgattctcaggcatgtgcttgactaatgaggcaacaacaacttgcaggtccaatcttatcttcatcaatggtatcttaactacatcagtggtataggactgcttctttccttagagtcccactgtaagttttgggtttcattctcattggcctgtgttgagtgatgtatacatttctaaaccaatcacagttgccacggagatgtaatacaggttgagcatctcttatccaaaatgcttgggaccagaagcatttctgagtgtggattttttttttcttcagattttgaactatttgcattttacttgccagttgagcatcccaaatccaaaaagttaaaatccaaaatgctccaatgagcctttccttggagcatcatgtcagtgctcaaaaggttttgggttttggagcatttcacattttgggttcctggatttggggtgccctcatttcccaggctgggtcacataatcacccttggagctaaggttagagttgagccctactccataaggactgagagtggggagaggtgatttcgcaaaggaaagtcaaagtgctgtcacatgaggggatgggtactggagaggcaaaaacaacagatgttcatactccgcatctctgggttcatttatctgctcttctctttctctgtgaatcatctgatgatttccactcctgcctgcctgagtaggactctgaaactcctgcctccagatctgactccacttctgagttgtagcctcctttcccccaccctctagagttaggcatttccatttggtggtgccatgcagacctgaaactcagtgtgccacaaccctcgccacctcccacctggtttcgctccctaacgtccctgtctttgtcagtggtgccagttgggtttccatctctccctcatccgtcccaacccccacctaatttccagccccattgtgctgcttttgattccttgaatgcacctttgcaatgcttttccttggtttgtaaccctctttagcatattcttggtttggtgaacccctggccatatttagatatcagctcagaattcacttatttgggaacctctaacctggtcacccatctctgccaagcctgagttagatgctctttccctgagttctactaggccttcatctcgtctaccacagcacttctcactcagactccaatgactggctccattgcctgccttccccgtaagggcaggggcacatctgtgtaattcaccattgtatcttcagcagtccagcctgacaattgagtctaggctggtgtccaacaaaccagtctttgttttttttttcttttattttaattttgatagttttgggggagcaagtggtttttttggttacatggataagttctttcatggtgatttctgagattttggtgcacccatcactgtaacagtatatgtggtatccaatatgtagtcttttattcttcaccccctcccaccattccccggagtcctcaaagtccattatatcactcttatgcttttgcatcctcatagcttagcttcatttacaagtgagaatatatggtatttggttttccagtcctgagttacttcccttagaacaatggcctccaacttcatccaaggtgctgcaaaggccattatttcgttccgttttatggctgagtagtattccatcatgtatgtgtaccacattttctttatccactagagataaaccaggttttgaattcaggatccacctctcctgagctgtgagcacatgggcaagtttcctcaccagtccaagcctgttttctcatctctaaaatggagacaatgacggttcctccctcactgagcacttgtgagaagtaagtggtgatcacggttacaaagtgttcagcacagtgcctggaacacggtaagcgttcaatcagtgccaatgatcatttattatactcactatgaacattatttttacctcatgcagtgtctagaacataatcaactctcaacaaatgacagctcttattattagccaagaatggaacctgaaacatagtacgctccatggatcattgaagctttgtttttgaaagtttgaaattaacaaaaagagcctttgatgtttcccttgctgcacattcttcccctccaggtggagtgggcagtttccactgggtgctggaaccaaccctcctgtagttggaggtgatcttctctgatgtcactagggtgccgaggtgatgtgtcaccagcacttgtttgcttgtgtgatgtaatgagggtggacttgcttctcctagggaagagcctcattaaggttagcaaggggcttgttcctgggaagttctaaggaccgcctggggctgccacataaggaactccccttttctcattttgtctccggtaagttgttattgatctgtacatgatgtttctctttcttaccagccgtgggaatgggccatcctctggcatcactgttgccttgaacgttaccatcaccaccgttgccatgaagtcatgacagcagcaccattggctctggtttattgggtgtctaccatggacagtagtagggctagacatttagtatactccagggctactgcggggattaaatgaggtatgaagcatctataaccccacggtccaatagggtagccactagccatgtgtgcctactgagatatacattttaattaaagttaaataaagaaaaaattcaatttatcatgcacagtagccacatttcaagtgctcagtatgtgctcatggctgatgtagctggcagtgaagatggggaacattgtcatcatcacagaaaattcttccacagcgctgatctagatagaacaggattcagtccgctgtggcttgtggatccatggactgaattcatacacacagaattttgtgggaacacagctgtgcctgtttgtttatgccttatctatggctgcctttgcgctacaaggatggaattgagtagttgtgacagagaccatgtggcctgcaaaacctaaaatactcagtctcttatccttgaagaaaaagtttgtcagcctctggtctagaacattgcctggctcttggtaaggttaaatacatgtttggaactttttatttattgaaaataatatacattttgttctccacctaaccttttaaggtaagtattgttatccctgtcctagagatgagaaaactgggactggaattctgtactgtcacttccagggggcaaacacctcatgaggttttttttttttttttggcagtcttgctctgtctcccaggctggactgcagtgtcgcgatctcagctcactgcagcctctgcctcctggggttcaagtgattctcctgcttcagcctccccagtagctgggattataggtacctgccccctctccccgctaattcttgtatttttagtagagatagggtttcatcatgttggccaggctggtcttgaattcctgacctcaagtgatccacccgccttggcctcccaaagtgctgggattacaggtgtgagctaccatgcctggtctcatgagtcttgttcatcacttacctccttttgttcttccagcttcagtttcaggttcagggggtacatgtacaggtttgttacatgggtaaattgcatgtccctggagtttggtgtactaatgatttcatcacccaggtagtgagcatagtacctgatagtagtttttgatcctcaccttccaccctcaaggaggtctcagtgtctgttgttcccttctttgtgtcatgagtgcctgatgtttagctcccacttataagtgagaatatgcagcatttggttttctgttcctgtattaactcacttaggatagtggcctccagctgcgtccatgttgcagcaaagagcatggtttcattcttttttatgcctgcatagtattccatggtgtttatataccacattttctttatcccatgcaccgtggatgggcacctccgttgatttcttgtctttgctattgcatcacttactcttgaatctggagcagtgcctagcacataatagacattcaggacatgtttgttgagcaatgaatggatgagttaggaatcaattacatataaatcaataatcaataatcatcaatgatgaatttctatgaacaaatatgaaaattagatcggccgcattgtagagatgaggagacagccctgtagaaggaaagtgcctcatcaaaatgcaacatcgctgtgaaagtgtagacttggagctccagctgaagtcatctgtgtattttctaagctgtcccctctaccatcctgccttctccgggagctgccaaagtgcagcgctgatgcctcctctctctgtcccacagcctgacttttgttcagctcctgcttctcttcttcaccaactgccagcttcagctgctttgtggcaccctggggcttgaagcttcatttctggtgctgtggcaccacaaagctctgccccagtgtcacttgagtccaagtagatcagccaagtttgaatgatctctctcttggccacttcagtctatgaagctggagttgagaccatctgtgattttacacattcgttacagcaaaaccaagagggccatggggtaagagggccattaagctagaggctgagcaaaactctgctcttgaagcaccttctgagatggcttctcatggaacgtctgcgcaaagtggcttcacatccaattaagtcaaagatgcattaaatgaatccagtttgtaactgcttccaaccatgaagtcacagttccatctcttgccctgggaggggcttctttcaggctctgaggactggagccctggagactttattgccttacggtttcctcctctaccatcagatgtttctttttcatgtgttctggcctggatttgaatagactgcctggatttgaatgctgccttcacctctttctggtgtgtaatcttggacaagttaccttctttctcagtgcctcagtttcctcttcagtacaataaggataataataagacctaccacatagctgtagagaggattaaaggagccaatatgtggaaagtatttacaacagtgtactgcatagtagcttttctataagtgattattattattatcccttcgaatctaaaatccctctagtttgtttcagaggagcaaggattgtgtctcgcctgcctttaaatccctttaagttgggtgtctcaagcccaaccatctgcaggagactagaaggggacttacatgagtgaattgaatcaggtgtggatttctgtgaactagagaatgcaaggctgtctgaaaggggaactattccttattcatgcatcacatatacactggtgtgccaagccctgttctgcatctggggacacagcagagaatgaaccgggcaaaattccctgcccccttggagttgatgttgtagtggactaagctctgatgactctgttgctgcatgagaatgtgggcccactgctgacaaaacttctgatttttctgtaagaaaagccggaaacctggatttgtaaaaaccgtgaactctcctagcttaagaattggcagtggtttccatttttttttttttttaaagcacagtacatgctgtgaacccaagagccagtttgcagcccctgccttaagacactcctctaattgctctgggaggaggcctgtctctgccctgcaaatcagcagctggtcggatttcaaggtcgttggtgtggagggcgcctcctccctctcctgcgtggaggttattgtggctttttctgcccacagagcagatgacgctgccaccaggcagtgagttagaatattccttctcttatccttccttttggatggtggccttggctgggttcccagccccctgacagcagaagacaaaaggatggaagcagcttcctcatagtcacccatgggggcgatagggtggtgatggtgatgtggagaaaatgcattgggtcaggacagccacctttgaagccagaaaattaatgatctctgttgcctgaatcttttcaaagtggagaagtaatttaaaagcttgtgtgggaaggattgagaatgggattgagaaaagaagtttaggttgctatcaggaacaattcctaacagcaggaggtttttggagaggcagtggtgaaattccttggaaatttttgtgtggtgtctttttttcttttttctttctttctttcctcttttttgtttttgtttttctttttttgagatagagtctcattctgtcacataggctggagtgcaatggcacaaccccggcccactgcaacctccacctcccaggttcaagagattctcctgcctcagcctcccgagtagctgggactacaggcacccgccaccatgcccagctaatttttgtatgtttagtagagacagggttttgccttgttggccaggttggccttgaactcctgacctcaagtgaggtccacctgccgtggccttccaaagtgtttggattataggcgtgagccactgcgccgggccttttatggtgtctttgaagtgcttgtttaaatttacatgtggttgcctctcagtggggtgcatgctctctggttttccccaagccccaccactccctgttgtgctttacccacttgcctgacttagttatgcttactggcctggcctttgtgggtctttgagtttgtgccttctgctctgaaggaagcatgcttgagatgatggaatctaggttcaaacctacctgccctatctgccctttactgacttgtgtgactgtggacaagttcctccacccctgaggttgtcaggaccctgcaggaaatagaaccattcaggtggctgcaagaagaaagtttcatgaaaggactatttagggagacttgggcaaggttaagattacaaataaggaatgtggaagcacctagggccttgcaacagcaggaggcggttaccgtctgtaaagaggaagaagcaagcggagggaatagtttggagcctattgagagctggggctaagaaggaaggcatcgccagcaggaaccatggtcctggagggatgaaccgcttcccaaatagcagtaccgaggcagggaggaagagggggaagaaacaccccagcttctcttcacctctcccattgcctgttggcctcacccactggctgaacccagctggaaaccagaaggaccagatgatgaattctgtaagggtcagccttttggggctcagctcacagcagaatcagagagaaaaaaatggatctgagaggtgaaacaaggaacaagcagcacgtaactctcagcttccctaccttgaaagtggaggagaatgagataactgaccttggaaggttattgggtggctcatgtactctcgaagggaagggcctggtcaatattaagtactcataaatgctgagattcagtgtgggtttcaaaccgtttctaggagctaaaggtcctgagaaagggcttcagtttcagtatcaagagacattctcaggtgggcagatctcttgaagccaggagttcgagaccagcctgcccatcatggtgagaccccatctctactaaaaatacaaaaattagctggatgtggtggtgggtgcctgtaatccaagctactcaggaggctgaggcaagtgaattgcttgaacctgggaggcggaggttgcagtgagctgagatcgcgccactgcactccagcctgggcgacagggtgagaccctgtctcaaaaaccaaaaccaaaaagacattctcctccttcccctgcagtggggcccactgggaatggttgcatcttccatggggagtttaaagtgaatgtgtagtggctaagagcaaagaccctagaaccaagtaggtggacactgtggtagtccatcagtgtggtagacactgatctttctgttactatagattaatggccttgtacagtatgcactattttgtgtctgccttctttcacttaaaataatgtttttgagactcacgcatgcatgtgcctgtattggagtctattgagagctggtttccagtcctgattgccactgacagtcaagttacttaacttttcatgccttattttctcatctgtaaaatgaggatgttagtagtttctacctcattgggttctgaggattaaaatgagttaatctacgtaaagagcttaacacagtgtctaacacatagtagacaatcaatagatgttagctattgtaattgccatcatcgtcatcatcatcatcattatcatcatcatcgtcaccatctccatggatcagctcaaatcaaaactgacccattgtcaatagaaaaattctctgtgggatgaagtccatgccaccaggcctctcgggaacttcattgatcataccattatcttctcatcctcccacagatatgatatttcagggagtgattgataggtgtgtgtgtgtgtacgtggggaagggtgggcttgtgcctgactccagggacagagtgctttgttatgcagaatagcttgcctgtcatcccactacaggccccttccttgaaaagttccaggctatttttgagccctcatggctcacatgttcctttctacatcatgtcaatgccagtacagaaaaattgaaaccttttggcagcatctaaagcaaaagagatttcaaagtgcatggaggatgagtgttgctcaaatgacagggtattaaaacgtgacaagaaggctgagttaagagactgcaggcagcttgtgtgtttgtatttggaccttgctggatttcttgggaaatcagtggagttgtccaaggttaatgtcatctccaagaaggcaccaaagggtagtaacactccttcaccctcatttgtacatacactctgcaagagcggaagatgatgcagccagtggagtgggcggttgtcccagagcaccacctgggctctgagctacaggattctgcaggggaaagcacctgaggacagagtgaggtgggttggtgccacctgggagctccaggcttttgtgtgctgatgtgcaggcagatactggagccagaccgaattgtgtgcgaaatgtgggtctaagagtgaaggcaccaaaccctcactttttttactttcattcagccttcccatttttcttcaaagggcagaatatgactttggagtcaggtagacctgaattcaaatccctcttcttcttcagtgagtagctaaatctttccaatgctttatttaaaaggaatcacgatcacactttcagggttgttgagaggtttagagattgtggtgttacagggcccctggggctcaaaaggtgtttgctgaacccctgtcttgtgttaaatagtcacaatagtcccaaggggaggatgaacaggtagcactgccatttcataaacaggtgactgaggtgcagagtggcttatccataatgacacaggaggtgaatgctggagctggattgaaggctgagtcattggactctcctctgagggaggcagtacagagtagtggtcagggcttgaccaacctctagagtccatgggcagattttctgggcctctggcttagttttcctcatgcataaatggaatgtggggattatagtagatgtactttctatggttgtgaaggttacatatacatgagataattctataaattcttagcatgtgcttgagttacagtaaatatgcaatgaagtattcactactgttttagtattatttttattagaagccgtggcagtagttaccatcattgtcaccatctccatcgatcagctctaatcaaaactgacccattgtcaacagaaaaattccctgtggatgaagtacatgttgtaggtgtagcgggcaatcgtgatcgccatcagaaattcatattggggtttggtttacaagtgttggcctctgggagtgtttcctacgtgctccttctctcctcccctttgaggacggatggtgtgatggttcctctccatttggtccctcctctgggaccagcattctcctgccttctttgtcctactctgtgtcccaggaggtagacccctgtggactgtatctcctggactcccttgctggttgacttttgtctgagttaagccaaagggaggtggcagcaagagacgagaaggtgggaggagagagagtttggggtatttccacctgcagctccctctgtccatctctggccccgctctgtgatgctagcccccgcgaggttgcccatctctcagggtttcctctcttacttgcccctgttacgtcatttcatgggactatacctttagctttaggtgcagaacagttttccacagttaaatgtctttaattgaacatctagaatgcaaaacatattataagataatgtgttggattgttttcctttaaaaaatggtacaaccactttgcaaaacaatggcagtttcttattaagttaaacatagagttacagtatgatacagcaattccactcctaggtatttatccaagaggaattaaattgtatgcccacacaaaaaatgaatgaataaattaagacttataaatgaatgttcatagcagctttattcataataaccagatactgttaaaaaaaccccagaatattgatcagtagatgaatggataagcaaactttagaataatcatataatggaatattattcagcagtaaagatgaactaactgctaatacagacacgtgcatgcgcgagtctcaaaaacattattttaagtgaaagaaggcagacacaaaatagtgcatactgtacgaggccattaatctatatagtaacagaaagtggatcagtgtctaccacaggctgggggtgtgtacagggaaactttttaggtggtgcccatgctctgtatctcaattttggtggtacatgcgtataatacatttgtattgtcttgtatcaaagtatgcctcatgaagttcaggtatatgaaaatttgtatttgctttattatatttaaatatcagagaatgcaaaattgtaaaaagaaaaagaaatcctgaaagtccttttaactagagacaaccaccaccatccacattttatctatttcctttcagtttttaattttttcctgtacttaggttttccccttcactgtcttatttaaataaaaaagaaagcaaatggaaagtctcccatacgaaggcctttttgctatgagtttaccttgtctaagggcatctagcatgatggtgagaaggttttgtcttgtataactaaaatgtattgggaggaaatgaaaatgtttagcctggtgaaggggaaacattggggagaaaagtgagggagagtgtggtctacagtcgtgagctttaaatcacaaccaatcagccaattaaatactgagctcctgttatgtgtcagtattaggaagacagtagtgaacaaaacatatggctcctctgatttaatggagttaacagtctgggagggaaagatatttttattatttgcaacaacaatagtaatagctaatatttatgatgagctagtgcctattatggtgttaaggtttagttttttcttttagtgtttttaatgtgttgtcacatttaatcccagcaactccatgagtaggtactcttaattctcatttcatggttgaaaataataaagtggcttggagatgttaagtcaaatggggtcatacagtgagcatgttaaacctagactggcaggtcaggacggaagtgatatttaatcctcagtgaaatgatttttttctttttaatttttatttttattgagacagaatctcactctgttgcccaggctggagtgcagtggcacaatcttggctcactgcaaccttcacctcccgggttcaagcaattctcctgcatcagcctcccaagtagctgggattacaagcacccgccaccacgcccggctaatttttgtatttttagtagagatggggatttcaccatgttagccaggctggtttctaactcctgacctcaggtgattcacctgcctcggcctctcaaagtgctgggattacaggcgtgagccaccgggcccggcctctttcagtgtttttaatgtgttgtcacatttaatcccagcaactctatgagtaggtactctttttattcctactttatggttgaaaataacaaagtgacttggagacattaagtcaaatgggaacatacagtgagcatgttaaacctagattggcacgtcaggacagaagtgatatttaatccccaagaaaataatatattttttttctttttttgagacagggtctcactctgttgcccaggctggagtgcattggcatgatcacggctcactgcagcctcgacctcctgggctcaagtgatcctcccaccccagctacctgggtacaggcatgcaccaccttgccccgctactgttttgtgtttttgcagagatagggttttgctgtgttgcccaggctggtctcaaacacctgggctcaagcaattcacctttcttggcctcccaaagtgctgggattacaggcgtaaggcactctgaccagctggaaatgatatttaatctgatatctgaaggatgataggagttaaacaagaatcaagtgtcagagaccagagatatgaggtctcatatatatatatttgctcagggcagggggctggttttgggtgataattaggggctagactgaacagaattagtgtttggaagtgagtggtggtggtggtgagggaggagagaagggtgagtcccagggtaagggatgcaggcacatcctgagaaatgaggcagaagaatgagaacttggcttggggcatgttctgttcatctgaatggtggtgctgaggagacaggtggacagagaggtgtggggttcagggaggagcacaggactgagagggaccagcaggaatagaattcctgaagtcccttggattgacaagatgcttcagtgagagagagtccacagggtagagatcagcacctaggacagagcctcgagaacttcctctaggatagggaagggctggagaacaggaggaggagccaaggagaggaggaaggggccaagagggcaggatcaggactgaggcaggccgacttctgcgcagttgaagaactctaatgtcagagctgtccttaggaggcagagaacccctcgtcctggaagagtgcagggagctgcttggtgaccatcctttggggatgtcatggaaaagatatttgcatcaatctggggtgagattaggtgtctggattggttcaggttcttttgtcatttgtaagcacacaaaagaactctagttatctaaaggaaaaaaaaaactggaaatattatgggttggcacacgagtggtgccaggcctcagagagtacagggcccagggtggctctggggatctgggtggcaggagcgaatggatgaccttcacagggtgacaccatcgggaggaatcagctccagctgttttctgtccttgtcccaagaatcaaatcccagggagaacagtgtgattccccaatgttgtgaggttcagtcatgtgcaaggggaaagccgggcacctcgattgacagccccaccaggactgcataccgtggagaaaggatggcttcccaaagaaaaacaacattccagctaccagagaaaagggagtggacgctgggcaggcaaagccaacagacactttttgtagtctccatggtcctgtgtatgattcagtgatttttgcagtattcacttagcaagtcattcctcgttgcagaattgttgctagtgtttttcctggctggggattaagctttttccatttgcctattttagagtgagttgggggcctgggattgacacgcatttgtctctgggcttcaaggtagcccagagattatgccacctcaggaggcacaatttggtggctgtcactccttgtcatgtcaacaaagggtgtggcttgtggctctgtggcctctgctttaccagcaaggggaggatgctggtagtagcaaagggtctaaatcgctgttgcatcagcgaggtggatgtgcctatcctaaaggcacctactgagaagatgcccaagtaacagacactcatgggcacagtagacctgtcaaacctcatagttcctggctgactctctttgggtgacctgagtcacacgcccacgcctgaacacccactgaaactcctaggtgcattacgtcttctgcaatatctaaaggaattaagggaaggatgaaactctgtatctcaactttcctgaattcaccagtatggactgatggaattgagtgctagtaacaccaagctcctaaataataataataaaggcttacttataggaacgtacgaagcacaagagaaataagggcccccacggcccacccttcaacttctcacatttggtttgttagtcaggactcctttggtcacaagagacaaaaaaaacaattcaagttggtttaggaaaagaggcatttattggcttgtacagaggagttgagagttctttaggtctggctggatttaggtgctccagcatggtcatggggcatctcttggctcagcttttctctgtgttggcttcattctcaaaaaaacttttccttggtgatggtaaagatggcagatgcagcactttgggagcctgaggcaagaagaccacttgaggccaggagttcgaaaccagcctggtcaacctagtgagaccccatctctacaaaagaaaaaaaaattcaggtgtaatggtgtgcacctgtagtagctactagggatgttaagtgggagttgcatgaatccaggtgctcaaggttgcagtgagccataatcgcaccattgcactccaccttgggtgacagagtgagattctgtctcaaaaaaacccacaaaaaccgcccccccaaaaacggatggcagatgcaaatttattccctaccagtttaacaactctgctggaaaataaaccctctttcctaataattccagcaaaagtcctgaagctgattctctttgggtgtcctgagtcacacgcccatgcctgaatccccactgtggcccaggtcccatgtccacccttagagccagaggatgagggcagccttagctggcccacacaatcagtgagccagtgaagagcgattcctcacaggagaagcatggaggatgggtgctgtcaggcagaaacaagacatgccaccacacttggttttggggttaggcctgcttctggtctgagcaatctgctgctggatatggctggtgagtgaagagatattgatgtgtcatccccttagaccatggcattgtgtcctgctctctgcatctttgggggcctgatcaaaagcgggaagtcatggggtcaaggacagtctccacgtgccacccaaacaggaaggatgtccccagcaggtgttctgctcagggtctggctctcccagggttgttactgcagagggaagggtaggggcagctttcttctggtggatttatttacttctcaggcctgttcttttcctcatgttggctcaactgttttatcttgcttagttaaataaatttggtaacattataaaggaaaacagtcttttccggcagttgctgaccactgcaaaattactgctctttcttttgtttttcctttttagtgctgggctgtgaataagcaaatgaagtttgctatctcttcctcccctcttccaggaagaaataatcaccatcagaactttaagagtttcccataagactgggcaaattagaggaaggacctctatacggtggaacagatgcaattgtgcaaacagaatggggttattctctacatatggagatggaacagaccctcccagatgtgttagtgtggggaaaagcaggtggtggaggtgcgttcagagtagcagtgttcagctctcccaagcacattcaaatcacccaggagcttttaaaacgtactgatgcctgcccaccaccctctcctcacagccccattaaatcagaatctctgggagtgggacttgagcacttttcattttaaaagctccctggtgactcctggggagccaggactgagaactagtgctgtagaattgtatatgggcaaaacagcagggatctagataaaaaaagaaaactgaagtagggaatatctcagtccgtacctacagatagcctcacacatgtggtcgcgcatacagagaacgtctctagaaggatacacaggagactggaaagaacggttctctccagtgatgaagtacagtggtgattctcaactgtatactcgtttgtaatgttggaattttgaagccacaagcataaatgctcactgtgtactgaaagctggccagacagggctgtaagatgacccctgaactctagcttgtctgtgttggggccggctgcccacagattcacacaaaccatctccctgcccgtggtctctgcttgccctcctctactcagctgcaatgagtggtttccgagtgtgggagagaccagaagagctcattcattcattcattcgctcacatttttagtaagaattaggtataagccaggcacgtggtaggcacgtgaatctgatctcaccttcacaaccgtatgtgaaattggtggtcttatctccattctaagattggggatattttaacacagaaattcatacaaccaagctgtaaatatttgaggccgaatgaccagctaagagagcttataaactggcagcacttagatgtgtttggatggcctgtacagaactttttaaaaaaatcctatttcacgactctggaccagtgaacccagggccactgttggctagagctgagtgtcccttggaagggcatatgcccctcagttcagcgcagtccccccatatcccttcccttctgtgtcacaccagccttgcatcactcagtcacaggcctagcctctgcaggcatttgcgtttgtcacccctgtgttaaggtaggtaggatgagtgaactgtcgtctgtcctgcagggatgctgagctgaagtgtcctgtggaatgtgccatttctattccaatctggccctctgtctgctggctggaaaaccaagctcctttgctttaagtttcatttgtggactgcatgggatgggctgtgggtattgatttgtttgtggaaaagatgtgcacaatagggaatgtgtaaaatacatcatggaaatggatggttaatgccgcctggctggagtgtggggcagtggagtgacaagagatgagagtcaagttagatggtggggtatactgtgggtagatgccgggctaagcattttgaactttaacctttaggctactgctgtccaataagactttctatggtgctggaaatttcttatatctgtactatccaatgttgtctccagacgcatgtggcatcaagcacttgaaaagtagctggcatgaatgaagatttttattggcattttagattttatttaattaatttacttttacatagctccatgtggctggtagctaccacactgggcgctgcagatttaggcaatagcagtggatgtgttggagcagggaaataatatcaaagctgaatcttcagaaggtgatttttccaggagtgtacaggccgcatggggtgagcagaagtaggtagggataatattgacacttcttagcatctattaggcacttcttgtgtccacacactgtgctaagataactcacttattcctcataacaactctatgaggaaagtactatcattgtccctattttatagactagaaaatgagacacagcaaagacaatgggcatattcaaggtcacacagctaatcaacagtggcacacggtgtagaatccaggcagctcagctgtagagcttgtaccatgaatccttccatcctggaaggaaataaatgaaccttcattgagaatataccttctgctgtcccctggtgctgggcattcacacgtaaaatctcatttagatttttgttaacactcatgtgccattcggtggatttagatcctttgtgtttatggaaacttgggctcatagggatgagatatcaaggcaactgcaatctctgtggacaccagttaaggctttattgtaaaattccatgcctgtgggggaaatcacaggctgtgggagtcggggggaatgtacaggaagatatggcataaaaggtgttgcgaaggaagaatcagtgggatttagcaactgactgaatggcgggggtgaggaaagcgggggaggctttctcctggaacagtgagatgaatgacaaacacacatgtaactgcactgtgtgagttgagagtgtgggctctagaggaagacaaactggtttcaaatacaagtgttaacacggactagctgaacaaccttgggcaaattacttctctccgagcatcagtgtccctgttaatataacgaggaccgaaggcaggaggatcacttgaggtcaggagtttgagaccagcctgggcaacatagtgagatcccgtctctagaaaaaacttaaaaaattagccaggcatggtgatgcatgcctgtagtcccatctactcaggaggctgaggccagaggatcacttgagcccaggagtttgcggctacagtgagctgtgattgcaccattgcactccagcctgggtgacagagcaagactttgtctctataaaagatataatgagaatcatagcaccttcctcacaggactgtgatgaggctcaggttaagcacggatatgaaagccctttgcaaactcaatagcatgaccctgtgagtcactcttcttagtgctggtgagaccagccattgggcagaaatggtgaccagaactttctgtctttgatcatggaaacagttcgggaaattgcctgggggaaccccacttcatcttaggtacttggtagagtttaatgcggataagtctgtgggtcagctttgacctaggaggaaagagtggttctcccagcagctgtagagcaaaatctgcatgccagtggctccaacttaaatgcccttttccaccaaacagtttgcatgtgttgtcttatttgagctgcacaacaaccttatatacataggtactgtgataaaataaggctcagagaggtggagacactgagctaatgtccttcagcttataggtagtaaaatgagtgttcaaacgaaggtcctcctgcttccagaaacttagcctgtaattcctgtaggtgatgggcttctcatttcttctcctaccacagatatctgcaactagcgctagaatttctatcccagattgacatggatttaagggtaaaggttgcttcctaagaatgtcagttttccactatagaccccagtaagaattgtgtacaagaggggaatcgactccaaacagaatatatatatatatatgatttaatttagtcctctttggaatgcaatgagtaaattttagtggttagagtaaaccactaaaatttgggagttaggggtgaagtgcagtgtgaagcagagttgagatctcagtgcttttcctggggcagaaacatccgagagggcccctgtcacccaagcttttggctacagtctactccttccatctgggattaaccaggcgtttcttatccttgctgatctagtgtttcttattgctgctgtaacaaattaccacaaatttcctggcctaaaatggcacacatttattatcttatacttctagatgtcaacattctgaacagcaggtcttccggggctgaaatcgaggtgtcagcagggctgccttccttctggaggctctaggggacaatctgtttcttaccttttctagaggccacccacattccttggcttgcgttcccttccagaaatggcacaattccaacctctgcttccatcatcacgtctcatcctctgactccgagtctcttccctccctcctataaggacccctgtgatcacactgggctcatccagataatctagtataaccccctttctcaagatccttaatttaatcacatctgcaaaatcaattttgtcatgtaagtaatatattcacaggtcccaggattaggacacggatatctggtggtggtgtcagggggtcgggggtaggggatgggaacattattctgcctacagagctggcaggtggcctttcttctttcctttcttttcctttcctttccttcccttcccttccctttcctttccctttcccttcccttttttccctttcttttctccttcccttccttttttccctttctcttccccttccccttcccttccccttcccttccccttccctttcccttccccttcccttccccttcccttccccttcccttccctttcccttccccttcccttccccttcccttccccttcccttccccttcccttccccttcccttccccttccccttcccttcccttcccttccccttccccttcccctccccttccccttcccttccccttcccctccccttccccttcccttccccttccccttcccttcccttccccttcccttccctttcccttccccttcactttcccttccccttcccttccctttcccttccttttcccttccacttcccctttcccttccacttccctttcccttcaccttccccttccctttcccttccccttctctttcccttccctttcccttccctttccttttcccttcccttccctttcccttccccttcccttccctttcccttccctttcccttccccttccctttcccttccctttccctttcccttcctcttcccttccccttcccttccccttcccttcgccttcccttccccttcccttccccttcccttccccttcccttcccttccctttcccttctccttcccttccccttcccttccctttcccttccctttcccttccccttccctttccctttcccttccctttcccttccccttccctttcccttgcctttcccttccccttcgcttctgcttcccttccccttctcttctcttttcttttttttctggagtcagggtctcattctgttgcccaggctggagtgcagtggtgctaacacagctcactacagccttgatttcccagcctcccgggttcaaccaattccccccacctcagcttcccaagtagctgggaccacaggtgcccaccaccaagcctggctaattttaaaaattttttagagatggagtcttgccatgttgcccaggatggtcttgaactcctgggctcaagcaatcctcctgcctcgacctcccaaagtgctaggattataggtgtgagccactgcactcagctgcaggtggcctttctgatcttgcctgtaataagggagggtgggaggtggatagagccggagacatctttttcattctctgctggagctgagtagcaatttccccttttaaacaggccatgtgtgcagtcccctacctggccgtcagacattttcattgctcacctggcccctaggcatttgagtttcagaccccattttgtagttctagtaaagccttgctatagactggggtcagagggctgcaggctttcaacctttgtagagcaaggggttattgaataaattatgaagcatctggagattctgggctcttaactgggtacctgtttgaaagtagggtctagtacatttttttcagtagctcagtaaatgttgcctcttcttaaaaaaaaaaaaaacagaaaacaaaaactggtcttactctgaatttgccaaatagaaatgagggggcgtttatttgtgtcacaaaaggatttgatttctttaaataggcagccctactattttcttcaaagtgttttagttaatgggaaatttgatttgcacaacttttcagaaacacactgtgtaaaggaattacctgcaccagaagctcatgaggtttttcaaagtctgttctcagcttctctgcacatcatgctggggttcacttggcctattgattctgcctcagtggggatggactattcatttctgtgggtaattggaagcctacctaaagtgaccttgtcaatggttggattgacaaatatccaggctggtgggatgtcaggcgatcatccaggagctacatctaccatgaagttggttatgttttctcctttttctatgactgatgatattcattttttggttcattcattcaccaaacatttatttactgaatatcaattatgtaccaggaattgtggtagacactaggagactagagatgagctatctttatccccttctgtctccaaaggggataaagatgaataagataataattgatttttttttttgagacagagtctcgctctgtctcttaggctggagtgcagtggcgtgatctcggctcactgcagcctctgcctccctggttccagtgattctcctgcctcagtctcctgggtagctgggattaccggggcctgccaccacactttgctaatttttgtattttttgtagagaataactgatattttagatgtttggaagaaaggttgtagaataaagcacctacttgaaaatgggggaaactactttcctaaatatttctgggtcaaagaataaattaaaaccatactaatagaccacttagaaacttgatacaatgatgggactaaatataaaacataggatgcagccaaaactgtacttaaaagagggtttttagccataacatctttaaatgtttaatgaagaggaatgggaataaattaattgagcagtcaattcaagaagctttaaaaagaacagtggataatattagctgacatttgtagaatagtcatgatatggttggcatggttctgggcatggaataactcatttagttctgacaacaccactgtgatatgggtcctattgttgctgtcattttccagagaggaaactgaagtacaggaagatgaggtagtgtacctagtcttagagtttgcaaatgatagacacaggatatacacctgatcatcagactccagaattcacattcccaaccaataagtaatacaaatacaagtaagcaatacaatcacagacacacagaacaaaaaaagttaaagtagcaattaataaagtaggctaaaaccaggtagagttgataaatataatcataatctgcttctttaacatgatagaaagataaaaatagacaagaaagaacacaaacttctggaaaaaaaataacgagagactacctaacaatgcaatatgaagaaagaaacaaagaaagagaaaaggtgtaatatcatcccagataagatgctacaatttaaacacgttgagaagaacactgtggataatttccaaggaaaatataaattccaaaagtttgtttgagtagaggtgaaaaactttcctgtgtggttgaagtgtagagagggagagggaggtgaagctggggaaagctcagggatggggcgagactatgctgtcatccctttactttcatgttgaataaaagggaaagttaaacatggaactacgacagggggaaaagagagaataataaaaatattatttggggtaatacggttttctatctggaaaactcaaaggaagcaactaaaactccacaaaagctatttgagtttttttaaaaaatgctttaaaataaatatgctaacaatctattgctttcctattgtttttgtttgtttgtttgttttgtgttttgagatggagtctcgctctgttgcccaggctggagtgcagtggcatgatattggctcacttcaacctccgcctcctgggttcaagcaatctactgcctcagccttccaagtacctgggactactacaggcacctaccaccacgcccagctaattttttttgtatttttaatagagacggggtttcaccatgttggccaggctggtctcgaacttctggcctcaagtgatctgcctgcctcagtctcccaaagtgctaggattacaggcatgaaccactgcgcacagctatttgctttcctatttttaaacaatgaccagttgggaaacaaaatgaagacatgtcaaatttacaatagcataaaaaagaatcccttagatgatgctaaagggaaaatgtgtaggacttatatggagaaaataagagttcaacaaggggacaatcatttcctgatggaaagactcattgttgtcaaggcatcaattatcttgaatttaatttctaaatttaacacaatttcaatcaaagtcccaatcattttttggaggctgagggttgactgaatacaatcccaataaaaattccattggtatttttaaaatcttgataaactgattctaaagtttacttggaagaataaatatgcagtgatagccaagaaaatgttgaaaataaggataatgagggtggacttgccctgccaagatataacatattacagagctactataattaaagcccatattgctatactagaagacagatcagtggcacagaatagaaggcccaaagacagaccccagtatatataattattaaacatataataaagttggcatttgaaatcagtggggaagggatgaattattcaataaaggatgctgggacaattggttacctctttggaaaaaaatggcaaattggattcccatttcacatcagattccaagaaattagacatggatcaaagagtttaaagtggaaatgatgccatataaaagtacaaaaaaactccaaagagtaatatttatatgaccttggagcatgaagaaggctgtttgaggtgtacttggactgtctttctttgtccagttttcccttttagtggtttaaaaggaatacatagtagtttttatatttttatttatttatgtatttatttttgaaacagggtctcattaggtcacccaggctggagtgcagtggtgcagtcatggctcactgcagccccaacttcctgggctcaagcgatcctcccacctcagcctccggagtagctggactgcaggcatgcaccaccatgtctggctaatcttttattttttgtagagatggggtctcactatgttgcccaggttggtcttaaactcctgggctcaagtgatcctcctgccttggtgtcccaaagtgctgggattacagatgtgagccaccacacccggtttctattcttatttttaatacttaattgttaacacgtatatttaaacttataatgtcctatatgcaatttctcaatatcaataatcttttgaggaatataagactcagcacattttcatcttgtaaccctcctgcaactcccatttcttatgacttgggttttctctacttctctatctcttcctctgttgaaaacttttcatattatggaaaaaattaaacatatataaaagtaacattagtataatgcatccttgtgtatgcatcacccagttcaataatgacccatcatgatcaatttctttttcatctgtaatcctcccctttctctccccaccttggcatactgaattattttaaattattttatccataaagatgttaatgtatcctcaaagataaggattctataagcaaagaaaaacaagaccattatcacaccaaatatttttcattccctaatatcagtaacaataattcccttatgtcatcagaaagtgagtatatccatttccctgattgccttacagttttttaaactgttggtttttttccacttagaatccaaacaaggtccacatgttaaatttagttgatatgggttgataggtgcagcaaaccaccatggcacatgtatacctgtgtaacaaacctgaatgttctgcacgtgtatcccagaatttaaagtaaaattaaaaaaatttagttgatatgtttcttaaattcctttgaaaatatacgtttctcgtcctattttctccccacttgcagtcctctcttgtagtctatttgttgaagataccatattctttgccttgtagttttctacattctgggtatttggttggggtgggggggggtgtgtttgctgatcgcatccctgtggtgtcatttaatatgttcctctgtcacttgtattttctgtaaatctgtatttgcatcaagagacttgaaccaatcatatttgattatttgacaagtgtacttcataggtagtgaagtgagctttcctctgtaggcaagtggtatctttttgtgaccttagcaaccatagatgaatgtcacctagactcattgtgtcactagggatggccttgaggtttcctgttctattttcatttactaagcatgcactttagaaaggctctgagctgctccctgaagcatggcacccgtcctccagaaacccgcagtctagaggttgtaaaagaagatttgaacaccaagactgtaaaagatgatttgaacaacaacaacaacaacaaagcagttttattttgtatacattctttcattgtacctcccccagagggatataacctccaaataggggagccataccatagatgcattaaattcacaccaattcaaatgtgtgtatatatgtatttgcttgcagactactaaagtgacaatgtaaacgttgctgcctatttttcccactcttctattagattgacgttgcttttggtgagatggggcatgagtccaccatcctgtcccctctgtttccacatgaccctcatcgtatgaacacctctcttaagtgtgattctaggatttaaagatacatatttcttatgcattatgcacctaaacacaagccaactacttcatctggcacctgatccaagaaacaacattctgttccaaaatcaatagaagacaaggcactttaagggatcttcaagggagtgtaattttgagcatatggaatctttctaaccctagctaactttagaagtttaactcctatgcaagatgaagcatctatgttcccaagagtttgacttcagcaaaggacaagctgcagaagctgacattattgtttattttggcataaaggctttacttgttggtgaagttcaagtttaatgatctcttcctccctttctctctcttcctcctctccgctttccttcttcccttcctcccaccctgattttctcttttgcagtttgctgctttgtggtgcacaagcggtgccatgaatttgtcacattctcctgccctggcgctgacaagggtccagcctccgatgtaagtaatgggcatcgattgcttttctctgtccacagtcaatgctgccttgtgattaaatgtgagtgagcattcttagacgagtaagtgtggacgatctcactctaaggcatgtggtggtccctatagcttttgagacagttttccttttagtggaaaacaaaattttggagggagtgtggctggataggaagtcagctagtttgtctactatgattttgctaatgtcttcactttgagagctggagcacggagggtgagaggcaggggcctacttggtagtgtggctgcaaaaaggtagtttcggtggtactttgcagtgcacgttatggcactttgttagggtgttctttcttttgttattgttattattatttttattatttttcagatggagtcttgctctatcgcccaggctggagtgcagtggagcaatctcagctcactgcaagctccgcctcctgggttcatgccattctcctgcctcagcctcccgaggagctgggactacaggcacctgccactatgcctggctaattttttgttttgtatttttggtagagacggggtttcaccgtgttagacaggatggtctcgatctcctgacctcgtgatccgccgcctcggcctcccaaagtgctgggattacaggtgtgagtcactgtgcccggcctattattattattatttaagagtgttgcccaggctggtctcaaattcctgggctcaagcaatcctcctgccttggcctcccaaagtgttgggattccaggcgtgagccagtgcaccctgcttgttagggtgttcctaatatcagggcccaggaatgaggaggaaatgaatttatcctgctaccatgaatctcaaagtatgactactgctagtgggacaagagatgcttgtaggtaaaatgtgcaaaaaatttttgttttaatcattataaatgtattttaatgtggattgggaaaaatgtatctagtagtggttttgcatttatgataaggatatagaatttcctacctaagtaaagatttttaggttaaacaaaagataaactgatttgaggacaatattaagtgaatgacagtatgggtgatataaggatatggcaaaagttttggtacaaatgtgtttaaagtttagggtacattgttgattggcctacccagcagccattcacagccttcatccttctggcagaggctacctctcatgatggaagctaaaaatgcctaatacttgcttttcccggctctcttgtagctgctgaatgaggatgtgacccaatcctgctaatgggaactgaggggaagacctgggaaagagtctaggaaagatttttcctttctgataagagagagacatcccttcccttgtcctcttgggcatttttgtacaaggatataatgcttggagttgtggcagcccttttgggtcaatgagggacacattgccgacatcctgagcatggcagagtggaaaacttaaaagaaccgtgggtccatgatgatgctgatgagctgttgataccactcacagtccttttatccccaagctggatagatgggagaagaagctttttttttggccaggcacggtggctcacgcctgtaatcccagcactttgggaggctgaggcgggcagatcacaaggtcaggagatcgaaaccatcctggctaacatggtgaaaccccgtctctactaaaaatacaaaaaattagccaggcatggtggtgggcgcctgtagtcctagctccttgggaggctgaggcaggagaatggcgtgaacctgggaggcagagcttgcagtaagcggagatcgcaccactgcactccagcctgggcgacagagtgagactctgtctcgaaaaaaaagaaaaaaaagaagctttttttttttttttctttttttttttaagcaaagtcttactctttgaagccttctcttttatttttgtttttttctcttttgagacagaatcttgctctgttgcccaggccagagtgtggtggcatgatcatgtctcactcactgcagcttaacctccctggctctagcaacccccccacctcagccgcccacgtagctgggcctacaagtgcatgccaccacacctggctaattttttatttgcttgtaaagataggttttccctatgttgcccaggctggtctcgaattcctgggctgaagccctcctcctaccttgacctcccaaagtgctagaattacaggcatgagtcactgtacctgaccctgggggcattcttttacatgcagctgaaactgtcctagctgagaaggctttccaccatgcacagtctttcattgcccaataatgaactgcattcagcataccccaatgcagccatcacccctagttctcttactttgtttctgctttgaatccccttcttgaaatttctcccattggctttgtctccattactggttctgttacccacttagacttgacagctgacagcttgcccaaagtgagtagtgactatcttctgtcattggatttctttagctcctgctggtcttctgcaaatggtcatctgccaatttgctgcaaactggggtgggagtttgtggggagggcatatctgttgccatagcaacacaaagatgctggagcatatgttggatattctttgcttggaaaatgtggtaattgaggttaagaactccaagaaacatggaacaaccaaagtccttggaaatctgtttgcaaagacaaagtttgagactgtttgtcatgttctctcagatcctatgccctagcccttgtagtgcaatttcttctctcctccctagcaaaataggcaggggagtttggggagactgccctactcagtatgcagctctgagtgttcatgcagactgaaacttgatactcaacttgcagccaagaagatggtgtttcccatattctatctatctgctgaatgtttctgttgcctaagacagaaactcagctcaaactgacttatatgaaaaggaaaattttgggtccttgaaatagaaaaggcctaagggttgacttggcttcaagcacagtgaatcaaagttctaaataatgtcctcaagaacctgtttctccccttcttggcttagcctttgtctgtgttgattttattttcaggaaggcttgtctcctatgcgagcatggtggctgcaacacctttaatcttatatcttatcagtgctgcagtgcagtaacaagagctaaagtctcattagaccatgaatcacatattgccagaagaatgggttatgctgattggccaggcctgggtatatgctgctgtggtgtgaatgttttgtttctccaaacttatatcctgaaatcctaacacccaaggtatggtgttagaaggtgggccccttgggaggtgatcagttcatgggggaagagccctcataaatgagatagtgcccctataaaaaagaccccagagatatccgtcaccccttctaccatgtgaggttgcaatgagaagacagttgtgtatgagaaagtgagctctcactggagaccgaatcttccagtgccttgatcttgtactttctagcctccagaactgtgaggaataagtttatcatttaaaaatcactcaggttttggtattttgttacagcagccagaagggactaggacagaaaattttggtactaacagtgtatagaggaacaaaattttaaggatgggttttctgaattggtttcggggatttggtaattggctgccaaatctgattagatttaagaatgctaattaccctatttctagtagtaaagagagcctggatagtccgtggcatgatctgtttatagagatacacaaatcatctgcattggatactcctaatcaaccatttataagaagcaaggagccaagtgattcgatatatgatacccaaacacttttggaaaactaaggcatataatgacttgctcctaatgtctctggacaaagtggagaaagaaaaagatgagctcagggatttgaattcccagctcaaagagtttcataaatgatctaagagcttctaggtgtgccctgaaggagagccttctagcctgtagttgcagggctgaaatttctgaaaattaaatgcacaacctcatcctgcaattggctgaattacaatgcaaattggactccccaccacacagggtgtctgctctaaaagcaagggcaagggcattgatcagaaaagaatgggatcccataaggtgggaagactctgatgaagaccctaatgaagctggggacattgagcccctaaattctgacaagtcttttttttaccagtggaagtggcctccttacctcaagcaaaagtgtcatccccactcagggtggcattggcctttccatcttgtctaagggaactaaccctgcattgccctaagaaacagtaatggctttccctgaggcagttgccatgccaggcaatgctgattcttgtcagcaccgaatcccaccaccccttcaagtcctagcaggctcctaaacgtgagatgcactgtgtgacccacggggaggtatgctataccccaaaagaactatttgagttttctaatttatacaagcagaaccatagggaatatgcatgggaatgatattaagggggtaggataatggtggaagtaacatgaagttgaatcaggctgaatttattgatagaagttcactaagcagagattctgaatgtaatgttccagcttaaggagttaggaagggctctaacagtttagctggttggctgaaacatggattaaaagatggcctatcatgagtgagttggagatgcctgacctcccctggtttaatgtagaggaaaggattcaaaagcttagggagattagaatgccagagtggatttgtcatttaatacccgctcacccatgctgggaaggtcagacatacctttaagaaaggtatgtctctgtcaatactttgagaaatatatttgtgaggggagccccagcgtcctttaagagctctgtgatccctcttctctatagaccaaaccttactatgggaaccacagccacttaattggaaaacttaaatgcaatgggaataattgggtcctggagtatcaggggccatttggtggcactcaactgttaaaggcaaggtaggtgcggttaccttaatggatcgcagagttacaacaacaatcggaatagcctgactcatgcagacctatggcactgcctaatcatggtgttgctagaagtgaaataggtgggaagcctactaaattcttacttgatctgtatagcagaaaaattctaggtgaagtgaacagaagtctaacttgaatcataaaaatagagaatcatagcccctcagtccattcccagacttgagccagtttatagacccagaaccctttgaatgaaagggaggtaaaatttccttgagaaagcgattatactgctaaaagtttatcctgttaatctttctcccagccttgcccaaagggacctactgctttttatcaggataactgtgcactagagaaaaggaaatgatgagaccttttggggactactgaacactagttctgaactgacactgattctaggagacctaaaatgtcacttgtccctccagtcagaataggggcttatggtggtcaggtgatcaatggaattttagctcaggtctgtcttacagtggatccagtgagtccccaaacacatcctgcagttatttccccagttccagaatggataattagaatagacatacttagcagttggcagaatccccatactggttctttgacctgtagagtgaggcccactatgatgggtgaagccaagaggaagccattagaactgccccagcctaggaaaacagccaaccaagagcaatactacatccttagagggacagcagagatcagtgccatcatcaatgacttgaaagatgcagaggtagtgattcccaccatatcccttattcagctctcttatttggcttctgcagaagacagatgaatctagaagaatgtcagtggataatcataagcttaaccaagtgatcactccaagtgtagctgctgtatcaaatgtggtttcattggttgagcaaattaattcatcctctggtagctagtatgtagctattgatttatcaaatgcctttttctccatctctgtccataagacccaccagagcagttttattgcagctggtaaggctagcaatacaccttcactgtcctacttcaggggtatatcaactcttcagtcgtatgtcataatttagtttgcagggatcttgatcattttttccttccacaagctatgacaatggtcctttacattgatgacattatgctgatttgtcctagtgaatgagaagtagcaactactctagacattggtaagacatttgtgtgttagaggatgggaaataaatccaactaaaatttagggaccttcttcctcagtgaaatttctaggggtcagtggtgtgtggcatgttaagataccccttttaacgtgaaggataagttgttgcatctggacccttctacatccgagaaagagacagatggcctactgggcctacttggattttggaggcaacacattcctcatttaagtgtgttatgctggcctacttaccaaggggccccaagagcttctggttttcagtagggcccagaacagtagaaggctctgcaacaggtccagactgctgtgcaagctgctttgccacttgggccatctgacccagcaaatccaatggtggttggttagtggcagagagggatactgtgtggggcctttggcaagcctttataggtgaattgaagcacaagtatttaagattttggaatatagtcctgccataatccacagatagctagtttcctattaagagacagctcttggcctgctaccgggccttcgtggaaactgacgatttgaccatgggccactaaattgccgtatgacccgaattgctcttcattaactgggtcttatctaaaccaccgagccataaagtgggcatgcacagcagcacttcatcatcaaatggaagtggtatgtatgtgatcaagcctgggcaggctctaaaggcacaagtacgatacatgaagaaatggcctggatgcctgtgctccccactcttgctaccctgccttctctctcccaacttgcacctttgggctcatgaggagttagttccctatgatcagttgacaaaggaagagcagactaggacccagtttacagatgtttctgtacggtgtgcagacaccacccagaagtggacagctacagcactgtagtcactttaggacatccctgagggacaatagtgaagggaaatcttctcggtgggcagaactttgagcagtgcacctggttgtgcactttgcttgggaggagaagtggccatacatgtgactatatcctgattcatgggctgtagccaattatttgactggctgggcagggacttggaaggaatatgattgaaaaaattggtgacaaaaaagtgtggggatgaggtgtgtggatagacatctctgagtgggcaataaacatgaaaatatttgtgtcctaggtgagtgcttaccaaagggtgacctcagcagaggaggattttaataattgacttgatagaatgacccgttctttggataccaggcagcctctttccccagacaccctgtcatcacacaatgggctcatgaacaaagtggccgtggtggcagggatggaggttatgcatgggctcagcagcatagacttccactcatcaaggctgacctggctatggccaccgctgagtgctcaatctgccagcagcagagaccaacactgagttcctgatatggcaccatgcctaggggttatcagccagctacctggcggcaggttgattacattggaccccttccattatggaagaggcagcattttatccttatggaaatagacatgctggatacagatttgccttccctgcctgcagtgcttctactgaaactgccattcatggacttagagcatgctttattcactgttatgaaattccacacagcattgtgtctgatcaaagaaatcacttcaaagccaaagaggtgggcagtgaactcacactcatggaattcactggtcttaccatgttccccatcattctgaagcagctggcttgatagaatggtggaatggccttttgaagagtcagttatgttgccagctaggtagcaataccttgcatgcctgggcaagattctccagaaggctatatatgctctgaatcagcatctagtatatggtgctttttctctgatagccagaaatttatggatctgggaatcaaggaagtggaatgggagtggtaccactcattattacccctagtaattttaccaccagcaaaattttgctttcttttcccatgactttatgctctcccagcatggaggtctcagttccagagggaggaatacttccagcaggagacagaacaatgattctattgatagttaacactgccacccagccactttggggttcccatgcctctgagttaacaggccaagaaggaagttatgaagttggctggagtgattgatctggactactaaggggaaattggacactactctacaatggagaaaaggaaaaatgtgtctggatacaggagatccctaaagacatctcttagtattaccattacctgtgattaagatcaatgaaaaactacaacaactcaatacaggcaaaactatgaatggcccagaccctttaagaatgaaggtttgggtcaccctgccaggtaaggaaccaccaccagctgaggtgcccactgaaggtaaagggaatacagaataggtaatagaagaaagtagttacaaataccagctatgaccgtgtgaccagttacagaaacaaggactgtgattggcatgattattggcattattttgttatggatatgtttgtgtgtatatatacatatggtgagcaaatatctttgttttctttgctcttttagttctttatcatgtaacgtaagatgtattgactttatatcagtatttttatgtcttagtatttaagttataggataccaggacaagaggaatcattactcaaggacttcatctccttttctggggaggggattattgcattttcagttgtacaaagtctaattgtatcacatcaggtggaattatgtccttgttattctttatttggaggttctttatttaagaaggtgtgtatggatgccaagttgagaaagggtggacttgtgatggttaattttgcacatgcagttaaccttgactgggctaaggggggtacccagatagctggtaatacatgatttctgggcatgtctgtgagggtgttttcaagaaattatcatttgaatcagtagactgagtagaaaaattgccttcattgacataggcaggcaccatctaatctgttgaggactcagaacaaaaaggcagaggaagggtaaattcactctctctttttgagctggaacattaattttttcccgcctttgggtgttggtgctccaggttctcagtccttcagacgtggaccaggacctactccattggcacctatggttctcaggtctttgggctcagatttcaaacattggactaaactatacccctggctttcttggttctctggcttgcagatggaagactgtaggacttcttggcttccataattatgtacaccaattcacgttattgatttttttttggagaaccctgactaatacattgtgcctacaccgtagatgagggcgtgagtgccccttccatggattgagagtggggaagaggtagtttctctgaggaaagctagagaaacggtattgtgtcctggttaaaatcacggattatggagccagcattcctagcctcagatctgtgtgaccttggacaaataacttaaatccatttatgccttagattcctcagctaaaaaatgagttaaataatagtttctacttgatagcattgttatgagtatcaaatacatagatatctgtaaaagcacttaggacagtgtctggtgcatggcaagagctatatatgtgatgatgatgatgacaatgacaatgaataacagtgcacacatgctgagcagccagcaaggacaggtgtcttgtcagacagaccaggaaagggtgaagaatgagcaggttctctgtctgccacctggcagtccttcctagaagtgtggaggctctgtaagtggcatgagacccctctctgtatgaatgaaggagtgcagccattcattgccttgagcatgaggagagcaggaagtactccctgcagccagcatgcataggatttggcagcctacctgaaatgattctatctctggatacagttccaaaaaggtcagttggcaccaaggatgatgaattggtccagacacctgaactggcttgactcagttcattgacctttttctgctcatggttggaggcatgattaaagacctagccacacctgcttgcccacctggccagactctcctttagctgcccctgatactcatgcaggtatggaggggtgccctctccttctgcatgaccttggaggaactggtgtgcagcaagttcgtgaagcagaaacacacaggcggtgaccttggacaaggctccatccacgataaaggatgtgcttggttgcatcctctaccctctgctgttccaagcccagtctgagccaggcaatattatggatattagtagagctttgtgctgttggcattatcctacagctatgttcacatcatatcacattgaggcaattttatgaaccaggcactgtcccgtgaacctagctactgagccaaccattcaataacaatgagaatagacaacatttatgggcactcgccattggagggccacaaagtgtggcagagttcatggatgatgctcctggtcacccacagtcatccttcttgttcttgatctcaccaggcaggaaatcctcaattcatctgtctcttgtacctcttagagagaccaggtctctggtactgtcataagcattacttatggacattataggttattcagcactcagaatactgaccacatacacagcctcctgtgacatctcagaacaagaaacagaggagttgtctctgagggttgggactagggtgagtcaagtgaggtactttccctgggcacagtttaaggggttcttgtctgtgtctgtggatagctggttggttggctggtgggtggatgatctaagatggcccctttcacatgactgacgacgagcaggttgtcggcctgtgtgatttggctctcgtccatgtggcatcatcctccatccaactggctagctctgacttgttcatatggtggtttccaggctccaagaagagcaagagagcatctcccaacactttttaagcctttgtatcatgtttgctaatgtcctaaaaagctagtctctggccaagtccagattcaagtggtagaaaaatagattccagtgcctcattggagaggaagtatctatggttaatctattgcagatcctgttaacccaagaggccatagcagaacagaacccctggagaccatcacactggactttataaaaatctgcatgttatagtgtggctcagagtcatagatggcctcatcaaaagaatgcacctaatttattccctgcctcaatcgccagtggacttaaccacctctagctataagtggttaatgtggcagtttattgatcacgtcaatggtggttaagagtatggactctgaaatcagacatacctgaatttgagtcttgattctgcccagatactcattaggaaaacttgggcatgtcgttcgacttctctatgccctagtctccttatatgtaaaataggatgttagtaccaaccacataggtttatagtgataattttaaaaatatttaaaatgagaaagagttcacaaacaaaagacaaatgaatttcaaagcccttacatgaaagcgcttggcacagtgcatagcaagcccttggtacatgtagctaaggccatttccattgctccacctaggtccataatcaagaatgtactgacaattctctacattcttccacccagagcatgcccttatgaggtgattacagtttccatttccattacttcacacaaacctcaaattctgtgatgcagtgctaagaaaagaactcaaactttggagccagaaaatgctggtgtcaaattccaaatggtctctgctatgtattgctccaatgaccttgggaaaataactttaagttctgtgaccctcagtttatgtctttaaaatagagaaaataatacctaaataaagcggtttttttttttttggtaactattcaataggagactgcttgaaccatccctagaataatgtctggcacaaagaaggcactcaatacctggttttaaaatcattattaatgtctggaggagcctctcctgctctataagggatacaggttaccctctgacctgccaagaaataatagctaataataatagctaactttattgaacagggtctctgggcaggcagtacaaaaggactctttgtctggtttgtctaaagatacctttttcaacactttatggctttagaaataatttcttatgatttatagtcaagttactgagtaaaacccactgttaggtcctgtgatctcctaattccatcactaaatcaggtcaattagagatggtagacactaatgttgaccttatccttttgatcaagtctcactttgtgataagatagattaaaaatcataaacttgttaaacttgttaaatgttgaagatttgataaaacagaaatgaaagtattaaatgtatgtatacattaaagtatgtaaataagtgagaacatgtttgaaaatctggttgaaatggatgattttctcataaaattgtcaattttgtctcaaaaagaaattgaaaaccagaataggcaaataaccgagaaagaaatgaaaacattattcaaggatcttttcttctcgtaaaaccccagacaaatatgtttcatgggtaaaacttcttaaattttagagcaacgaagaatttctgttcatttaaaattgtacctgattacaaagaagaaataaacctttacaattttttttaaatgaaaatgagagaaatccagctcaaattagcagtaggaaaagagggcccattgactcctgagaaggacattgggagtagagtaagagcttcaggaccaaggacctcaaaggctggaactgaagctccagtacttgcaagatacttttccatttctgctttattggttagttattttgctctgtaacaaaccattccaaaatttagtggcttgaaacatcagttatttgtggtttctcatgattgtgtgggttacttgggtgattcttctgacctgggtttatttgggtaatccctgctgggctctgtcctgggtcttggtcagctagtggctgggccgatgctggattacctagaacagccttgctagcattgactgagggctggcaggctgtcgatctgggcatttcatttttcctccatgcgtcctcttttcctccaccaggctagcttagtttcacggttccaagcacggcaagagagggaaatcccaaagcacaggtgtgtgtgtgtgtatgtgtgtgtgcgtgcgtgtgtgtgtgtgcgtgcgtgcgtgtgtgtgtgtgaaatggagtctctttctgttacccaggctggagtgcagtggtgtgatctcggctcaccgcaaccctcccagatacaagtgattctcctgcctcagcctcctgagtagctcggattataggcacccaccaccacgcctagctaatttttgtattttttgtagagacggggtttcaccatgttggccagctggttttgaactcctgacctcaagcgttctgcctgcctcagcctcccaaagtgctaggattacaggtgtgagccactgcgcctggccagcataggtgttttttaagcctttgtttgtgtcacagtggttatggacaagatcagatttggggtggagaaacaaacttcatctctggatgggaagaatagcaaagtcacatggccaaggagcatgcggggatgggagacattggtggccattgtgcagtctaccacactgacccttatctgctgtgccagatgcctcgtttgcccttccaatccactctgctttctctgagagactaagccataatgactgcttcaactggggctcccttaccctctgacctgacctctggttggactcaaggggaggggctaataggagacttggggaggggagagtgagaccctccccgagtcagtcagtatttattatggagtcatcttcactctaccttttgactataggttgctgctcctctacagatcatcttctctatgtaattctctccttctgggttccaggagctactcccttcctttgtcctctggctcttactagcctccaatcccttatactttcccaacaccatgcccacacctttagaaacagtcctttcattgaacctttcttaaacactcttcactttagtatgccatctgtttcctgcggggcccctgactgatgcatctgctttgtcttgcctcatttgctcctgctgtagatggaacatgtctgcaaacatcgttacagttgaccccatggaaagatggcaaccctagtggaggaattagccttcttcctgcattcgttttttttttttttttgagacaaagtctcgctctgttgcccaggctggagtgcagtggtacgatctcagctcactgcaacctctgcctcctgaattcaagcaattctcctgcctcagcctcccaagtagctgggactacagatgtgcaccaccatactcagctaatttttgtattttcagtagagataaggtttcagcatattggccaggctggtctcgaactcctgatctcaagtgatctccctgtctcagcctctcaaagtgctaggattacaggcgtgagcgactgcacccagccatcttccctgcattcataattgatctcagaaaatgttctgatggagttggttctctatcactgggagaacgaactcttataacctcagacctggatcccatggcatccctttcacccaggagcagtgtatgttataagaagagtgaaggagaaactttgatgcgctgatgaaagtaataactaattattataagcttgcttaaccacaataaccgctattacctagtaaagttggcataaaaagtaaactacaagccagtctcatacatgagtctagatgaacatatcccaaataaaatagtgaatgctattttattgttgtcacggacattatgcattcaaataatgtggaggaaacaatctagagataaaacaacaaagaaaattatgatcaatataacaaaatataggaataaagataaaaatatgccagcaaggaaccgtggaatctggaaagcataaatttagatggtagaagtgatagcagaatgttacccaaccaatgtaaatggattgaaattctctactgaaaggcaaagactatgagattggatgagcaatgtacaactcttggcagtgtataaaagatgcttaaagcacaggttttaaaaataaaagggacaaaagtgtatcatgaaaatacatatataaaaatgaaacatggtcttaataatgatatcaaaagaaataggactcaaaacaaaaagcataaacgggggcagatgtcccagcagatcacttgagctcaggagtttgagaccagcctgggcaacatggcgaaaccaagtctctacaaaaaaaaaaaaaaaaaaaagaaaaaattagccaggcatggtggcatgcacctgtagtcccagctactcaggaggctgatgtgggaggatcacttaagcctgggaggtggaggctgcaatgagctgtgattgcaccactgcactccagcctgggcaacagagtgagattctgtctcaaataaacaaaactaaacaaaaacataaaacagggaaggagaaaacatgaactctaatgcattactggtgagtggcaaattagtatatgttttctaaagagcaaattttccatacatatccagagctttaaacacatttttgacctaagaattactaaatctaatcattttgacctaagaatgacaattctaggaatttttggtaagaaaccatttcaggataaatgcatagatttatctagagtgatattcattgcatcagtatttataatatcaaaaatttgaaaatgacccaagtctcactaccaattagagtttatataagtaaaatatattacagtcatatggtggaatgctggccagtgattcagtgtcacagtgtctggggataaggggaatgttctgtgtcttgactgggatggtgcctatacaggtgtacacatttttcaaaactcatcaaactatatgcttaaactctgtacattactgtatgtaaattatactttaataaaaagtcacagtgattaaaatgccattggcctggaaatgcagtcataatatattgctaaatgaaaaaaaaaaagcagacaacaaaacattaggtcaggtatgatagatttaaaaatataaaaatatatacacatgtaaagccaaaggccacattccctaaataaattttcgtgaatacttaattctgttcactgtcttatgccagacttgttacctgcagagctctgaaggtcactttgggatgttctgtagctggtttctccagttttgtttgtttctggggccactccacctctagtgcagactcaggtttcccacttagttcagtgaggaccaaacttgagtggcggttccggcgtaatcgggagtcacttacagttccttccaaatgtggttactcttgaggtcctccatccgctgggagtcagctcagttcctggactgagcatcttcaggtgcttctaataagattctggcctctgataagtcttgacttcaattcatttttggccccagagaaggggaatcttggctctgccaacaaggccctgtccatttcctgcctcagtgtgagtggcaggaagaccaccttgatcttcagggcaaaggctcgcttcctcctcttggtgtcatccggtctccttggctcagtaaagcaacgtaacagtcaagtgcacttttctcaacgcctggtttcttctgtcttacataaccccaagtggggacacccacagtgaactttcaaaaataatgctccttccagggagcgaagcagcaatgagggttgaacatctctcttgggatgaccatcacctggaccaaaagacccatttacatctctcaaggataagtaatgtcaggggcaatttagtctaaatgatacagtctccacctcccttcctcccttcctcccttcttccctctctcacttatctattatctccctacatctgaaagtgcaccatcctgctgaaatcacatcctgttcacataacactgcagtccatagcttctgaatccacacagaagttctcgtgggcgataccaaatgccaagaggatgccttagaaggagtctggagatactcgaggattggcctctctagctcagaggttacactgtcatcaaatgtccaaagagctcttgtacagaatttttgtggtgcagttctaaaggagaagtaggactgaggtccatctgtgcaggctaacgaagaacagcccatactgaccaactggttgctacataataatattagctccccatccgaggatagtaaagctcaattgccaggcatgctgtagagggcatagctgtggtagatgtgggtttctaccatgttggtggttctactagcttttgttgttttgttgcatgcaacagaaaccatctttggttaacataagttggaaaggaattcattggaaaagatgtggcatccttcagagcgttgaaagaaaacttgaacaaccagaccagttctatctgattttggttcttgtgttacattcagcctaaattcaaattccagaaggagagagattatctggccgagctcaagttgcctaacaaactcttgggtcgggcttttaaaatgttctttcaaagactaaacgctgtgggggtaggatggcttttcaaaggagaatcgaagtactgatacggggagcagggggtggggagggggaagaaggcacagatgttgcgccaattggaacaacgtgtttgctacaatttctaaatgctacattgcagattgcagagagattggatgacaggcttcacctgaagagatagagatcaggacctgggaatccatgtgttaaaaagttcttgggtaattctgatggatagctgggtttagaagccagtgtaaggcaatatgtataaaagctctgaaaccagaatgactgagtttgaattccagtttggccactaactagctgataatcttgggctagttacctaacctccctgcttcagtttcctcatctataaaaagaggataaaatggcacccacctcatagggtccacgtgaggattaaatgagttaacctagatggtaagagcttcatgccgtaactggcacataggacatgctagttaatattattgccacaaatgatcctttcaagtcttagattgtgcatttcaaaagtccatccttatttttggaattgcatgcatttatcttgctttctgcaaaatggaaaggcatctcccatgggctggttggagagaggggctgataaaatgatggtaatgtgataaaatgcagttctcttgattgtcaagtgaattctgcatgattcttctgctctcatttgccacgggctgactgcttctgcaatgcagaacccgcttgtaaaggtcagaatgaattgcttccaaacatccctttgtccctcactgtcacgaagacacagagctgcatgctgtggaggaagaagcaaatccatgatgctggaaggccagagaacagaaaccaaccgtgcacagagaggcgagctgctgggacttgaatgaagctgatgcgtcccatctataaattattgtggcttctcctagttgggaggcaggaccagcctcacaatttcccagaagaccgtaatttctggagcctgcaggcctgggggcaaatggagaaatcaaaaggcagatggccttggagataggcagccagaaaggatgtgaaaggccctggttctggactcaagagacctcacgtttcctagtcttctttctgtctctgctcttttgtgttcatgaggttcatgccctcatgagggctcccccacctccagtggtctaggattctaggatgtcttggtattctttttcaaaaaaaaaaaactaagagccagcatttatagatataattctgtcctaaacactttacatataataattcttcattcttcattacaccctgtgagataggttatcattgttataattccatttcacagatgaggaaactgaggtactcagagactaaatgacttgctcaaggtcacttgtgagaggtccagctctaggccctctggcccgtggggctatgctcttacctagtacctcaaactgcctggtagacctcaaccctgtgtacctgcacaaatggtcctgaagcaggcagctttcttccctgagagctgcctttccagatatgcactgccaaaggtctgtgaccctacagccttggcctgatttggtccagatgcgtgtggacatctctcccaaacaggatcaaattggcctcttctaggagtttagaatttggaatcaagggtgctggttttagtctggactggtcacacagtttttgacaactgtttattgtacgggaaaagtgtccagcttgatgaattctcacacagtgaatttttctttgtaagcagagccccagaagcccttctttgctccttctaatctctacacgtccctccccatccatcaaaataaccactaccagaccagcaatcctttggctgcttttccccccacccccagtgatctattttattttattttggaaagaacacgtaacatgaaatctatcctcttaacaaagttttaagtgtaaaatgcatcattgttgatgatggatgcagtacgagacagcagatctctggggcttattcatcatgcttgactgaaacttgatgcccattggtaagtaattccccattttgcccttcttccaggctgtagccaccaccctttcactctgattttctatcaatttgactatttttgttactttacgtaagtggaatcatctagtatttgttttcctgtgactagtgtttttcatttaccataatgtcctcagggttcatctatgttgtctcattgcagaacttccttctttttggggggctgaaaaatattccatcatatgcataaacacattttccttatccatttgttcgtcagtggacacctagattgcttccacgtttagctgttgtgaagagtgctgcaatgaacatggaactgctaacatttcttcaggatgttaatttcaattcttttgggtaaatacccagaggtgagggtgctgaatcatatggtagttctatttttaatgttttgaggaaccttcacacgggctaaggacttgaataggcagttgtccgaggaagacatacaaatgaccaaaaggcatatgaaaatttaaaaagctaaacatcactaatcactaggcaaatgcaaatcaaaaccacaatgagatattatctcacacttgttaggatgactattttttttttttttttgagatggagtcttgctctgttgcccaggctggagtgcaatggcgtgatcctggctcactgcaacctccacctcccgggttcaagtgattctgctgcctcagcctcccagagtgctgggattacaggtgggagccaccacgcccggcctatttttttttttaaaaaagacaagtgttagcaaagatatggagagattggaacccttgtacactgttggcaggaatacaaaatgttgcagatactatggaaaacagtttgcctgcttttgagcacttaaaaaacaaaactaggctgggcccggtggctcacatctgtaatcccagcactttgggaggccgaggtaggggggatcacttgaggtcaggagtttgagaccagcctgaccaacatggcagaaccccgtccctgctgaaaatacaaaaactagcctggcatgatggtttttgtatctgtaatcccagctactcaggaggctgaggcaggagaatcgcttgaggttgcggtgagccgagatcatgctactgcactccagcctgggtaacagagcaagactccatctcaaacaaaaaccaaaaaacagaattatagagtagaccatctcttgtgtctggctggtttctttcatatgtgtgtgtgtgtggccacatgatattgaaaggacacatagcatcctgttcatcaggatgtccagcttcagagccagcaggggccaggcaggtgggtgaatgagtgacgtgtgtgaccacaggcatgtcccattggcccattgaacaccctatctgaaaggggcagcggcactcagctccgtttcctaattcctgctgtttaaaggatgaaggtctaagttttcccatttttttccagagaaatctgaaatcccctaaatttagattttgacagagaattcaagaattacaactgtggtgtattttaaacacatttttggactggattccttctgtgaacctccggtttacaacttctgcattcgtaggtggggactgtcagtggaaggtctcccccaccccacatcggaggggagaagggaaaatgtaaatttagtcaaatgggctttctttggagagtagagagtgtgcaatagtccaaggcagggagctttaaaagaatgcagaagtcttttttctctcttggtgtctgagctctaaattggctgggacatatccttagttaggagtcagtggctatagcgccccctgctgtcctttagcaccctcttcgtgtccagtgagatctgcaggtgagcctggaagccacttgcttctcctgcaggttttgggaggaagattcatcattttaaatattgctcaagtgcctgctgctgccagtgacttcataggctcctgttagactcaccttcacttatatttggtcaattacctactccctcagtcagaccttgccactcgattttttttttctttttgatacaaggtctcactgtgttgcctacgagtgcaatggtaccatcacggctcactgcagcctctgcttcccaggcttaagtgatcctcctgcctcagtctcccaagtagctggggctacaggcatgtgccgctacgcctggttgattttttaatttttttgtagagatggggtttcatcatgttgcccaggctggtctcaaactcttgggctcaagcaatcctcccaccttggcctcccaaagtgctgggactactcaggcataagccaccatgcccagccaccactctatttttttttaaattggaggtagggtaagaaggactgggccaggtcgtccttcccacaattccagtctcactgtttctatctattgaaaagcatttctggcatttgcttggtacctttccctggtttctgggctgaaatagattttatcccatttttaaacaattccttctgatactttcaggggtagtttgtggatgagagcagagtgaaatgcataggctcaggtttgtggccttgcaagttaataaagagtgtggactttggaactagcctgcctgggctccaatcttggctctggtacctactagctgtgtatcattgttttcattgttttgttttgttttattttgttttgtttgagacaggatctcactctgttgttggggccagagttcagtggtgcaatcatagctcactgcagcctccaattcctgggatcaagtgatcctcccacctcagcctcctgagtggttaggaccacaggcatacaccaccacacctggctaattttaaatttttttgtagagatggggtcttgctatgttgcccggatgggtcttagcctcccaaagtgctgggattacaggcatgaaccattgtgtcccaccttagctgtgcactttaaataagtcacttgacctctctgttcctgtttcttcatttacaaggtgaagatgataatatactacttcttagggtgagtattaaataagttaacctatgcaaagaggttaaaacagtgcctagcatatcatagaaatgtttgcttgacccagaggcctgaacctgctttgccttcagtgttggtctttaggtcctggcttcactccttaatgctgcatctcagcctttcctcatgaaactttctgtctttgatccttttcactccttaactgtgaatctcccaaattccactgagcagtgatcaattcttggggcatcttgctctgtgttcccagacattccttcaccctcattttctctccatggccaaatcctatagtgcctcctaaataattatagctgacatgtatgtagcacctatcatatgccacgtgctgttctaagtgattgatatatgctaactcatttaatcctcaccctatgagaaagatgcttttttaacacctattttatagaggaggaaactgaggcccagagaagtgaactgacttgccaggtcacataactaataagcagagtctggatttgagtttggctctagagcctgctcttagccaccatgtcccatcctcactgagaggacccttgttcaactccactaaccctctctggacaagtagcctctggtcctgtctccctgcttcctctctgtctcactggcctaccctttccacacctttctaaaaaccaaatgtgatcatgtcatcctctttgttgaaaacatgtcaatggcttcccattgttcttgggacaaagtaaatactctttgaagtggctgcgaagcagggtggacatacgtcctcctctgccaagcttgcctataaaccaaattggtttgttctgttgtgtcagcgtaccacaaggctggtgcccttgtcatcctcacaagagtccctgttggaagatacaggatatgattgtcctactcatgaggccctgcgtgctctggcgtcagggtccctccagcctttgcttgaccactctgagtaccttcgttcactcctctgttcatcctgccaccaggcatttgcacatacttctcccttggctgagatactcttctctctcttcttccctgtgagttcagtgggtctcaattctagttgcattgtagaatcttctgcagggctttttaactgaatgcagtgtctgcacccattccagaccaactaagtccaaatctctgattgattcagaacctctcagttgcatgcagggttaagggccctggtcaactcacgctggtcctctagactgcagctcaagcatcacttcctcagggaagcccttcctgacctccctgaccaggcccatttccaatattttgtactcagcacaccacatacctcttcttgctgtcacatatcttagggacatctaaatattaggttggtgcaaaagtaattgcggtttttgctattgtaaataatggtgcaatagtaattagttaaaagtaattaaaaataatggcaaaagcacagttacttctgcaccaacctaatatttacttacatggtgacaaagaacccagattctggataaaaatgaatcactagctgtgtgaccttgggcgagttacttaacttctctgtgtctcagttttctcccctataaaataggaatagtcaaaaacctgttttacatggtcgttgaggatcaaattagttcataatatgtaaggcgcttggaacagtgcctggcacatggtgagtgctgtatgtggtagctgttactgcactagtaattattaccccctgctgggatctgtaaatccctgaaggtggggttggcatccgttgtttgatcactccacacctaggatgctgcatgaacataatagctcttcaatacctgtctgttcagcagagtggcgtcctagtgaggttcttggtaaaagatgaaaggtgagatgtggaattgcaaaaaaaaaaaaaaagtatagacatcagagttggcctgcacagaattcaccttcctcagttagggcccttgtctatgcgggcctgctggttcagggtcattgtttctagcggtcatgaggatcagagcctgcctggacttgctgtgtgcagagtccccggtgcagatggccacctggcaggcatttgctccagcagcatcctttgcaggaatgggaggctcctctgtaattcacaaactcaccgtgtccttctatacagaggatctttctgctcttctgaaatgcagacttgggtgtgctgagagcttctgtgacagagggtgctgtcaggaagctgggcatccagggctgcacctggaaaccaagctggcagcggctttgcaagttgaataatcttatgttgtgatcttgcatttacgggaccccccacttagcaaaaaggggtgctcagaccacttcccttagttggcttacggcactgcagggggagaggggtggggaggggaggagatgggtgtggttttgtgggtgatggaggatttatttataatgtgggtgtgatccgttgccatgtgactattccctgaaactactgtacaccctgagcaatgaatgcacaacccggcctgcacaggaagaggtggggctcactctgtgaacagcctccaccagaactcgaaggccccctggggaataccaagcctaacccctttgttttcagaaggaggaactgagaccagaccatggcagtgacttgcccaagatcacagatgtcatttttattctaagctaacatttgtcatatggatactacatgccagtcactgtgccaagctaagcatcatcattgtgatttcattaatctgtacacatctagaaagcaggctcattatattcagcaaacacttgcatagtgtatatatgatgtgccaggcactgtgctgagtcttttacaaatattaatccattaaattctcataatcctatgaggatttagtgtgattattatttccttttatttatttatttaagacagagtcttgctcttgtcacccaggctggagtgcaatggcatgatctcggctcactgcaacctccacctcctgggttcgagcaattctcctgcctcaacttcctcccaagtagctgggactacaggcacccgccaccatgcccagctagctaatttttgtatttttagaagagatggggttttaccatgttggccaggctggtctcgaactcctggcctcaagtgatccgcccgccttggcctcccaaaatgctgggattacaggtgtgaactgccgcgcctggccttatttccattttaaagatgaggaccctgaagctcagagaggttgggtaacctgtccaaagtcacacagctgggaggtcattgagttgggagtcaatctcagacagtctggccttgaagtgtctgctccagcactgtcatttctctccatgtgacagctcttctctccattttacaggtgagaaaatcaaggcttatataactcaagtagcttgctcgaggctgcacgactggaaattaccagagctggtgttgaatttgcacattccagctatagaatctgacccctgatctcatgctaaactccctctcagtggggctagggtcttttggctgaggggtccaagctgggaacaggtcacgggggttgaggcagagcctgaagccagcaggtggaggtggggtggtgtcagccaggtctacctgggttgactctgaacctcatgcagtggagcagttactcccttcccatggggcagagccccagctaggtggccatcgcctggttacaccctctaattccttaagatttcagcttaaacttcattttctcagggaagccctcctgactctatccagccgacactctccttgtaaattctctaagcactgagtgtctcctttgcagctgttggaagtgtacattggtttatgcttctttattgttttccccaactagactgacatagggaaggtactcaacgaatatttggtgactaaatggttaaataagtgaatggcttatagctgtagtagaaggaattggcacaggaaatcaagactgaagtccaagaagtggaaatatatataaggtttattgggaaaagtcacaactcagtaggcacagggatgccctgagcagtgataattaataattaatagttaataataatagcttgtacttattgagtgcctgctctgtgtcaggcagctgttttaaaggttgtgggtaattcattccctagaacctcacaaaacaaatattgttatcccctagggataactaccgctagggttattatcctagctccccctagggttgttgttcctagacagttaaggttaactagggataacatcaagagagctggcccaaggtcaccatttcttcccagcttttaaccaacgttttgagaatacagtattccccatcaaaatcgtggctcaccacggctgtgagtttcacccagcggcctgggtggtcatggtgaaagctagaaatacatctctggaagacattttcaggtatgctacagaggctggcatacccgggctaagagctgctggcctggctaatgaactaagatcactcgttgaaacaacaggtataaatctccaagcagaaaagactcgcttaacatggatggcaaatgttgtctaccaagaagacccaagaaaataatcaaataccctttgccaagaatgtctggttataaaataaagatataaatgacaataacttttctgtattttagcaacaaccagttaaaataaatttgaaaaaatcccagttaaaatagcaataaagaggtaaaatacctaggaataaatacttaggccccaactaagagagtttatgggggaaaaaatcttttctggaaaaacacaagaaggctcaaattacatgtgaattccacccctagctcccccaatctgtttttctcctggcagccgtggttctatatcacatcccacctcaccccttagctcagccacagcacccagctctgcacaattccttattctaaattctgattggcccagttcttccttcataaatttcatatcactgacccaaccttggtctattcagcattggctggaagtatgaggtcagatgctttactgtccactgagctggtgctgtaggttggaatttttctagaagggtcaataagttaagcagccaatgattggcatttccagcacaatctgggagaatacatggataagaataaccaagaaaaatttgaaagtaagcaggaatgctaggggaggggccagtgggtataaaggtgtgtgcctctagataccaagagcttatactatggtatggtgcaacggtggggagagagagacagatcagtggagcataagacaatattaaaaaatgagccgagaatacataagaaattcgtgtatcataaaagaggcatttcaaatcagcagggaaaagatgcatttcatacatttgctgtctaaacattaagagtagaaataaaggtctttcttgagagctcatgctaaaatgaatgccaagggaaatgatgatttcaatgtaaaaaagtgaaaccataaaagactaccagaaaatatcaggaaggactttctaaatacgacagcagagacagaaaccatacaggaaaagggaaaaatttgcactttattaaacacgcaggcacacacacacacacacacagacacgcacatgcgttatacgttgaaaaaagaacatcgacaaaattaaaaggcaaatgagaaactgggaaaacatttactgcatatatcataggtgaagggttaatatccttaaataatacacaggaaaatttgttacaaataatttgaaagaaacaaacttgaattttaaaacaggcaaaattaatgataacagtgaacatttcttctttttttgtttgtttgttttggaagcaggatcttgctctgtcacccaggctagagtgcagtggtgtgatcctggttcgctgtagccttgaactcccggcctcaagtgatcctcccacttcatccccacaagtagctgggactataggcatgcgccaccataactaatttttttttttttttttttttttttagacagagtctcgctctgtggcccaggctggagtgcagcggtgcaatctcagctcactgcaagctccacctcctgggttcatgccatactcctgcctcagcctcccgagtagctgggactacaggtgcccgccaccacgcccagctaattttttgtattttttagtagagacggggtttcaccatgttggccaggatggtctcgatctcctgacctcgtgatccgcccacctcggcctcccaaagtgctgggattacaggtgtgagccactgcgcccggcccataactggctaatttttaaatgttttgtagagatagagacaagatattactatgttgtccaggctggtctcaaactcctgggctcaagcagtcctcccaccatggcctcccaaagtgctgggaatacaggcgtgagccaccggacctggcagaacatttcttaaatgttcatcttcaccagcaactttatgcagtttccatgcagtatctcactgaactcttactaacctaggaattaagcattattattattccagtttccacacaaggaaacgaaaacttaaaagggttaaataactttccctagagtcagaaagttaataactggaagagccaagagttaagcttagatgtggctactaattcacccctatattgacatggactgcagtgcagatcttaacccaggaaatggtattttaaattctgccaaagtttatacaatagaagcttatccttcaaatggaataattacgtattcgccaaatgggcggggttagaagagggcagggtatatcaggcggttgaagcaaatcgtcacccaacacacaagtgtttacatggtgttattggctctattcattctcctctccaggaacaaaatgaaagatcgtcaccaaattatagtgtccccttttcaaatgtgccatgcgtgtgtaattacagcttctaacattctccacttttcatgctcagacaatctccgtccactcagtctcaattaaggtttccctactttttttgtcttttgcaaatttttggccttttgtttgcagttgtgggcatggcagtactgatgtgttactcacggtggtagtacaagaggtgagatttttgtaatacccagataaaccctaaaatattctactttacatcaaaagtatagaaaagtctgtgctgagaagttttactctctgtctactttattctctcttgcctccatagatgaacacttgtattaggttttttttttctttttttttttttggtgtatcctgccagaggtgtaattaagagtcgactttccccggttactcaggaggctcaggcaggaggatcacttgagcccagaagtttgaggctccagtgaactatgatctcgccactgtgctccagcctgggcaacatagtgagaccttgtctctgaaaataattttaaaaagaaaggatacacacttaacttattgcacctcgctttctcacacacacaaaaggtaccatgtaatatacacacctcagcaccttgatttttttgtttgtttcacttaaaaaatacaaccttggtcgggtgcagtggctcacgcctgtaatcctagcattctgggaggccgaagcaggcggaccacttgagcttgagctcaggcgaccagcctgactaatatggcgaaaccctgtctctgcaaaaaatataaaaagtagctaggcatggtagcgtgcaccagtagtcccagacacttcgggggctgaggcaggaggattgtttgaacctgggaggttgaggctgcagtgagccgagattgcactgctgcactccagcctgggtgacaaagtgaggccttgcctaaaaaaaaaaaagaaaaaaaaatgagatttttttccatattaatgcagagaacttcctcattgtactttatacctgagtagtcttccattatgtggctacactatgatttatttaaacaaccctttcccagtgacacttagcgtgtttaaatcttatgctaccctaaacagggcttcagtgaataactgtatctgtatattacttcctatgtatgcaggttattttaccttcgtccaacgtgatggagtgaaaggtgaaaagaatttgtaattttacaaaagcatttgtactttggataggtagtgccaaattgcccccacaggatgacaccaattggcccacccaccaggaatatgtgtctctgtttctccacagcttttcaacagaaactgtcgggatgaacatttaaaattttcattttaaaattttaaattgtctacttcattttaaggtgcattagaaaaggcagtttgcatattgatcccatgagttcacactcttagtttcatttttaaaaataggtttatttaaataaaaatggcagtactgaattgaagaaaaatatcaagtaaatattatgttggtgcaaaagtaattgcggtttttgccattactttcaatggtaaaatccacaatgacttttgcacctacctaatactgttacaggttgaatgcaggcatgcgaagttatgacagctcatgactgaagctggggaaatgttgccatgatgattttttctcttgggaataataaaatcaagaggttttatgttctgtgtgcaggacactgtgcttgaggttttataaagtggatacggttattggacccattttatggctgaggaaccagagactcagggtggttaagtcacttccctgaggtcacacagctaactctggagcctgcgcttgttaatttccctctgttctgagggtatttccaactgggaccttcaatttaaccttgcctacctaccccatgggaagtagagcctcaggagctttcatagcttgtaaatgtccagggatgacacagtctgaacttgcaatttgcttttcctttctcctctatggatgctgttagcttgtgttttctctctgtgtgcctcatttcagcttccttattcctgcagttttacttcagcccaaccagatttcagcccacctgtgggcaaagctgcacagcccattcagactgagagagacttttctttttctttctttctttctttctttctttctttctttctttctttctttctttctttctttctttctctttctttctttctttccctccctccctcccttctttctttctttctttttttctttctttctttccttctctctctttctttctttccttccttccttccttctttcttttcctccctccctctctccctcccttcccttccttcctctttctttctttctttctttctttctttctttctttctttctttccttccttccttccttcttcctttcttcctttctttttctttcttttctccctctccctcccttccttccttccttccttccttccttccttccttccttccttccttccttccttccttcctccttccctccctccctcccccctcctccatctctctcacctgtgcttcctttcctcttagctgcctgtgtctgggattaagtgatgacctaggatctgcctgtctttgatgctggggattgtttttcactataaagactctggtttgggggtggcagggacccaagtactctgtcactggccggtgctgaatttgtgtgagatgaagagtgttattgtctataacccccgtgttaggtgggagactctctggggaggctgaggagcaggggggcagccaggggacactgaggggttcccactcggctggctgcatttctggagtctgacaaacttggcttccagtcctggctctcccatgtccttgctttgtgaccttgggcaagttacttctctgagcctcagttttctcatctggaataccaggataacagtctaactcctccatcactgggctgtcaggagaatctggggacatgacatagaggactcagcacagtgcttggcaggtagtatgtgttcaattcaataaaattggtggcagtaaaagtcacattcgacggttattttgttgttgtattcaacaatctcttgaataaagattggaaatggaaggaaatttgggaatccaagcttgcctaataccaggcatgtggagatggagcctcagcaacaggaaatactgggaagaggaatcgtgccaggatcctgtggaaacctgatttccaggggtgggcgagatgactggggatgatcaaggggtgatgctgcggcaggagtgtaatagtttcaaacctgtttttgagagcacttgagactgagtcagacaaactcactcgggagtttaggggatgtgttcacatggggttggattccagcactgttgggaagaaggtagggagtctggcagaggtcccaaatccaaattcctacagggtccaggcaggaaaggggaaagagagaagcaggcctggtgtaagacaatagggaagagtggggactgtggaaaactagaaagtttattacttatctaaaggggaaaaccactgctcagcccacagaaatgagtgttctgtgttgtcacagctgatgatttctcaaaaggaagcaatatttcacattttttattctttctttctttcttttttttgtttgagacagagtctcgctctgttgcccaggctggagtgcagtggtgcgatctcagctcactgcaagctccgcctcccgggttcatgccattatcctgcctcagcctcctgagtagctgggactagaggtgcatgccgccacgcccggctaattctttttgtatttttagtagagacagggtttcaccgtgttagccaggatggtctcgatctcctgacctcgtgatccgcctgcctcggactcccaaagtgctgggattacaggcgtgagccactgtgcctggccaaaatttcacattttaatctgatagttcctgacttaaatatagtaaacttatttggatttctaagaagcaccttgttggccaacggtagcttctttacaggcttgatatagcttctgggttccacactgtggcccctgggcatgaaggagggcccaggccagggatgggacaggctctaggtggcctggaggtgtctagtcagtgtggcctgggtgacgaggatctgatgtaaaatgagactaggggagggattgaggcagagatggaagctgtgtctttttttttgtttttgagtcagagtttctctctgtcactggagtgcagtggtgccatcatggctcactgcagccttgaattcctgggctcaagcgatcttcccaccttggctgggattacaggcatgagccactgctcccagccaggaagctgcatctttgaatgcgatcagaaccaaaccccatagagggagtgatggcttacaggccatgaggattcccagactcatctcaggcttggtcaatacccacagcatcaaggctaggaagggaatgtattttggttaaaggcaggactgatacttatttatttattttgagacggagtctcgctctgtcacccaggctggagtgcagtggcgggatctcggctcactgcaagctctgcctcccaggttcacaccattctcctgcctcagcctcctgaatagctgggactacaggcgcccgccaccacgcccggctaattttttgtatttttagtagagacggggtttcaccgtgttagccaggatggtcttgatctcctgacctcgtgatccgccagcctcggcctcccaaagtgctgggattacagacgtgagccaccgcacccggccaggcaggactgatatttaacctgcatgccctggcactactgtaccagtggtggaaatattgaaatactctgaaaccgatgggtaaatagccactgggtcctctgggccttttcccccaaccttccacttacccatatctgcctctgccagctcctaccacaccccctccatgacgtggtgactagagtgctaactcccagcacagccaggctctgctgtccattccgtttggtctgtgggcagtccctgagccaaggcaattatagatatcttgactcacccctggttgtaggtaacatgcctacctggattggctgaagcacaaaggacaaattttagaggacacagggaggcagatggaattggaaggcaggatgccagaaccccagggaccagaaccaggagcttcatccctggggtcatgtagtctttgtctttgtttctccaggttcctcagagcgcaccataaaaatcagcaccaactgtcatttgctacaatgtggatgaacctggaggacattatgctaagtgaaataagccaggcacagaaagacaaatactgcatgatctcacttagatgtggaatctaatgaagttgaactcacagaagtagagagtagaatgatggttaccagaagctgggggacagcaggaggcaggagtagggaagaaatggagagttgctgagcaaagagtacaatgtttcggataggaggaattgcctttgagatctattgcacagcagggtgacattagtcaataatatgtatgtttcaaagtaattaagagagtaaatttcaaatatctcaagctaagaaaatgataggcaagttaggtgatggatatgttaattttcttgatttaatcatgccacattgtgtgtgtatattcagaacaatcagaacaatcacattgtaccccataaatgcatacaattataatttgtcaatcaaatataaaattagcagcctcagccctggaactgtatgtctgctggcctcaggactgattacctgtgtcccagccactcagcatatgtgacccttgagccaagtgtccacctctgccccagtcagctgtgttcagggaatgtggatgtctcaaagtacaagcatggcttttgggaggtgcccatctcagagatggcattgggctcaggcaggcatggaaaggtaccctgaaagatgcaccttgagggtcgtggagggagtcatgaggaccacaggtgtaggagtgtggctttaagctctttcaggtagcaggaaggaggagggaagaatccactgaggatgacctggtttgtctggtctgaaggattggggcagtgggtgggtagagttggtgcctacaagtatgatccctcatgaaagcggagggaggggaatgaggtcagaggagctctccagcagcctctaaataagccgtaagaagtcaatgtttccctgcaacttgccgattggttttcctgtctctcatctggctctaatctgtgctgcacagccccttctaagtcattttcctaaaatagcatgtttatggtgcaggggtttgcagtggccaacagcgatgattgcagccctacagctgtcacaacaacccattgaccactgtgtgcaatgctgtgcttgccacgggcaaaacacttcgtctcttagttcttcggtttcctcatctgtaaaacaggggtagtaagtagtatgtactttatagggctgttatgaggatcgaatgcattaatgcctgatgaatcccttaaaatagtccctggcatgaataaatgttccataaatgttaactctcacttattaagtatttattgagcatcttctgtatgccaagtacagtttatgccctgagagtataatgatgagcaaaatttcctcacattgcatgcagtgaagtgtggaagagatgcaattaagcgtgcatttataagtcagtggtttaagtgccgtgatggagaggatttagaatataagttccatgaaagcagaagctcttttgttcacagctgtatccccaatgcctaggaagaacttgaccctcagtatacatttgctaggtgaatgaacgaatgagtcaagttctatcttagccgcacatgaagatgaggtgtcaatggagtaaagttgggagtgaggagagaagggaggggaacttggtgtgaaccccatctctgcaagggtccagctgggtggccttggtgaagttactctgtagttaggatctgtttcattgttgctaaaatgggaacaaatgataccttctgcatggcatgtcataaggattggagagagtacatgtgagacacccagcgtacacatgtagctctcaagcagtgtgttgagactgggtgtggtggttcacacctgtaatcctagtactttgcaaggctgaggcaggcagatcacttgagcccaggagtttgagaccagcctgggcaacatagcaaaaaccctgtctctacaaaaaataaaaattagccaggcatatggcatgtgccttcagtcccagctgctcaggaggctgaggtggaagggtcgcttgaacctgggaggcagaggctgcggtgagctatgatcgcaccactgcactccagcctgcatgacagagcaagaccctgtctcaacaagacaaaaaacaaaacacacacaaacacagaaatgtgtttccttttcccttcccattctttgtgcttcttggtatctcctcttgtttaagagactgttgatatggagaaaggtctggatcatttttggtcagaaatgcttgaatccttgtcttggagatcgctcaagaaaatatttacatgaagaaaagtgcaaaaccaacagaggcaacttattattagttgtgattttgccccagatcttaaagtagagctcacaaggccttgaggaactcctttcttctctactaggcaggactaaggaaattcaaacctgaactcaaacctaactcttggcctctgtaagatcaatatatcagagaaaccagaagggaccacaagagccaagagtagagacagaatgtgtcctaggtcttggagaggagctggctcaggccacttctaccaagggtctcagggcaatactataagacttggacccagtagcgtcctgggagaagtgaaggatgtaagggagaaggagaagagaaagatggcaaggatgccttttaacctccatgcgagctccaccactggggtctggccaatccgtgtcttggaatccatccaattaaatcaactctgcctccttagaggttaagtaggggtgtaagagaacctggagcttctcctacaggccaataccagtcatgaacaggggttccttttttattattattatactttaagttctggggtacacgtgcagaatgtgcagttttgtttcataggtatacacctgccatggtggtttgctggacccatcaacttgtcatctacattaggtatttctcctaatgcctcccctagtcccccaccccccgacaggtccaggtgtattatgttcccctccctgtgtcgatgtgttctcatcgttcaactcccacttatgagtgagaacatgcggtgtttgattttcgaacaggtgttcctttttaggtgggtttgaagcactgaactcccaactttaaggtgaatgtccaagaagcacaatgggaactgttctgtggcacagagcagggggactctgataggaaccttatgtattcacttagtctcattgtccggagatagagacatggctggttaagctgccaaaagggatcccttagttttttggggggtggatttccaagccctgttgttgttactaggacggcacctcaatctttgagcaggacagatgattgctggggtccttttgtagctgagagcactcagggtcccactggcgacagcagaaaagacctcgcttctcaaacttggctgtccagtgctctggacgagtacttcatctgcctgactgcagagggtgggaacgttgtgaaagaaactttgtagctcattaacaagataagaagcaaccgaagtctgcagtggctgaggattttcagtcaggtttattgagacatacgtttcctgtggtaaaagtcactttaaacaattttttttgagacagggtcttgctctcccacccatgctggagtccagtggcgtgatcatagctcactgcagccttgaactcttgggttcaagtgatcctcccaccttggcctccctagtagctagaactacaggcatgcaccactatgtctggctttaatacatatatatagtagagacagggtctcactgtgttgcctaggctgatctcaaactcctgggttcaagctcaagcagtcctcccgccttggcctcctaaagtgttgggattgaaggcatgagctactgtgcccagcaaaattcactttttttcttttttcttttttttgagatggagtcttgctctgtcgcccaggctggagtgcagtggcatgatttcagctcactgcaacctctgcctcttgggttcaagcaattcttctgtctcagcctcccaagtagctgggactacaggtgcatgccactatgcccagctaatttttgtattttaaatagagacagggtttcaccatatcggtcaggctggtcttgaactcctgacctaaggtgatccacccacctcggcttcccgaagtgctgggattacaggcatgagccactgctccaggccacaaattcacttttaaaaatataaagtaaaattcatcacagttaatatatagaccactccaatatccaaaacaaaaaagttgctgcatctgcctctttttagttaattccctatccacctccaaccccttttaaccactgatgttttctgtccccatagttttgtgtttttcagaacatttagaaatgaacctacacttgtgttgaacatctttgttttaccagaatcctttcgaggttcatgaatgctgctgcatgtgtcaatagttcattcctttttactgctgaaaagtattccactgtgtggatgcctcacactgtatccattcacacgtcgaacgacatttgggtcctttccagtttggggctattataagtaaggtagctataaaccttcatgtatggatatggttgttgttttttttttttccccttctctgtcacccaggctggagtgcagtagcacgatctcggctcactgcaacctccgcctcctgggttcaagtgattctcgtgcctcaccctcccaagtagctgggactacaggcatgtgccaccacaccctgctaatttttgtatttttaatagagacagggttcctccatgttggccaggctggtctcgaactcctgacctcaagcgatctgcccgcctcggcctcccaaagtgctggaattacaggcgtgagccactgtgcccggcctggatgttttcatttcaccgaaaagtaggattcctgggtcctaggagagttccagtttatgttctttcttcactaacacttggtatcgttggttttagttttcaaacattttagcaactctggtaggtatgtgatatggttaggctttgtgtccccacctaaatctcatcttgaattgtaatcctcataatccacacatgtcaagggagagaccaggtggaggcaattgaatcttggggcagtttcccccatgctgttctcatgatagcgagtgagttctcacacgatctgatggttttataaggggcatgtccccctttgctcggcacttctccttcctgctgctttgtgaagaaggtgccttgctttcccttcgccttccactacgattttaagtttcttgaggcctcctcgtcctcaagaaaattgactgttagtcaattaaatctctttcctttgtaaattacccaatctcaggcagttctttatagcagtatgaaagcagactaatacagtatggaattattttaaagttttgaaaagaacagtttccttaggagaagcactcatcacattaacagcacataaaagaatatctatgtagtatgtctgtttatttgcttacatgttcattttctgtcactagagtacaattttaaaggaggcatctgtggcagcatcaataaatacatgtgaatggatgaatgaaggaaggaagaaactggtagcatgtaccaaaggctagggtgtcagatcagccctggattggaacctaaggcccatgttattaacttctgccatgtacttttttttcctttttttaagagagagagggtcttgctctcttgcccaggctggagtgcagtgatgcaatcatagctcacacatagccttgaattcttgggctcaagtgatcttcccacttcaacttcccaagtagctgggactacaggcatatgccaccacacctggctaattttttattgttgtagacatggggtctcactatgttgcccaggctggtcttgatctcctggcctcaagtgatcctcccaccttggcctctcaaagtgctggggttataggcgtgagacactgtacctggtctgcaatgtataacagagaaagcaacttttacagaaagagttctcttgaactaaaaccaattctgtgaggaaagaatctcttgaagaagaaagagaaatgcagagccaaaggcttacaaagggcatggtctgtttgggagcgggggtgcgctctgagtgctgagaatgtacatagtatgtgtgcatgtgggtgggtgggaggagggggcttagctggggatcaccttggccaaatagtaatagcaatcatggaaagcttatgctgcttgctatgtgccaggtggttctaagacctctacacaggttcattcatttatgcttcccaacagtcttataaggagagcactagcattatcagcattttacagatagggaaactgaagcacaaaaagatcaaattagctgggcatggtggtgtgcacctggcattccagcaattttggaggctgaggtgggaggatcatttgaggccaggaatttgagactagcctgggcaacatagtgagacccccctctctacaaaaaaaaaaaaaaaattaaaaattagctgggcaggttgggcacagtggctcatgcctgtagtcccagctactcgggaggctgagacagaagaatcacttgaacccaggagacagaggttgcagtgagccaagattgtgccactgcactccagcctgggtgataagagcaaaactctatctcaaaaaaaaaaaaaagatcagctcagcatagttgcatgcacctgtagtcccagctactcaagaagctgaggcaggagaatcacttgagcccaggaagtcaaggtcccagtgagctataattgtgccactgcactccagcctgggtgacagagcaaaaccatgtctcttaaaaaacaaaagaaaacaaaaaaccatcaaacaacttgcacaaactcacacagcttagagccccggaagtttatccaagtctgccttttaccactgcactgcactgccaggctatcaagggcatatttattgattaggaaattatgtaaggttctgtgagaaatagctcccaaaatatagtgacttaaacaaggcagaaattaggtttttctctcaggggtcagcccaaagggacaaaattcaaggctggtagggtggctttgtcctttccacatatggctccaagtttgggtccaggacagtcacttccagttctcaccatctttgaaccagtggggagagggaaaggctcaaggaagtatgcatttccatttgaagggaatggccctggagcacacacatcccattggccagaactcagcaccatggcggcacctgcaagaggtgctgggaaatatggcctctatctggatagccatgctctctgctaaaactcaaggattctactattaaagggaagaatggatattggtggaaaaccagcagtctctgccacaacttgcagactgtccactgggctttgaactttattctgtcagtgatgaggaactggcaatggtttctaagcagggagatttcacatccagacttgggtttttgatcactgcagaagcatgcttggagaataaaggtggggagaaagaaaagtcaggagccctgtttagatgatgtgtctgttactttgttttcccatctctggagtccctactacaggcaggagcctgtaggttgagttcccaggcaggcccagatggagggtttgcaggcagggtgagtgagcatggggctgcaaagggaacaatcatctgtctttgtccttcattccttccacaactatttatccagcaccgtttctgggcacagggctccagcgatggtcccaacaggtacaatgacctctggggaccaagttcagttcttggtgagttctccagtgcctctcgatgtaggatgaaccgttggcatgctccactgacgctggctccttctgttgtttctcttggctccaggacccccgcagcaaacacaagtttaagatccacacgtactccagccccacgttttgtgaccactgtgggtcactgctgtatggactcatccaccaggggatgaaatgtgacagtaagtactttttctctctgggggcatctgctgatggcagaagcaatgggaagggctgcttccacttggtttggggtccaggtctgccatacattcccccctgtcctcgttggggctggtgtaccagttatctgttgctgcataatgatcctcccaccccaaaacactgtgactgaagacaataaacatttttttagctcatgactctgcaaggcagttctttgaatctgggctggcctcagctgatgtcacgcatgttcataaagcatgaactcatggttcatggtggattagcagatggaggtgggctgggagctgtctgggccatggtggcctcacccacatgtcctggaggatggctggctgtcatctgggtgatggtgatgaccaggccacgtgtctttcctcctcagtgggctaggctacctagcctccgtgcatgcacggaggtcacagggtcctgagtttcttaggagggcaagtcccattggcagccacacttcaagtctctacttgtgtcttttgctcctgatccactggtcaaagcaagtggcatgtgagatgcacagtcacagtgtgggaaggggcagtccatggctgttgacacccagaggcatgaacaaatcatgggcatttctgcagccatgcaccaccactgttttcagcattgagatgtggggctgatgcattctttgcatggagaagacctgtggccctgcagcacccacaggtttgtgctggaggaggaaagagcatcattctctggccaggatgtggtaggaaaggcaggtggggtaggactcctctttatgaggccaaggcccggatggcctgtggggcaggggagcagacaggctttgagagctatggccacaaagctacagggacactggaggtgctggtggctcccacagacctgttggtctgcagcaggctgggtgtcatgaggctagtggtactgctctcccaagggtcctgaggcccagaggacagagggagaaagtcatagggcagagagtgacagagaggactgtgagggtgaataagggtggtagggagcaagacagacagcaagaaacacacatgcatagacagacacagatgcaggggaaagatggacacatgcaaccctaacacagggaggaatgtggggcgtggaagctacagagagactcagctagagagagactcaggcaaaaggagggacaggcagacacacagaccaacagataagccaggtgcagtggttcactcctgtaatcccaacactttgggaggctgaggcgggtggatcacctaaggtcaggagtttgagaccagcttggccaacgtggcaaaacccaatctctactaaaaatacaaaaattagccagtcaaggtggtgggtacttgtaatcccagctacttgggaggctgaggcaggaaaatcacttgaacccaggaagcagaggttgcagtgagctgagatcacactactgcactccagcctgggtgacagagtgagactctcaaagaagaagaagaagaaaagataaaatgattggcatggacacagagagagacgccattacacaggctcatgcagaggtatagagatggaaagaccagagacagagacagaagcacacatggagagccacagagagacacggaggagagaggcagagagacacagttggagaaagggagagacaaagaggccagagacaagtgcagagagtggaacagaccgattcacagacacggccaaggcagtgagccacgtgcagaagtgggacagcagagacaagagacatgcagcaacgtggaaacagagagacagacacagaaacatggcaagagccacagggggacagtgaggttggagccttctgcctgcaggacaccagctcctcttaccacacatggggccctaatatagggacaatgtccctgcctcagagacagtggtgggtgggagctcaggctggtgctcaggtcccagagggctctcccttccctccccacaactcatttctagtttttgtaataggcctgctgcctcctgggacttgggtggtctgagaagggtcccttgcccccagatcccttgaaataggggcccatggggtgacttggcctctccttctggcttctccaactggaactagcgtccccctggagaatcctgggtgcctggcacaccttcctggagtggggcattattgctcaagacctagaagaaatcacccaccacattgaaatagacacagatactctacggaggagtgcgcagagggagtggatatcctataacatgagagatggccgaaggccaaattcagtgtataggcacattttatccaccctgccctggctctaaatctttttccttgtaattaattatggtggacactatggccagcccagaccccctcttcatggtcccaccccatcccctagctgtggttcacagcagtgccccatcctgcataattgcccaagataatgcctcttccagggagaccagatgattgtggtgcccagccctcttgtctcagtttggaacaactctgaagggtcatctcagctctgggctccccctaacatcagctttgattgcatccacgtggcaaacgaacttctccccacaagagcactccccaaaaaccttgtgctcaaaactccccgtctcagactctttccagggagcccaacctattagctgttaatatttaaaaatcagagctgtcacgtacacatcgagattcctgcatacgttgagaaatggggaatgtttttgctctgtttcccacttggcttggccaagtccctgccacccccttagctttcctcactcatgtgaccagccagcctgtgagcattgaagttggtgactctggcttcagagccttaaggggtgtggggtgtgcttgcttcagactgcacccttggctgtgggtggggaacagacaagttctacctcctttgcccatcagggttcagggggaagagttggaaaagcccttctgatgagatcctggcaggcaagttggtctcagccaggctcgtgtgtctcagctgtctcaaaggagggaaacaggaagggctcagcggtcttgggtggggcagatgtctgcagcccccagcctgggccagcctaagccacatcccctctctctgccctcacagcctgcatgatgaatgtgcacaagcgctgcgtgatgaatgttcccagcctgtgtggcacggaccacacggagcgccgcggccgcatctacatccaggcccacatcgacagggacgtcctcattgtcctcggtaggtggccctggggctccactggctcctgaccttgcttgacctgtgtgattgagaaggggagggtggcggaggggtggggcagtccagtggaggggtggggcagtccagggacggggagggggtgtggcactgcttctgccccatgccctgcccatgacagcccctccctgcagcagggggatctttagaaactgtacaccctcaaagcttcgtccatcagcaccccaggctgacttgggttcagagaggagacgtctgagttccttggacttctaacttcctcaggatcctccacttcccttctctccttctcatttcccactcttttttagtaatcttttgggatgggtagttgcatttcctttactcagatagcagagaagggaagcttgcttcttccgcaaacttttccagcaggaaaaatggagtcttgatgataaaccccagatttggagaatataatatcttgggaaggaggagggttggagggtgcaattcaggggctttccacatatttgaaatatttctttcttgaacctgatggtggctatgctgtaattttattattctctatattttctgcatgtctaaaatatttcatgataattagaaagcaggatggtacagtctcctgggagatgcagtgagaggaggagctgctggtggtggtggtggtggtggtggtggggctgtcactcatgtatcccagcattcaagacatacctggctctgatatgggaagttcaagcaaaattggaactcagcagcactggcttgaggaatactcagccataagccccggtataaccagcactgagctggctgggagtggagctaaaactttgcaggaatttcttctcaaaggctagtgacaaactactgtggactttatatatctaatgaatataaataagggtttatgagttggtaactcaggaaattgatcatggaagagattaattttgcaaaaattagtgtttctgaggcctcagactggttcagtagctctgatgcattgagccctgggttgcggaggggctttacgtagattgtgtaaaagctgaaaaatacttatccctgtacaatataattcttttaaacttgagatttcgtgaagcccagtgagattttagaaaatgtgcaatccattgcattatgttttcctccaagtggtcgcctgcctcccagtgtgatgcttgggggccccaggggaaatcccgcagtttcaggttcaagggaagccagttttccccactgattgaggttcccgatgctggtgagacaaatatgagactctgcttccctctggtgtcattctgtgggaaatacactcgttccaaagcatgactgcgggcagccaacatttatgggccgcatgggatgtgcagtgctctaaaccttacgtgttatctctttccaccttcacaacattgtgaaatctctattattcttgtttgagagggagactccatctgttgcccaggctggagtgtggtggcgccatcttagctcactggaacctccacctcccgggttcaagcgattctcctgcctcagcctcctgagtagctgggattacaggcgcccaccaccacgcctggctaatatttgtatttttagtagagacagggtttcaccacgttggccaggctggtctagaactcctgacctcaagtgatccgcccatctcggcctcccaaagtgctgggattacaggtgtgagccactgcgcccaaccttctattattcttgttttatgaacaaagaagccacggctcagagaagttatattccaagagctcacaccatttgcaataataataaaacaatagctaagatgtgtttagtttttaaaatgtgttaatcattgtgaaaagcacttacaggcagtatctgatttacattgtttcaacaactcaaatgagttaagttatcattctacccatcagaaaacacatttcctcacctaggtctgtttgactcaaaagtactatatagtaggttacttttttgtttagtttagtttcgtttcgtttctctatgccctccaccgtatttattccttttgtggtttggctagggcacctcctatgggcattccttagggagtctttgttctgatgtggtacagtacaatatttcttcaagttcaaggtcaaagtcttcccccttaatcatagatatgctgtgaactttgagaacctggatcacaagcccccgcttctcaggacacactgataggaggtgtatccatttgctgtggctgccataacaaaataccacaaactgggtggcttaagacaagacgtttaaaaaaaaaaaaaaagaaacgaaaagaaaaagaaaaaaacaataggccaggcacagtggctcatgcctataatcccagcgctttggaagaccgaggtgggtggatcacttgaactcaggagtcagcctgggcaacatgtcgaaacatcatctctactaaaaatacaaaaaattagccaagtgtggtggtgcacgactgtaatcccagctacttgggaggctgaggcaggaggatcacttgagcctgggaggtggaggttgcagtgagctgagattgcaccactgcactccagcctgggtgacagagcaagactccgtctcataaaacaaaaacaagaaaaacaaacaaacaaaaaaggccaggtgtggtggctcacacctgtaatcccagcactttgggaggctaagacaggaggattgcttgagactaggcgttcaagaccagcctggccaacatagtgagaccctggcatattgtaggatttcatttctttgggatgttcagagcaggcaaatgtataaagaagtttaatagcactttgtgcttttccaaatactttgatatcacaccattcgggaaagggcacgttgttgccatcatggaagggaaaacgaagtctcagcaaggctgaacaccctgaccaatgtcacatgctgagcaggggtgagcacctgggcctctggccccatgtcacaatgccctgcaattgcccatacaccatgctgggcacagcctgtactcagcatgggcttgttgattgatggatgatagaagagagccctgatgctgtggccgagttctctaaaaatagagccaagatggggattttgttccagtgatttattgggctgctcatgggaaaagagaagtgaaggaaccatgcttccttcctcaggcagggaaaaagcttggcgagagtgtggtctccgtggaagtcttcttcagcctggtatctggtggaattttgtaccaaacactgtagcacagtcagtcccatcttgaggcaagggggctgttctgtcgtgttccaggtcagtcagtgctgtgggatgacttgtgtctcccccagatttgtatcttaaagcctcacccccagtgtggtggtatttggagctatgggacctttgggtggtaattagggttagatgaggttgtgagggtggggccctcataatgggatttgtggatttctaagaggaagaagaaagagagatcattctgtctccaccaaaggaaggatacagcaagaaggtggccgtctgcaagccaggaagtgagtccttaccaggaattgaagctgctggtacctcgatcttggacttcccagcccccagaactgtgaagaaataaatgtctttttttctttttttctttttattttgttttagatggagtcttgctctgtcacccaggctggagtgcagtggcatgatctctgctcactgcaacctctgcctctcatgttcaagcgattctccggtctcagcctcccgagtggctaggattacaggcacgtgccaccatgcccagctgattttttttatttttagtagagacggagtttcaccatgttagccaggatggtctcaatctcctgacctcaagtgatccgcccgccttggcctcccaaagtgttgggattacaggcgtgagccactgtgccggcctaaatgtctgttgtttaagccacccagtccatggtattctgttatgacagcctgagctggctgatatagtcagttactgctgtaggctgctggggatggaggtgggaaggtagagtaacttcccaggtgaggaggcttctgtgcagttgaggacagttatctggacataggggtaactgtgagccattaacagccatcatacacagcacccaggggatgggtgcattggccagcatggaggggagctgggcagggtccaacagcatctggcacactcaagtttcccttggtctcctgactgtcttcctggtttcattgctgggactccagccccctcctccttggtcttggcaagacagatcagagaggagcgagcactaaaggttgtgcggggtccttcccagcagtgccaggccagaagtggccttgtggtgtttgtggaatggccccacctcatccagacccaagaagcatggtcagtattaggattttccactgaccatcagcccaggacactgccgtttgccctgagtgtcatatgttctttggaaatctcagcatctctagaggtcaaaggttttctaacttgcctggctactgaaattgagctcatatatctgttcttagtgttttggcaggtcaagatgagaataaatctgatcagttctcctccttttaaaaacccatcaatggtttcccattgtctttataacagactaaatctaacatggcgatctcattctttattcactgtctcctccccctttcttttaatccttggtcctctgcagactgccacacaccataagacatctgtgcgttctgtttagaatgtttgccattgccatcttctctttttctagcaattaactcttcctctcgatctcggttcatttttaccatctaataagcttcctccaacttccccctttcgtagacactcatggtaacctgagcttggccttgtgaaaggggtgattttatgttggatttgattaatgtctgcatctcatcacaaggcattagctccatgagggcgggactgtgtcttgccactctactcccagcacctagcaaggtgggcatcactaaatatttatgggctcaatggctgtatgtatgaatgagaaacccctggaggatcctgatagatagatataaggctttcactgatggtccccagatcagtgcctcctaaagtcaggaaatgaaggtcaacggattgtccaatttataccattattctcatgggaggtagaacatgcagaaaatcttaagtaccaggtccaacgtcaacagcaaatgttactgggactgagacccgcttgttggagtcatgaccacccttgttccctggacaatgtagaaaagacatggagcagtgggatttgtagtatcccaggaaaccgtattgacatcatgatgcccataggtgtcatgagatcaggcaatacaatgtccagatcagagttgtaaaatgctcccaaggtttgtgaagcctgcgtgttcatacatgcaacaataattttttttgtgtgtgtgtgacagagtcttgctgtcacccaggctggagtgcagtggtgcaatctcagctcactgcaacctccccctcccaggttcaagccattctcctgcctcagcctcccgagtagctgcgactacaggcgcatgccaccatggccggctaatttttttttgtatttttggtagagatggagtttcactgtgttagccaggatggtctcgatctcctgacctcatgatttgcccacctcagcctcccaaagggctgggattacaggcgtgagccaccgcacccagctaacaatatcttattcaatgctttttcaattcagtatctacctatcaacataacaactgacatctattatttatactcccatctacattacagccacctccaaatgcttagccatgtccatcctcatatctatctcccaaaagttgggagtgttcttaaagaaagcagaaagaacctttttttttttaaatgtttctctttggaactcccattctatattcttaccattatattgtgttatacagaaactttttagactgaaacatctccctgacagccttaggtactcccaatattgtgatatttaaatccttcttaagatctgacatccacacatcaaaagaaaaagagtaccaaagaggctgagtgtggtggctcacgtcggtaatcccagcattttgggaggctgaggcggctgtatcacctacagtcaggagttcaagaccaacgtgacaaaaccctgtctctactaaaaatacaaaaattagccaggtgtggtggtggatgcctgtaatcccagctactcaggaggctgagacaggagaatcgcttggacccaggaggcagaggttgcagtgagctgagattgcatcacagcactccagcctgggtaacagagtgagactccatcttggaaaaaaaaaaaaaaaagaattgggaagaaaaagggcaatgtaaacaagaaaaaaaaatccagatagcttaatatttatttttgtttaacttttatttgaactttggtgggggggtacgtgtgcaggtttgttatataggtaaacttgtgtcatgggggtttgtgtaatattgcccagccatgcgtcaattgcagacagaaaattattataaactaggccgcgagggcccactagggggcagtctctgccttcaaagccattcctcctcggaggctctctcaggagatgccccaatttgtgaaaccacagtactgtcattgctcataatggaaggtgcagcagagaccagctacgctcactgaggtccagagaaaggttacttcttcaggtcacacacagatagggcccagttctggtagatctcccttcccttttacattattggtttgtaattttttcccaagtctttattttgaactaagttgaaagaattttacagcaaacactcatttatccaccacctatattctgtcgttaacgtttccacacttgcttaatcacatttccaactatctcgctctccatccatcaatctgtcttatttttgacacatttcaaagtaaactgcagacaccaattcgatttcccccaaacacttcagcatgcccaacatcaatagaattcaaaatttacttgtagggtttcttttttttttttaacttttgaggtgaaatgtacatacaatgatacatacaaaattttttttttttttgagacagtctcactttgtcacccaagctggagtgtagtggcgtaatcacggcttactgcagcctcgacctcccaggctcaattgattctcccacctcagcctacaaagtagctgggactacaggcatgagccaccacactcagctaatttttgtagttttgtagagatggggttttgccatgttgcctaggctggtcttgaactccatggttcaagcaatcctcccactttggcctcccaaagcgctgggattatagatgtgagccactgtgcccggtgatgtcttaagtgtacaatggctgagttttgacaaatgcatatgactgtcattctaacccttatcaaattaattctcttttttgatgtcacagctgctgttgaggatccaagggaaggtatgaaccagagaaatgcctttatgtccccacacactgcactcatactcatgagctctggctattgggatgtctattatacctaaaatcccttagatgacatgaaacttaatagttgttcaattttttttgtttgttttttgaggagttataatgcagtaaagtagaaactttgaaaattggaaattcttgtttacaattttttgttatgtattcattgaagagcaaaatgcctttaaaaactcaatacacctgctttattttgctttttttttagtattgttgtaatgaagaagttcagttaaatcatatctgtctatggaacatctatcatctttctcagtgtattactgatagttgtctgcacaccccatgaggccaggggaagggtctcttgcccatccttccttcaaagcctatcagcttgttaggttgaggtgagtgtctcaggcactgaagttttgggatactggacctaaggagatgtagggaagctgacgtcttgctattcagtgttccttctcttcttccctggtcatttaagtctcatgagaattatcaaggccaggccagcgtctgaggccttcaggatgtgctgggcgcggtcattgctcccaaatgtctagggaattgcattgaagtgggcactgctgggacctgcagggctgtgacttgtgactgcctttggggacagtggtccagcaatgtctattaaaatatgtatacatatgaacattttgactctcacgttttcctttagggaatctattctcttaaaatgaaacaccagcgtgcaaagaaataaaatctagaacaagcatgtttattgatgttttctttgagatgcaaagaaaacatcagcctaatgaaggggtacccattttatgtgatactaggtagttgttgaaagcattgaattaggccaggcgcggtggctcacacctgtaatcccagcactttgggaggctgaggagggtggatcacttgaggccaggagttccaaaccagtctggccaacatggtgaaaccccgtctctactaaaaaaaatccaaaaaattagctgggtatggtggtgcatgcctgtaatcccacctgctctggagggtgagacacgagaatcacttgaaccctgcaggtggagtttgcagtgaacagagatcaggtcattcatgcactacagcctgggtgatagagtaagactctgtctcaaaaaaaagaaaagaaaagactgaattaaaatgagaaaatgagtataatttttgacatgggaactggttacacaggtgaatttcctttgtgagaattcaagctgtaagattatgatttatacacttttctataggtatattatacttcctatacttttattatttaaaagtttgtgataaaaattctaaataactaaaaacaaaacaccaatgggttagagctacagatattggtgtaaagcagaggttgccaaactggcctgctgcctgtttttataaataaagttttattggaacacagccacatccattcatttatatattatctatggctgctcttgtgatacaatggcagagttcactgcgtagttgtgacaaagcttgtacaatctgcaaaatgtaaaatatttgttctctggcctttactgaaaacatttggcagtccttgaactagaggaacatctatggttaagtgaaagggttaggttgcgtaaaaatatatttagtatgatctcattttgaagaaataagcaacagcaacagacacctcctatgtgtgaagttttgtctgtatattttataacctgtgtgtgaagaaaggtgtggaaggataccaaccaggttgtaaacactgggatcgcagcaggattgggagtgaagaggctgtggcggtgagggggattgtgttgtgtctctgtagttttcattacgtttcacaggttgattgcaatacatatcatttccgcaatttttgaaaaataaaaacagaaaaatctccaaataggaaaaatgaacagaaataaattgtctcaacaacaatagcagaaaaaaaaaatgaatggataatgccccaaatgatggggtgttggttgcttgaggagggttgttgggtggttctcagcttgagcagagctgggcccaggccctgtctgggtatttttgagtttttattgtcactagcttccatcttgtgtagcatctgccttgtgagctgggcctgttctccgagtttcatggtgtttgatgttttttgccttctttcagcaaggtcgctggcatcatccttgctgagtcgcatatgttctgggaaccacctcctcttctctgtgcctctcgcctggcaggtctacgctaaactgccccctgccctcccaggcccaccccacctccaagtctgagttctttgacttaaacttcaatcctgtttcccatgggctgtggcttcccaaccctcagtttcagttgaagctaatttttttttccagaaatcactgtgggccctggctgctctgggtgtggtctggggaccagctgcatcccatcggcattacctgggagctcgttagcaattcgggatctcagcttcccctccaggcctgctgaatcagaatctgcaatttaacaacatcccctggggatgcactgtaacattcgagcagccctgctgcagaggatcgcagtgagacgggaagaatgtgtcttttccactagatggcaggccttacctgcgcttggctcctgcgcagaccaccacaggtggatgtgccaggggtgatgtgaacctccagccccgcgttggccatggcatcttaccagtcatgaagctcgggtgtcagtcccgccagggctggaatcctctttcattggtgacctgcacctacctgcatgtcctggcctggtgcagcatgagcttctggcttgagccatttgtgtaaagtgacccagagcctttctttcttccctgctttgcctttgtcctctaccacctggaaggtgaaggcatgtctctggggagcttcctagtcattagcctctgtgttgcttttctggatggcttgctgcacgtctctgctaattttaggccaatgtggtctatgattacaaaggttttgcatgggctttggagtcaggcctgggtttgaatcctgcctttcccactcctccaacaagtatttgttgggggcctcccatgtgctgggcactgcttacaggcaaggcccctgtgctcatggcctctgccttctttctaatgatgggagatgaagaggaagcaaacaaaacactttgagaaaacaaggaacactatcaaggaaataaaataaagcggcatgatgtgatagagggtggccagtgggctgagtgtgattagcagggataatggcatttagttgagacctcagggaccagcaggagggagccagcttgctgaaaattccagggaagagtataccaggcagagggagcggcagaggcagaggccagagggaagagtgaagcagcaggcttgtgagtgacaggaactgacagccagtgggtgtgactggagcctcgggatggggaggggtgggtgacgctggaggaaaggcagggacagccagttaggctttgtgagccccatggtgggcttggtttctttctaagtgcatggaaatttagatcccaggagtatctgaaggacatcatgcaaggtcagtgtgtttaggccccaaaaccacccagtgggggcagtcattttgtttttctcattttacaaaggagaaaacagagccttgaaaaatctgagcctggtgtggtagcatgtggctatggtcccagttactcaggaggctgaagcaggatcatcagttgaggccacaagtttgagaccagcctcagcaacacagtgagaaaaaaagtcttaaaaattagctgggtaggcagggtgcggtggctcatgcctgtaatcccagcacttggggagtctgaggtgggtggatcacaaggtcaggcgttcgagaccagcctggtcaacatagtgaaacctcatctctactaaaaatacaaaaaaaaaattagctgggcgtggtggtgcgtgtctgcagtcccaactgctcaggaggctgaggcaggagaatcgcttgaacccgggaggcagaagttgcagtgagctgagattgtgccaccgcactccagcctgggtgacagagtgagactccatctcaaaaaataaataaataaaataaaataaaataaaatacaaattagctggacatggaggcatgcacctgtagtcccagctacttgggaggctgaggcgggaagatgacttgagcccaggagttggtggctgcggtgagctatgatctcgctactgcactctaggctgggcgacagagcgagaccctgtctctccttctaaaaaaaaaaaaaagaatttgagcacccgcctctagtccctaaggcagtgcatggaggaggctggatttgtaccctgggtccatctgtctggcaggttctaacacattaagtcagatgttggaaagatacagtttaagactatgagacattggaacataagaaacacccaccataccagtggggagaggaaggagatgcttcagcactggtagttctcatagtcttatctttcagtggctttagggcacaggttgggactagtttagccttaaggtcttggagaagacctgcttttcatttgcctgttgccccagcactgtggggtcagaatctttcttgtgatcagagtttagagaagggagggagcagtgggctggaggcattccaggtagccctggagaaggcaggagaggcataagttagaagggtgagggaagggaggagggccagtggctgacgcttactgagcccttgctgtgaacccagcacagtgctagccatcgtggggcacaaaagcctgtgcaagatgcagtcgcagctcctgagcagcctcgctgtctggttgggttccatctgctttaccactaccaacaaaaccaagggacggacacctcttactgatagtaaccaccaggcactgggcgaagcacgttgctcagccatgtcgtataatcctatcaacaacctgtagtcccagctacttgggtgggagagagttactgagggcatctccattttacagatggggaaactgagacacagagaaagaggttaaataacttgcccaagccacacaactaggaagatgtggagctgggacttgaatctaactatgccattccagataattaggctcttggacaccgtcttatcctggcactaagtacatcagtggagtgatgatgatacatgatattagtagcagccacttttacttctttcttttcttttctttcttttttttttttttataacagagtctcactctgtcgccaggctggagtgcagtggcacaatctcagctcactgcaacctccgcctccctggttccagcgattctcctgcctcagccttccaagtagctgggactacaggcatgcgccaccatgcccagctaatttttttgtatttttagtagagacagggtttcaccatgttggtcaggctgcctgacctcaaatgatctgcccacctcggccccccaaagtgctgggattacaggtgtgagtcaccgtgcccagccacagccaccttttctaaaacccttccaaatgcctggcttttgctaggaactctacaagcgttccttcaggtaatcctcctaacaacttttgctattacccgtagtccttctctccattatatggtgaggaaactgagactttgcttcatatgactccattttccccaacacttcctgctagcctgttttgctcctttgggagtatgagagtcagtgtttgctggactgtgaggctgaagatgataacatttcttcaaattggcctgttttttttttttttttttttttttttttttgcagaaagacagatttcactggccaagatctgcccaagaggctgaataaattcctaggttgtgagaagcaggtggatggagaagactttctctccaaacctccctgtgttaggaccagggaatgggttatgtgaatctggcaaccctgtcccaccctggacctgcaccctttaccactaccctggcacatccgggacctgcaccctttaccactaccctggcacatccgggacctgcacccttaaccactaccctggcacatccgggacctgcaccttaaccactaccctggcacacccgggacctgcacccttaaccactaccctggcacatccaggacctgcaaccttaaccactaacctggcacatccaggacctgcaccgttaaccactaacctggcacaaccaggacatgtgcccttaactattaccctggcacaaccgggacatgcacccttaaccactaccctggcacatctgggacatgcacgcttaaccactactctagcatcatccgggacctgcacccttaactactaccctggtctgcctccttgagtggcccagggaacatctagaagctgagagaaagagagggataaaaccaagttcacagcagtatcctaagaaagtgttctcacttaaaaatgcaaagatgctcacagagtgttcaggttacactggaaaactccagaaacaaagtggtttgtgtacatgggaggaagcagaatcaacttcccaccttagcattgtgggtgcttagcccacgcctgtgtatcgctcagggaatcagagtcactataagcatcatggaataagggatttactgtacacgttagaccttatacaagcttggagatgctggagacgggaagatctggaggggtgaattgagaatcagaggaagagcagtggtgcaggtggacaagtaggagttggtaggggatccaagaagccaagcacgttgagctgctgacatagatattgatgaatttcatgaagcttttacaggcactggtttcacccttgggtaactcagtacaggtatgttgacagccttccactaattcaaagatggttcataggtgtcccagaatcttttaattcccaagtgaggcagccccaactccttcagccatttactttctaatccttaatccacagcccacaacctcaaacacatgatagggccgagtatgccatcattgatgtcaacccggaactcttcctagacaacactccagttggagtagcttccttataaagcagggtgcccagagtgaaagagaatccacctgtgttgccgaggagcgaaggattgtcactttccttattctagatcagctgttttcaaacctttcggcttccagcccatctaggttttatgtaacacacacacacacacacacacacactgcacaaacaagcacaaactcacaaacacacacacattgcacaaacaagcacacactcacaaccaaaaccaaactgccattaatgcttacctctacttatgctcaccacacactctgatacattctcctctcttttgtggccctcttttctgttcatttccattctatttcctttaagaaaccctttaaggaaaatgctcttactctgcaaattgatttcactaacaattggcaaatgtgtcatgacccgccgcttgaaaaacactgtcctagacaacaaaattctctttctgcatcctgagatgatactactcttttggggggtctgggggtaccaccagccacattgcactgttgacttatcttgggtttatgatcagttaaagctctcttgtctatcacatcgggtgctgctagcctgcaggccccacatccttgtgcaagattttttttttttttgagactccaggatgaaacctgatgcatttcatcttgtagggtttggccttttgctccacggccaggctgagagcttttgggtcttcctgttcttgtgccgagtgtcttccggacatcaccttcctcacaccattctctgtgctacttgttctgccctccttacttttgaaaagatagtttattactcatagatgaggagcaggcgtgccactccatgaaaggccacacagggaagcagcagggtctgccaggaggcagaggaagcggaaagaaaacgtggcaggagcatttgctgctgtttctgtgagaaggagcaggtagggcgggaaaccagccttagggctggctggtttgaatgatctcagcagactctgggtgtagaggctgtctctctagttgcctggtacctgatacctggtgcttttacctggggtaattagcacaggctggcccagagtgtaagagccccatgaaggagttggttggaggtttgggctttggattggttggtttgcatatgaaaggtgcgcttgcaggtgagttctttactgtctctaggaatgggctagccctgggacagacagtttctccagggtcagcaaggctccgagacaccaaagcatcagaaatacagaaaatagagccaggtgcagtggctcatgcctgtaatcccagagactcaggaggctgaggtgaagaatcacttgaggcaaggagtttgagaccagtctgggcaacatagtgagacccctgtccctaaaaaaaattaaaaataaaattacccaggcatggtagtgcagcatgcctgtaatctcagctactcaggagactgaggaaggaggatcactgaatccaggagttcaaggaaagaggccgggcacagtggctcacgcctgtaatcccagcactttgggaggctgaggcaggtggcgagtgaatcaccaggtcaggaaagggagaccatcctggccaacatggtgaaaccctgtctctactaaaaatacaaaaattagctgggcatggtggcgggcacctgtaatcccagctactcaggaggctgaggcaggagaatcgcttgaacctgggaggtggaggttgcagtgagcaagcgagactccgtctcaaaaaaaaaaaaaaagacataaaattaatagaccttagactattttatttaattattttatcaaaataggataggcatagttaaaaatgccaatgtgcattggagagctgaggatgaaaagcaatgtcctgtacttgagcttgcatcagaatcatctagagagtgccccaccctcagagtttctgattcagtagacattgaagaatgagaatttgaatttctaacaggtccccagagaatgctggtgtgttcacactccggttaccagaaagggatcccgatccagaacccaagagaggttcttaggtcttttgcaagaaagaattcgaggcaaatccataaagtcaaagcaagcttactaagaaagtaaaggaataaagcatggctactccacaggcagagcagccctaaagctgctggctagccacttttgaggtcatttcctgattatatgctaaaaaaggggtggatttttcatgagttttctgggaaaggggtggcagattcccagaactgaggattcctcctctttttagaccatgtagggtaacttcctgacgttgccatgacgattgtaaactgtcatggcgctgctgggagtgtctcttagcatgctaatgcattacaattactgtataatgagcagcaaagacgaccagacgtcacttttgttgccatcttggttttggaggattttgacctacttctttaacacaacctgttttatcagcaaggtctttgtgacctgtaccttgtgctgacgtcctgtctcattcagtgacttagaatcccttaacctcctgagaatgcagcccagtaggtctcagccttattttacccagcccctattcaagatggagtcactctggttcaaacatctctgacactctgagaaccactgcattggaagacactattttcaactctttaaactctttcttccagcacttgagctctaaattttaatcatgtgctctgtctctctgtcatttcactatttcatggctctgacttcctgagaaggttttaattctctgatgtgatccctctagttctcttcccctcacatccagcacggggttactgccatttgtagttcactcactcaaaaaaaagtgattattaagcatcttctgcatgtcaggcattgacttagtcactggagatttgtcagagaacaagccaaagtcctgccctcatggagcttatattttagtgcagggcttgacaaactttttctgtgaagggccagatgggctttggagctatctggtcactgtcacaactacttaactctgccattgtaacacggaagtggccacagtgtgccaatgaatgggcacgggtgtgtgccaataaaactttatttacaaaaacaggcaggaggctggatttggcccttgggctgtagtttgtagacctctgttgtagtgtgggagaagacaaagtaggtaaataagtaaaatacgaacagtaagctaaggggaaaaagaaaaaacggaaaaagaggatgggaaggaggcaggaggggactggacctgcacatttagatatggtggcaagcaggcagtcactgagatggggacattgagtaaagactttcaaaggagatgaaggagggagccatgcatctccctggcagaagagcattccaggcacagtaacagctggtgcaaaggccctgtggcatgagcatgttcggtgtgcttgaagaaacagcaaggaggctcgtgtgtctaagtggggcaagtcaagggaagggagcaggagaggaaagcggaggaaacagagaggcagctgctgagggctatgtgattcttgggagggaatttgtcttttctcttagtccaatgggaatccattattgtgactctagtagttgtaatagttcctttaagttttatttatttattttagatacaggttctcactgtatcactcaggctggagtacagaggcacaatcactgctcactgcagcctcaaactcctggcctcaagcaatcctcctgcctcagcctcctgagtagctgggactgcaggcacacaccaccatgcccagccaaatttttaaaaattttataatagagatgggatctggctatgttgcccaggctagtttcaaactcctggcctcaagtgaccctcttgcctcagcctcccaaagtgctgggattacaggtgtgagccactgaacctggctatttaagttatgtatttgcaactccatttcttgctttcccaatggtaggcaatatctcttaactttgtcttttgtagagcatttttatatgcatgatatcatttactccctatgagatgtgactattgtccctattctgtagaggaggcaactgaagctcggaaaggttaaatgacttggccagattcatatagctgataagtgctggtgctggaatttaaacccaggtttgtcttaatatggagatcttagcacctattttatatgaagagacaatcctttagggatactggggaaacctgtggcttttggacaataaattaaaaaccctttcccaagaaggggagctgtgtgtgtatcaatcaaacaaaatgagaactattctgagagggaggaaaaggttcttttctgtgggaacgctgaccaagccgttgacagctcatttatgtgatgctggtgcagtttgacattcatagtacaagacttgcatgcaattagcacgaatcgttctaacagtctcttgaaaacatttggaattttccctctgtctggccttgtgcatgatgtaaacatggctttatttagttggtcatccatcccagaatagtgtggtctgcatctgtctgcatcactgtggtctgattgaggtcttgttttcctggagggcagagactgttgtgtaggcttgctttgtggatcctcctcccccaggatcattcgccacaaacccgatggcagcctctctctttagctcatgacaatttctccaagtgtaagctgggggtcccgttcagtatgcaatgcaaatgagatgcaaatgaggggccctcttgggcacaggccaggaggccagagctctggggacttctgtacccctcctctgagttgcctaatgaagctgaccgttcctttcacaatcatcttctccacccaccaaaggcctcttaatgagggcagaagctgactgctctgaaaccccttcagacacctggtgattggaagctggagagacagtgagctttagatgggctgtcagccgctgctgagtcctcatcagctgcctgctgggttctgagaagcactagggaaggaagggagatggccctggaactgactgctattgtctgttcctcctcccctgacgagctgcatgcggcagccacggatggctgggtttgggctttcacgtcggcttctctggcccttgctggatgcctgcttcagctcagagaatgtggcttcacagggacttggaataagagctgagagcctgttccccccatcgaggatcaatgctcctttgatttcatttcttctttccagacgaatccactgtcttagcccgttgttggagaaatcccgacctaagcaggctttcaaattggggaaagaaaagtgaaccaatctgaaatcatggaatggttggtggagaaggacaagtaggcatatccataaagagccagcagtcccaaaggatgttccagtgcatctttctgcttatttcttctagttttgtaggggtgtgtggtgtgcaatgctgtttgcttgacagaatcctttcagtctctctctctctcgaaatataaatttcctgcactacaacagcctactaagtgccagacacagtgctgggctctttacctgcatcaacccattttgtctccattgacaaaaggggaaactgaggctcagagaggttaattgacttgctcaaggtcaactgggcttctgtgtggcagaactggagtttggtcccaggtctgtttgcatctaacacccagccccttaaccactttgccgaattgagaatttggaaattaaaatggtgatttcaactcagggatgggtgtgctttctttcagccttgcagtaagtgcacatcttctttctcttttcctctttgaagctgccagcctctcccttggggttctccttggctctggccatgatttccccagcttcctcattcatacctcctggcatcagactgacctgggctaatcaccatctctgcctgtcactagttcaagaggcagcttatggggacttgtgggtcatacaggttcccctagaaagatgatgggcagactgacattgggattgaaatgtcttgtctccagcgttcttgaataggggcaacaatgcccactgggtctccaggcatggggtctaaaagtgaatgcaaaatacctgtgatacagtgtggatgttttatccccaccaagtctcatgttgaaatgtgatcctcggtgttggaggtgaggcctcgtgggaggtgcttgggccatttttgggtcatggggcagacacctcatgcctggcttggtgcactccatgtcacctaaacgagttctcgctccatgttcactagagatctggttgtttaaaagagtctggcacctcccctctctcattcttgttcccgctcctaccatgtgatacacgggctcccctttctccttgtaccatgattggaagcttcctgagtccctcaccagaagtggatgccagcaccatgcttcctggacagcctacagaaccatgaacaaaaataaacctcttttctttataaagtacccagcctcaggtattccttgagagcaacgcaaacggatgaacacagcctatttccatagccttgctattggtgagtcttgggcccgtggtgcatgcacaggggccagatccagcccttaccccaagagcagattcaaacgtgtctttccctgattatttatggccactaaaatggaaggtgatggttgtggtgggtgtctatgatcagggctcaataaatatttgttgaaaacaaaaatgtaaacaagaaaaagacaggaccttgtcaacaagtgttatatagttgcagatctttatcttggattgttcagactctgcccttctctggcaggcacacttttgggaatgggaagggccaacagtgcttctttggtcccattagatccccatgtcagccctatgaaataatactatcccatacttactactatttcagctttacagaagggaaaaatgcagctcagagaggtgaattcacttgcccaaagtcccatcgctagggagcgatgggatttgaattaaaaatgcagatgtgattgattctaaacgcaggctgttaatgcatagctttcctggggaacaaaaagagctttcctttcatacctcattcattcattcattcacttattctttaatctcttctgtatgggaggtcatttgctagatactggatggctgtaggaatgaatatgattctttacacgctgagtatttcatagccctactaagagagaagaagagagagctcactataaaaggggggattggtgaagagataatggagtaggaagcacatgctgtgggaggtgccaggggatgagaggttaattccaacccatggggttgtgataggcttcacagaggcaaaggcagtggacttagttctggatggggcagagatctaacgcttattgatggcttgccccttgctaggactcagctcggtgggcgctttgtctattttctactttgaaagatgaatagaaactttgacggtcttttgccctctgaaatccactcttcacacccagccacaggaatctttctaaaatgtaaatcaggccatgtcacccccctgcttaaatgattccaagccttctcagagcttccaactgaaacctaaactcctcactcctgctctaagagcctgcagattctgcttccttcagcctctttccaaccttgtttgttcttttcccatgatagccacatctctgagccaacaaatatttttccttccttcttgcacttgctcttccctcagcttgggttgcttttccttgggctctatgtgttgccaactttccagtagccttcagtcatcactaaatgtcaccttctcagaaagcccgcctctgagtcttatctgaagaaacccctcccagtcactccctatcccattactctgtttgcatttgtttatttatttgcttcttgcctgtttctctccactggatggagagcaagaaccttccttattttttatgccactttgtgctagtgcagtgcacaattgacatgtacagatgcacaattagagtttgctgagtaaatggctaaataggttaaaaaaaaaaaccaaaaacggtgggctgctaggcagaagtgtaaccacacaagtgaaccttgaaagttaccatgaaacgtaaccttcatgccctgtgaaggtgccttaggtttctggtgtgtttggaccatagattgtagctatgaagtctgattaatgcctgaatcagacattgaatgacctgaataaatagttaaaaagttggacttctaggctgaagtgtaaccacatgagagaagcatgaatgttaccatgaaggtgcctagggtttctggtgtgttcagaccatagattgtagctatgaagtctgattaatgccagctcacagaagagcttgctcaagcatgctagggatttggtgagccattgtaggtggtaatgacctgatctagttaccatgggtgacaattaaaaagaaggattaaagatgtaagggactagagctgtagagacccatccaggagctattgatccctgtaggatggaggagatgaaacatacatgaattaaggaagtggaaggataagaataaattgatgtagaggatcagggagaggatggaggagtcaggactaacagagatttctgactcaggaagacatgtggatagtgagcgtgatagccaattagggttagaagtcacagaagcttaccagaagggaaaggtaatcatcttgctttagtatatgttgagatgtttttgggttgcatgggtgactgtgtccagtaggcagatgaatctgtatatccagagatccgattggaaaaacagagccaacagtatggatgcaggggtcaccggccctaacagtggaagctgaattctttgagtgggtcaggaattagtgcagcactgtaagagcaggaaggttcaggctctgggaaatggagccacttcagtcatcagtggagcaagaggagccagtgaaggagaatttaaaaataatgcttttaagtccaggtgcagtggctcatgtctgtaatcccagcactttgggagtctgaggcagaaggatcgcttgagcccaggagttcaagaccatcctggatgataaagggagactccatttctacaaaaaaaaattttttttttttaatgtagccagtgtggtggtgcatgcctgtggtccaagccactggggaggctaaggtggaaggagcccttgagcccagaagtttgaggctgcagtaagctatgatcacagcactgcactccagcctgagtgacagagtgacaccctatctcgaataataattattattagtagtaataattatagtgcttttagagaatgaaggggaaccagccgagtaaatggtcatagaagccaagggaagagagaattcaagaaagtggatatggccaacaccttagatgctgccaactggtaatgataaacacgaggctaagaattgaacagagtcactggatttggtcatttaacttagggacttgggaagtgctctttcagtggcatagtaggagttaagaggcaggatgccggaaagcctggatgctggatgttgaggagggaattgaaggaggggatgtggaaagaggagtgtagacaactcatgagaatttgggttgtggaagaaaggggccagggaaggcgtcttagaaggaagttatttctgagaggcatctgagcaggtttatagcatgaatggaagaaagcaaggtgcctgggaatagggataggaattaagcagaagcggtcctaggctttgtcttcaggaagataggtgttcaagtcccagctctgccacatgctggctgtgggactttgggcaagttaatgaagccccatgagtctcagtgtcctcatctggcgagcagagagagtagcctgtaccttgcagagtcatggcaaggatgaaacaagaatgtctctcagggccttcacagcgcttagtgcataatgaggggttagttagtgaactcctaccaagctcctttgtacagggcatttagcaaagacgtcagtgaccctgagaatccctagtctaaggtaggtaccccttccctaagcgctgaacttcctcccttatgcatgtatcacatctacaatgtttccttgtgtagtggatactgtggtgtgccaccaggatccctctctcagcacagaggcactcctgccccaagccacgcagagtattggctctgaccactcacggcttcagtatttccgtaggatttgccctgagggagctgcagtgcccaaggttatgccctcttccaggggcagctcacagtctatgattggttgctggtggggaatgggcttataaatgctcttccccagcctcagtagggaacaagtctaaggggccatcccagctacagagctccctcatggatcaggtgacacctctgttgcagctacattgcagttcagtttctcgatttcatcctgcttcccccattccttgcaggagttcctcccaaggttattccctgagaagccgcctgcatacaatatccagatcagtcttttttcagggaacccgacttaagatgccttgtttaatgtttgtatcttttctctaaaatataagctttttgtagggactgactattctgtcttgttcattttgtgtcaccatgtctaggtacataataggtgcttgttaataatttttaatctttttttttttgagacagggtcttgctctgttgctcaggctggagtgcagtggcatgatcttggctcactgcaacctccgcctcccgaattcaagcaattcttatgcctcagcctcccaagtagctgggattacaggtgtgcatcaccacacccagctaatttttgtatttttagtagagacggggttttgccatgttggccaggctgatctcaaactcctgagctcaagtgatctgcccactttggccccgcaaagtgctgggattacaggcatgagccaccacatgcggccattaattgaataagtgaatgaacaggtttcctaaacacacacacaggagtgccctgatatatacagtttttcagagttgtgattagagaataggttatctggaagtgccttcctgtgggagtgtgagcttgcataggctcccccagcatggagccatcactagcaatggctgtgtcttccacgagctatttccagggttccatcagcaaacagtggtcacgatttataaaacgttcacacaagaacatttgggctgcattctacatcattttagtacagagaggttgttccttggggcctttaattttctagctttcattattgagagagtaaaatgtatcacttgcattccaaaattgatttttatttcccaaaagaagcccataaaaataaataacttcccgggagggaaaacagaaaagcactctatacactgggcaatttgttaaaaaagaaaagaaaaggaaaggaagcctggagcgacaaagcaatctaaacatttagattgtatctcttgtattcccccactccccctgcaccttaaataaataaaaaaaaaaaaaaaaaaaaaaacttgaggcctgctggactttgaaaatgcccatgttgttgagaaaactctgttgggcagcttcatgggacagcatcctttggagcactgcctcatggttcacacccctggtatcccaacccactgctatgttgttattagcaagatacgtttccagtatctcattactaattgtatcagtaagcatttgctgtgtaacaaattgctgcaagggtagtgggcttaaaacaacattctttctctcaattttgtgggtcttctgggaggttcttgtgatctgggccagcttgtctggggctggagggtctgtgaggccctcactctcacatctggtggttggctcagtgtcagctggagggacagggatgccttggccattgcctgccaccacccagcaggctagcctttgcctgctcactggcatctcaagagcagtaagtgagggcatttcaatccaagccccaattcccaagcacttttgaggattctgtttgcatcgcattggctaatgtcccagtcacatgaccaaacccagatgcagggaatggagaaacgaattgttgttctttccttgacattttactttctcaagtataaaggggggtttgtaggcaaggaagatgccaagtagtcccattttatagctaataaactgagaaccagagaggttgagcaactggtctgaagtcacgcagcaagcccagaacacactgggtaaccaatccactgggggtgagttcaccctgtgcagccacatttgatctccccttgcttcattccctccagcactctggcagccaggaggacagctccctgtggggactgtgacattactggcccctcactcagctcttcttgtgccaattagaatgcatacttatttttttttgcaggttgtcctttgcttgcatccctcacctcccccatccactctgtgatcttctctgtggctcaagagcctgactccttcagagtgcatgacatgggctcttttcctttttagtttctgattgagttcaagcagtaagaggcattgattggcaagagattgtaggatggtaggaatgagaagatgcggcatttctgtcccaattcctctgctcttggctgtgtgtccagcagtatcagaaggccccttctctgtgtctccagatttcactgggctctggtaacactacttccttctttggcctcttcaggcctaggggtagcaatgacatctcaatgctgctactctctggatgtctcaccatgcgttgttgatccctttaaccctgtcttcacatttgtgagtagtaccttaattaaaatctctagagccttctgaattggattctgttttctgcttgcgcctatcctgatacactttttttttttttttgagatggagtctcactctgttgcccaggctggagtgcagtggcatgatcttggctctctacaacctccgcctcctgagttcaagcgattctcctgcctcagcctctcaagtagctgggattacaggcgtgtgccaccatgtctgcctaatttttgtatttttaggagagacagagtttcatcatgttggccaggctggcctcgaactcctgacctcatgtgatccgcccgccttggcctctcagagtgctgggattacaggcgtgagtcaccatgcctggccactgatgtactttcactgggttccattttttttataaggggagaaagaatggagtttgcagcatgcgcttagggaacccagtatcatgatgatagaggagtgagtagcctgcatgaatgctgctgtggcaggaagaatgtttgagaacttgagcactagagtgtgagatttctggttgtcttggctccattcagggaattcttaggactctgggaaggacataccaggatatttatggcatcactgtttgtggtggcaaaaagctaatagcctcctgaatgcccgtttttgaaggctgaacatgttgtagtctgtccatgctgtggtataacttgcagttgaaaaagaatgagtttcaaactgactgacatattgttgggtgggaaaagcattttgcagagcagcgtgtatagtgtgattccgtttttgtacagtaaccctcccagtccatttgtttctaggtgattgtctcagccaggagaaaggtaggaaagagtaaacaccaggttgccgtccttcttacctggcagttggggaggaggagaaagatagaatgggaaagcaagtaggtaaagggagcttgaaaaaaaaatcatagcaaatgggaacatacacatagatttaatttggtgtcccttttctaactttttgagatagatatagcattgatttttcagcctatcttctttcctaatatgtacattaaggctacacattttcctttaagcacagctttagttgactctcacaagttttgaatatttttgaattttcatgatgatttttcctatgatttattcaaaagtgtatgtttaattttcaagcatttgtaaatattctagttatctttttgttattgatagtttgtttccaccacagtctgaaaacatacataatttcattcatttgacatttgggtaaatattccatgtgcacttacaaagaatatgtatcctgtgtttgttggatgccatattgtgtgtgtgtaaattagtttcgttagttgtgttgttcatattttctatatcttgtttgatttttattttgcttgcttgttctgttactgaaagaattggatttaagtctcctattatgattctgggtttttttcctttcagttttatcaatttttggtttgtatattttgaagcaatgttattattataaaatataattgatatctcctcggtgaattgatccttttatcattctgaaaggtatctgtttatctcaaataatgcttcttgccttaaagcctactttgcctcttgtaaatataccagttttcttttggttgatgttttatgatgtgtgtgtttatatgtatatacatatatacatatatatagaccgaatatatgtattatatatgttttatataatgttttatggtgtgtgtgtatatatatatataaaaagactgaaagggaaaagggggaaatatatctatatataaaataatataaatatatatatatttttcccccttttccctttcagtctttctgtagccttacatttagagtgtgtcttttataagcacaatttttaatacagtctgacaatagttgattttaattggagcatttagaccatttacattttatataattgctgatatatttgagtctatatctaccacttcctatgatttttcgtttgtcccatgtgttttacattcctttttctctttattattgccttttggggatcacttaagtatattttattatttcatattcctttctattaactaattagtcatgtattgtttttattatttttatattgattctagagattgcaatatgcatctttggattttagaatttaatatattagtacttttattacgttccaaatgatcctaggttctttaacattttagtcctgtttaccccatcctaccatacacattgtaattttacatgtgatttaaactacattatgataatgcttcatataatcagcatttacttggatttaataatatatttaccctttctgttagttttcattctttcttacattttcacatttccatctgggatcattttctttctctctaaagaacgtcttttattatttagtttaggcctgctgcaaatacatcttaagatacttgtatttcaagctgggcacagtggcacatgcctgtagtcccagctattcaggagtctgagacaggaggattgcttgagctcaagacttcaagtccagtctgggcaacatcgtgagatcccatctctggggaaaaaaaatctttatttcacattcacccttggatagaatttgaaactggctgttattttctttcggcactttaaatataccatcccgttgttcttcttccatcatttttgttgattttgtcagtcttattgtggctcttttgaagtcctattgttgcctttatgcaatctgtatgattttagattttctctctctctttgattttcagcaatgtgactgtgatgttcctgtgtgtgtgtgtgtgtgtgtgtgtgtgtgtgtgtgtttgtatgtgtttatcttggttggtgtttctttacttcttgcctctttaacttgatgtttttcattagtattttcttgtccattgtctgccctatccttttctctccttttcatgcttgactttgattatatgtatgttagaccttggtactgtgtcctctgtctctgacactctcttctgtactctctgtctcttttaatctttatgccatagtctgatttttcttaataatctgtttttcagctcactgatttgccttctaactgcttccaatctgctgctaagccatgcattgagttattaattttaagtattgcattttaaataaactttttattttagaatagttttagatgtacagaaaagttgcagaggatagacttcccgtatacctttcactcagttttccattattaacacgttacatgaccatgacacatccgtcaaaatgaagatgttaacactaattagtactgtattgttaactaaactccaaactttatttggattttccttttttttttcacgatattcttagtgtattccaggatctcatgtaggataccaaattacattaagttgtcatgtttcctaagtgtcctctggtttatgacaatttctcaatcgtttcttatttttcatgaccttgacagttttgagaagtactggtcaagtatctggtagaatgtccatccacttgggaattattgtatgtttaattctaaagctttcatttgctttatttagttattttgagacaagggtcttgctctgtcacccaagctggagtgcagtggcacaatcatcactcattgcagccttgaactcctggcctcaagcaatcttcccacctcagcctcctgagaagctgggaccacaggtgcatgccactgagcttggctaatttttaaaaatttttgtagagatgaggtctcgctgtgttgccccaggctggtcttgaactcctggcctcaagtgatcacccctcctcagcctcctaaagtgttgggattacaggtgtgagccactgtacccagtcagtttcttttttgtaaccaatagttctctggtgaaactttccacattgtcatcctttctcccttcttttaaacatcttaataagttattttaaagttcatgtttgataattccagtgtctgaatcacccatggatctgccctcttgtctgtttttttaaaattttttagacgggatcttattctgtcacctaggctggagtgcagtggtgcaatcatagctcgctgcagcctctacctcctgggctcaagcaatcctcccacctcagactcctgagtagctgggactatagatgtgtatcaccacaccccactaatgtttgtatttttgtagagatggggttttactatgttgtccaggctggtcttgaattcctgagctcaagccgtctgcccatgtttgcctgtcaaagtgctgagattacaggcatgcatcaccacgcctaggtgttttttgcttctggtcctatttcttggcatgtttggaagttttgtttgaatttcagatgattccttgctaaattagaaagctgttggacaggtgtggtggctcatgcctgtaatctcagcactttgggaggacaaggtgggtggatcatctgagatcaggagtttgagatcatcctggccaacatagtgaagccccatctctaccaaaaatacaaaaattagcctggcatggtggcacatgcctgtaatcccagctactggggaggctgaggcacgagaatcacttgaacctgggaggcggaggttacagtgagcctgggtgacagagcgagactccgtctcaaaaaaaaaaaaaaaaaagagagagagagagagctgaggaagaggttattttccatgcaggttggggtcacccttctggtggtgatcgagctcactgtgtgctggtttatagccttcgtaaggtttgttctatttctggttcatttccactcctatggtgtagaggtttccaactctgaggctgaagacttgccagggccctccttttaactgggtcctgaaccccaatttttgtttctctagcaccataagcctgacaaaacctctcagctgatttctgttttgtgtctcaacctctgcagtgtgattggtagagactcaagagaaaaatcaatgcctagcgttgagttcacttctctgctcttcccctcccactatgatttggcccctcaagtcctgccttccctggaagctttgattcctagccccaagaataagcttcaagctctggtggcctccctccttcttagcaggtgccctctgtctagcttcttagtcctttgccctgtgttgagaattgatttatggcccaaaggaaaaaaaaaaaaaaaccacacacagaatattggacttatcttaattctaattccttcaaaattccagtttcttgaaaaatattttttatctggcttttatagttgctctcagtgggagagctactttatcattgccccaagtggtatgatattaaataaaaatataaaatacaaaatagatttagagtggtataattatgtaaaaattgaatgttaacatggaaaaagaccagaaggtgaatatacaaatgaaagcatttatttaattttgggataagatctaaggtaatatttgtttggttcagaaaattatttttaaagaagggtgttgtgagcatcagtgatagagtgaggaatcctcatttctttcagatcctggtaggggaccctgagaactttggggagtgaagatagtgaagtaaaggttgctaagcattctgctagaacactatggagacagcgatataaaataagagccaataataacaaagtagcacatagtgaatgtttaccatatgccagacattctattaatttataatgattgtaacattcctatgagccaacatccttatcattagccccattttttaaacaaggagactgagttaccgagaagttaggtaactttcaggtcacaaagctgctctatggcagagctgatctgccaggatctctgggtttaagctcctcaccatcacacttgactaatttggtatagaaagtggctttagatcagataagggtacatgaaatgcaggaggtgccgtgttagaggacagtttggtccagtccccatgtcctggggcaaatgaagcagatggcctcagaacagcctgtttttaaatcatgtaagactgacttctttcagctgctggattcctgcctcccagagtgagacgttgaagtttggcccggaagaggctgagcactggggacgagcagtgctgtgctgtgtatagagtgcttaaaacagtgcctgggtctgagcgtggtggctcatgcctgtaatcccacctctttgggaggccatggtgggaagattgcttgagcccaggagtttgatttcagcctgcaacatagtgagaccccatttctacaaaaaattttaagaagtagtcaggcatggtcgtacacctgtagtcccagctacttgggaggctgaggtgggaggatcacttgaaccccaaaggttgaggctgcagtgagtcgtgattgcactactgtactccagcctgagtaacaaagcaagactttgtatcaaaacaaaacaaacaaaacaaaacagtgcctggcatatagtatgtgctcaataaaagttgtcattgttattgtcatgacatcatcagagcctagaacaaatcacaaaacctgtatattctctctgggctggaggtcttaagattcttctccattcccaacgggtactcccgagatgacgtgattcatggccattccttccttccttcagtgtgtggctcacactgtgctgggctatggcgtcaccactgtcaatacgacaaataaatggataattacagcaaagtgttaggactgctgtgccagacacgagtgcaaggtgtcctgggcaaccagggaagggacgttaacttacactgggattggggccctgtgatggtaagcttttcatcttgcaggaaaccaggggatttttttttttttttttttgagacaaggtcttgctctgtcgtccaggctggagtgcagtggcacgatcttggctcactgcaacctctgcctcctgggttcaagcgattcttgtgcctcagtctcccaagtagctgggattacaggcatgtgccatcactcttggctaatctttgtattttcagtagcgacggatttttgccatcttggccaggctggtctcaaactcctgacctcaagtgattcgcctgcctcagcctcccaaaatgctggaattacaggcatgagccgttgcgcccggccttgaaaccagggaatttaatgacatttaaaaatcatttattaagtatatatgaaatatatagaaaatagtatcccaggcacctaatagaacagaataataataatgactaggagttgttgagtgtaaaataggttgcagtcattacaacgcatataatagcatgaagtatatagctcctcagccctctcagccatcttatgagggaacactgttgctattctcatattacagatgaggaaactgaggctcagagaggttaagtaatcctccaagcctccgcagccaggaagtggtatcactttgaactcaaactcaggtctgtttgatcctgaggccaagcccttggccagaaaaattaggaagtcatagtcccttcccttaaggagctctatttaatatagcagaacaagtaaagcaagtacatatctctctaaagtatactgtgtcactgaagataagaaaggaagaaatcctgtgatgggtcagatgaagtcaggaaaggcttctgggaagaggtggccttatagatctaactagaaggatgaatgagctttgggccaaaggcaagggagggaaccatctggacaaagggtagttagtacacactgtgacctgaagagggagctcaaagcccccctccactccagggctgatgtgaggatgtgagttaaggacttggatgctgctcttggggctttcagagataggggaggagcttaatgacctcgtcttcatgatataccctaagcattctctcttggctttccatttgagacttactctgccttcagacctctcagaactctgcatatctggtatggtaagaggagcctgagctacctcttctctgcattgccttgaaaacaaaacatggccgggcacgatggctgacgtctgtaatcctagcactttgagaggccaaggcgggtggatcgcttgagctcaggagtttgagactagcctgggtaacatggtgagaccctgtctaaaaaaaaaaaaaaaaaaaaaaaaaagacaaacaggactggggaaaaggaataagaggagcccgtccaaccttccaatttccaccaattttaatgtggatccagaattgagaatgctagtctagctcaactcaacagggccagtggttctacttgtgattgggggtaaaggtcctagggtagtaaagagagtgagtacctgcctggcttgtccgctctgcacatgtctctgggcagtagctgtgggatgtggtcctggacactagatcccatctgtctcctcctatggaggcaggatcttacagggaacagccggcagccaaggctagctggagtctggcctacaccatataaggagatggtgcaggaaaggctgaaagttatggtgggggccgaagagggcgttgagttgcagtaaccatgcccaagcctttgtggagttaatgatcacagtggacacattctggaggggtcgtcggcatcactgggccctgctccaggatctcagcaaggatgttattattatcatgagggtgcccaattcagtttgctacttgtttatgggctgattgcaatttggatagagtttaacccccaccccacccccgccttttgtttttaaaaatttgctgaggtgaaattcacatgacttaaaatgatctgttttagagtgaacagttcagcggcatttagtacatgcacagtgttgtgcaaccaccactgctatttagttccaaaacatttccatcattccaaaataaagccccatactgattaagcagtgactacccatccctgccttctcccagcccctggcaaccatcaatctgcttttgtttttaatttttttgagacagggtgtttctctgtcacccaggctggagtgcagtggtacgatcatagctcactgcagcctggaactcctgagctcaagcaatcctcccacatcagcctcctaagtagctgggactgtaggcatgcaccaccatgctcagataattattatttttattttttataaagatgggggtctccaactcctggcctcaagtgatcctcccacctcagcttcccaaagagttgggattacaggtgtaagccaccacaaccagccaatctgctttctttaactctctctttctctctctctctcttttttttttgagatggagtttccctcttgtcacccaggctggagtgcaatggcatgatctctgctcactgcaacctctgcctcctgggttcaagcaattctcctgcctcagcctcccaagtagctgggattacaggcctgtgccaccagaccgagctaatttttgtatttttagtagagacggggtttcaccatgttggccaggctgatatcgacctcctgacctgaggtgatccacccgcctcagcctcccaaagcactgggattacatgtgtgcgccacgcacctggcctaactctctctctctttttaaggctgtttaaaaatgaaactattcagtagctcaagtataccttactgtaaagaggaagtatttatgcagtgctcagtcatcttgatcagagatgattatcaaaacatcaaaatatctctatgccagctggcaactaagaaataccaccagatgtcctctgcctctctggccttgttagtttcttctccaagagcccttggatgtgatctgataatgaaaaggtgaatgtctagttcagtgggagccttcacatctaccccagggctttggctgtctccaatctgatggataaaccgcttgctaaatattttgactatcagccctgtgattaaggtcaggattagaactgttgtatttgtaagaacctctcctaaagatggcctcccattgcccacctgtttgaatcctacctgccttaaacatttttgccatttttatttatttcttagaaacaggatcttgctctgtctcccaggctggagtacggtggtacaatgttggctcattgcagcctcagactcctgggctcaagtgatcctcccgcctcagccccttgagttactgggactacaggcgcatgccaccatgtctggctaatcgtgaaaattgtttttgtagagacaaagtcttgctatgttgcccaggctaatctcaaattcctggcctcaagtgatcctccctccttgacctctcaaattgctgggattacaggtgtgagccattgcgcctggccggttttttaaatgtctcagtctaaagttcaatattcatcccctagcccctaagccatgtttttaacacctcgataaacgatgtgctgactttacctaaaatgtgtccagtattccttctgagatggaaagatgctattttgggggtaaatatgttgatcttttccagaaggagtccaagacagctgatgatagcttttgcttgttctctatagaagagcaagtgatggccgggcgtggtggctcacgcctgtaatcccaacactttgggaggccgaggcaggcggatcacgaggtcaggagatcgagaccatcctggctaacatggtgaaaccccgatacaaaaatattagccgggcgtggttggtggcgggcgcctgtagtaccagctgctggggaggctgaggcaggagaatggcatgaactcaggaggtggagcttgcagtgagccgagatcatgccactgcacttcagtctgggtgacagagcaagactccatctcaaaaaaaaaaaaagaagagcaagtgatgtgtttaagacacacctcgaagctactgccatagaatgtgtgaccatggttatggatttcataaggggcaccctaagagggaaaaataatctgacccagatggatcttccgaggcactgtgatgtcgtgcctaagagtgcagccttgggaggaagacagagagggttcaaatcccgctctactgttatcagctctctgtataccttggacaagtcactcaaccccctcagctgtcaggttccacatcagtaaaatggggaaaacagtaacactcacatcataaggttcttgtaaggattcaatgagataattcatgtgcagtccttagaatagtgcttggctcatatagtaagagctcattcaccgtcaactattattatttaatctattttctatcatattttggaataaaacattttggcttactaaaaaagaacaaaaagaacatgtatttaaaatcagtaggcaacagtgagtcagtgaggatgttctgagagtaggaatgacatgataagatctgcgttctgggaagattaatttgtctgaagcttatagggtgacctgaaaggagacgaggaggggagggaaatctgtaaggaggctgatgcaacggtctaagctgctttgtgcaatatggcagccactagccacgtggggctgtttaaatttaaattaacgagcttggcctggtggctcacacctgtaatcccaaaactttgggaggccaaggtggaaggattgcttgaggccaggagtttgagaccaatctgagcaacatagcaaaaacttgcctctacaaaaaataaagttagccaaatgtggtgggatatgcctatagtcccagctactcgggaggctgaggcagaaggctcacatgagcccaagaggttgagactacagtgagtcatgattgcaccacgcactctagcctgggtgacagaacaagaccctatctcaaaaaaaaaaaaaaaaaatttaattaaagaaaattaaataaaatgcaaaactcaatttttccaacacaatagccacatttcaggtattcagtggcctcatgtggctagtggttactatactggacatcaaacacttccattattttagaaagttctattggacagtgtaactgtaataggttcactgcccaatgcatgcagcaagtcaatacactaagccactgagttgcagcagagaaacaggtttaattgtagggaagagacaggaggaaacctcaaatccatctcccagaggagtctggggctaggatttttaagggttttgcagtgggctgaagtgtggagattgttgattggtggaaaagagcaggatggagtcatgggacagggagataaagaagctgtgttctcttgctgattcagttcctctgtttggggtctttaaactggttggcatcagctattctgctggaattcaggatctgtttaagcaactcttaaacaaaagcctatgattctaatgtcagaaatcctatctgtaggaacaacgaggttgcaaatggtcagtatccagtgttacctgacttttagttgcaaggaagtgggtcaaagttagcctgattaatgctgaattgtaactatatttctgtccagaattcttcctaccctggtgaggctggcttcaacaacactggtcaaaagcagtggttttcatacatgagtgtcacatcagagtcatctggaaagtgtgttaaaatacaggttgctgggttccatcctcaattcagcaggtctgagcagggcctgagatcatgcatttctttttttttgtttgttattatactttaagttctagggtacgtgtgcacaatgtgcaggtttgttacctatgtatacatgtgccatgttggtgtgctgcacccactaactcgtcatttacattaggtgggaggaataacattaggagatcatgcatttctaatgagttcccaggtgatgctgacgctgctagtctgggccacaccctttgagaaccactctctgaaacaggacttctcagtcatggtgtgagggaaaggggagttgtttggagcatgtgaaaagccttatttatatgccccagttaagcccaattgggatttggactcagcctctttccaggattggcagttgttggcagatgtacaggagtgcttttggcttttctggttaaaagaggtgaaaggtggggctaattcagagtatggagatcagaggggtgaatcatggagcaaaaagggggccttatctgcttcttcatccattctctctgtcatcctggagctcagcttttggggcctgatagggagaaagacgagacagaagctttcagaactgagaagtcagaattcactggctttgttcctcactaataccttgacaactttctccctaaggcagtggatgactcacgtctagctgcatggtctggggggaggagcctcagggtacaagtgacagaattcaatgaagtgcaaagtgggagaaacaggcacttcaaacctcaacgtattaccttgctacaagtgtgcctttaactcactgtttgagtcacagaaggaaacagcatagggcttgctctcagggagccggagtatagcatctgctgatggccagggtcactggaatatttgcctctgtctgggcagagtttagaataacaggcagaggcatagggtgggggctgtgccggaactctgtctatctcatctgtgtacccttttatagatggtcatcggatttgtatttgcatctcagtgtagtcagacattcttccagaacactccagcagtgcttctgtgcctgctggaaaatagctgcagctctctcctgaggcagctcttcccacagtcccagctgctcccctgggatcctccttggacctccccatagcctggcaagtaaacttagcacctgggcatatcagggggcctctaggaccctgttccagtactgagcacagcatcagtactggttagcttgtgcttgggctgtgccatttggaagtattttgaagatgcacatgcacgtgtgtgtgtgtctgtgtgtctacggtggtgaagaatggagggatgtgggatggggcagattcagtagatgccttgagatatggatagtttggtaaaattatgataataagaaaatggaaaggatgccagtttccttccagctagttaagacccattactttactcattgacccacctaacccatccatccatccacccatgcattcatctctccatccatccatccatccatccatccatccatccaatccatacattcatccatctaatccatccatccatccacacatgcattcatctctccatccatccatccatccatccatccatccagttcatacattcatccatacattcattcatctgtctaacccatccatccatccactcagccaactcatccatccatgtaatcatatatccgtttaggataaatgtatccagcactctcttttagtgcttctgtgtgactgaggatgtttgacaatgaaaggaggaagcattcatctgctgggaccccttctaacagatgttttcttctcccttcatccctgaacaacagtaggagaaacaggaaacttgtcttcaaatggtagcccttttccctgactgtctgaggatcatggtctgagaatgtgcctctcagtttttaaaaatccttgaattccatgattcagtgatgtagttaatgtagacagggctcttctatcaaagcagggagcctattgaagatatgagaaaatatgcactgtttctctagagaagggaagtaaacccgccttcctcagagctgggaaggcttttgtcccaagcttctgaaaattaaacccatcacttaacgttctcactgagcagattgcggggcttctggccctatgctgcttgggttgtgcagagctgccgacagacagttttgattgaatgtccaaattaagctgccaagcagcgactctgcagctccagggactccatgttagtatttatgtcacatctttagaaataatcacattgcaaagcagcacccagagccatgtctgcagccgctgcagcgtgggagagggggctgttgagcacctcctgcctccatgcttcatgctgcatttactcagcacccaagcaagggtggggccccatggcacgccatcctggttcctgtcccgaggatatgagtgaggaattggtaaacctcgtctgtccttcttgttttcacttaacttgaggcaggaggtggtctccaaacaagaagtaaagctaacttattggatgcctgactcccaaaccatctgtcctaggcagacagaaagaccctcagggccaacctgaggggaacagatgtttatggggggcaggtttactcttgtttttccaagctgggctgaagagctcctcttccatctgcatcaagccctgaaaactctgccgtgcatgagtaaagtagcaagtgctgcatcccccagtgagatccagtggtgacattgtccacaccactggggaatgctagttattaagagactgggcttgtgagagctcaaaggtggactaacccagatcttccctgtcgagggaaatggtctctagacttgtggggttgtggttgtgtggagtcagagtaagtgtggagcaacgctgggaactgtaggaccctgaatgaccagggaaaccgctgtagaaaatagttgacactaaactgggtttagggggtcataaaacctccaagatttcaaagcttctgggtcccaggaggactcagttactgagcacaaaagttgcatggttttggtgtcaggcctctgagcccaagctaagccatcatatcccctgtgacctgcacgtatacatccagatggcctgaagcaacggaagatccacaaaagaagtgaaaatagccttaactaatgacgttccaccattgtgatttgttcctgccccaccctaactgatacgatatattctcccccgcccttaagaaggtactttgtacacctatcccaaacctataagaactaatgataatcccatcatcctttgctgactctcttttcggactcagcctgcctgcacccaggtgaaataaacagccttgctgctcccacaaagcctgtttggtggtctcttcacacggacacacgtgacatttggcagtgttgcaaaaccctcagaagtccgagtatcagctggactgaaccttggggcacccgcgttgtgtctagttccagtttgttaagaattaggtgcacaagaccagccccccttttacacaatgatttctttctctcagatttagagtaacatttttttttctaactaaaaatgtaattaatgctcaactgagaccatatattgaatgtctccttcttccaaattcccactgaagtgacaaagagattaaaaatggaaaaaaattgatcagggtgacaaaccagaaaaatggtatcaatcagatgccagaatctttggggaatttttctaagatacaattcagacaatccaagctgattttgtgttctcttttccaacatctaagcctcttatacaatacttttaaaaaatgtaattgcgttgattggtactttcagaacaatgttaaattatgatagtgatggtgggcattcttaatttgattgtggccttaatagatatgcctctagagttttacccgtaagcataatgaaggctgttggtatatttattacgtcaagaaaagcattcatttatttctatttttccaagtgttaaaaggacgaatggttattgaattttgtcagtcgcctttttcgtcattttttaagataattatatagtttttctcctttgacctagttttatagtgaatcatattattaatagattttctaaaattatgaaagatttttgtttgaagagtgtgcgatcggtttctagcttttgaaagatcactttggtgggggagtgaaggaagggctcaatagaagaccacaggcaggaaaccaatgaggaggatcttaatttcacccagagaggaaaagtgagtggccagggagcaatcatatgagcagctgctgtttatgaatcactcatcacctgcccagcacaataccaggattcaaatataacttaataatcacagtaattctatggcacacttattattgttcagatggcagtgatatgaatagtagggactcaggtacacaaaatgagaaagaggcagatcaaacagcacggggttgtagattgcaccaaagggaggagaccagaatgatttctagattcttactggggcagttgggtggatagttcaacactcactaagactggcattgaaagacagggaggagacatggtggtgtcgggggagcaggaggataatgagcgttgttggacatgttgagtttagcgtacatatgggacatccagtacaagataaccagtggacagttgtacatacagttgtaaaggtcagtaaagaggtgtgggtgggagttgtcagtatttaggtagaagtaaaatcataagagtagagcccctggaaaaatacggaaactaacaaacaaacttccgaataatccatggtttagttcaaagaagaagtctcaagggaaataagaaaatattttgaattgaaagaaaataaaagtataacacatgatactttgtggaatccagattaaaaagtgcttaaaaggaaatttatattggtaaattctaccaacacttaaagatgaaataatactgattctcctaaaaagtagatgagaagggaacatttttcaacctattttatgaggctagcattaccctcataccaaaaccagacaaaaatagtacaagaaaactacaagcaaatatctcaaatattttcttccagttcgtcatttgtgttttgcagaacaaatgtttttaaactttaataaagtacaatttatcatttttttcttttataggtcatgtttttagtgtcatgtgtaagaactctttgtaaacataaatataaaaatcttcatagaaatattagcaaattaaattcagcaatatataaatgaaaaatacactccgtccaaatgagttttatcctgagaatgcaagctggcttaataataaaaaaaaaaatcaaccaatgtaatttaccatattaataatctaaagaaagaaaaaaaattaacatatcaattgatgcagaaaaaattggacaaaactcaatattcatttatgatgaaagttctcagcacactagaaatagaagggaactttcttgatccaataagaagtatctaccaaaaacctgtaacatacttaatgatgaaaaactgcatgctttctcattaagctatgaaacaaaactaaaatgttcatcctccccagtcctattcaacatcatgtcataaccagcacagtaagataaaaaaaatttttaaaggcatgtggggctcggctcggtggctcatgcctgtaatcccagcactttgggagcctgaggtgggtggatcatctgaggtcaggagttcgagaccaacctggccaacatggtgaaacccccacatctactaaaaatacaaaaattagtcgggcgtggtggcagatgcctgtagtctcacctacttgggagtaggcaggagaattgcttgaacctgggaggcagaggttgcagtgagctgagattgcaccactgcactccagcctgggtgacagagcaagactctgtctcaaaaaagtaataataaaataaaaaataaaaaccatatggaatggaaaggaaaaaaagaaaaattgtttctatacacagaaaacagtattgtttatgtagaaaatccacaggaatctaccaagaaattactagaaataatgagtgagtttagctgggttgcagcatacaagtcaacacacaaaaatcaattgtatttctatatattaacaactagaaaccaaaaatttaaaaaatactacttacagcagctgcaaaacaaaggaaatatttaggtataaatctaacaacacatgtctagaatctatatgctaaaaattccaaaacactgaaagaaatcaaagaatacctaaataaatgaagagataacccatgttcatggattgaaagactcagcagagtgaagatagcaagtcttacgattgatttgtaggcttaatgaaattcaagtcaaaatcccagcaggattttttgtatgtttggacacagtgattctaaaacttgtatagaagggcagtgaatccagaatggccaaaacaattcttaagatgaagaataaagttggaagaattactgtacccaatcttaagacttactatataaagcttcagtaatcaaatgtgatattggtgacaggatagatacacaagccattggaacacagtagagaatccagaaatagacccacacaaatacggcctattgattttcaacaaaagtgcgaaaacaatgaaatggaaaaaggacggtctttcaacaaatgatgttggaatgattagacattcatatgaaaacaaaatgaaccttgacctccatctcacaccttttgcaagaattaactcaaaatgggtcatggagcaaaatataaaggtataaaatttcagaaaacacaggagaaaatctttatgacctgtagttatacaaagagttcttagacgtgacacttaaaaacgtgacccataaaagaaaaaaaaaaaagtggtaaattgtactttattaaagtttaaaaacttttattttgcaagaaacaaactataaactggaagaaaatatttgcaaatcacatatctgacaaaggacttgtatccaactcattgtatcagaactctcagactcatttgtatgaagccagccttacttaaaatgtaatctaaaaacctgaacaaacactttaccaaataatacaaggatggccaatacattcatggaaagatattcaatatcactagaaattacagaaatgcaaattaaaaccacaatgagataccattgcacacttactagaatggctaaaataatgatgataatgataataaatactgtcaatatggtgtgctaatgagtatgcagaacaagaggaactctcattcatcactgtgggaatgcaaaatggtacagctgctccgggaaagtgtggcagcttcttataaagctaaacaaacgcatataactgaatgatcccactcctagttatttatcttaaagaagtgaaactttatgctcacacaagaacccgtgagtatatcagctctatttgtaatcactaaaatttgaagaccactgaaatattctttaacagttgaatagataaaccttgatacatccatgcaataaaatactactctgcaataaaaaagaattaactgttcatatacacaacaacatggatgaccctcaaaggccctttgccgagaaagagaaaccaatctcaaaaggttttcttgctgtatgattccatttaggtattattcttgaaaagataaaactgtagtgatgagaaacagatcggtggttgccaggggctgaggatgagaagaggatgtgactatagaggagaagtatgaggaatttttccgaggtgatagaactcttctgtattctgattgtgtgatggttacgtgaatctatacatgcattaaaatgtataaattttttcacaaaactgtgcaccaaaaagtcaattttactgcatgtaattaaacacataaaataaatgttataggcagaaaataagctgataaaagacacaagtacacacagagagagagaagagagagaaaagaaggcaatagtccaagatgaagagggagatggataagaggaatgcagaagaaagaaggttgtcatgttatgatactaaaaagtaatttaaaacagtagactaaatcaaagtgtgtagaagcagtagatagaggagtgcctactgcagaaaatgtaataagtaatatggaaacaagcttaaggagtgctccaatggggatggcaggggaaagggacaaataaataaatataaccactaaataaatgacagatgtagagaacaaatagcatttatccatgggtaaatgagtatcagatactcctagagaaaagaccagagcaaatggaaaagcatctatactgtattcaaagtagagttcaagacaaatatataatatactatataaaatgtgtcttttatttatggtaagtaaagtctggggacaaaaagtaatcatgaacctagggccaaaatgcataaagcaaaaacttgaaatgaaaggagtaatttacagaaataccataatagaagggctttaaaaacacactttgtcagtcttggacagataaaagcggttaagaaaatggatatagataatttaaataatataattagagtgaatataaaatacctctctatcttgaatcctgaacccttcaataaaagaattacattttttccctagtattcacaaaattagtgatatattaacttgttaaggaaacctcattaaattccctccaaaatgcccccagaaattgctcagcccacattttccgataaaaataaaacagaactagaaattaatgacaaaaacatataataccaaagatcaatggatgagtgagatggaggtaggaatcagatgggagcctcaagaattgaaatcttgaaattgcttctgtaaggaatgggaaattaactagggacacccaataggtttgacaagcagtgtgcgggactttgctgtggttggagatcatgggtatatagtggcatgaagcccctatgtgtgacactttcccctggggacactgtctagagcaaatttcactcatggttgagggtatgcacacaggatgttgaagagacaggaaggtaaggacatttaagccactggtcagaagcgattgaatggcttttccatatgggaagtggtagggaggaagtaaaaccgtagcaatgcactgatggaccaggggaaaggaaacagttgaggaactggagggtttgatgaaatgaaaaaaaaaaaaaagccaggtaaagggagtagagacataaaaggataaactaccactggagagtttagaggctatgccatatcaggtgaaactccaaatgcctggactggagtggagaggaggtcataagaagaatggatgatacgtttgacttcacgtcgtctattattctcagacctcctccaagattcatttgtatgaaaatcacattggagggatactcttttagccctggaatttatcttgattgttacataatttggtctaaattctctgaaaggagaaaggaaatcaacatttgttgagcctctgccatgtgccttacattccactttgacactgttatcctctatcattagggtagtcatataatttattgttaaaatttggactctcttaagagtgagaggacaacagttctaaattgaggttgctctgggaaaactgggatggatggtcacccccactattatccaagagcccatttgagttgtctgtgtaggtttatgagaatttgggggtggggagacaaaggctcagagaagccatttgagtgagatcacccagttagtgagagtcatggcagaggtagaattgacaaccgtgtctgcctgactctgaggtctagccattgctaacttagttcctgattcaccacgctagctctccaccattgtttcactagctgtggcttgacaggctctcttcttgacagacaccatgacagtcccagctggaagtctgtctcaacacagataattagatgtgtgataactgtaccactgccagcaatgatgggaagccagctgttctaggagcctttgggaccacgatgtgctcgggaggactttgatgctggatgtgggctgcccaaagaccccacgtttgctggttttgtaatcagagcctatcaggtgaagattatacagcatggccagttacagaggctgggaaggggattctgagggatttcagggctcataaaagccacagcatcagagaaccttggggtcagaaacccccagggttagaagaagtaataagtaaacaggaatcgatgggacacaaatctagattgtagagcaaagggctaaagaagcttccaacttgggaaggtatggcagggcaggggggttcaagcaaaggaccaggtaaactgtcagccaccaacagataactgaaacaggagaggggcagggcaggacagtgaaaataggttgatggatctgaaatgattgacctgtttagtctctccctccaaccctggttagggcatgtgctgaggatgtccagctgacctcaatgagcttatcctgggtctgtgtgttattcaccacggagctcattttctgggttctatgatgcaaaccaaaagtttttaagtatcaccctgcggatccaattaccctataaactctttggaggaataggatggggtctctgaaagccagggcaatagattcttggaaactgtaaaagcacaactgaatttgtaaattgttttaataacacaattaatacaagaatacattctctttgtcagaaatttaaaatgtgatggataaagctaaaatctttattcacaaccctcaaatcaggttcctctacctgttcctcagaggtggacattattttaaatcaattttgggtatatcttttcagactcttttctatatatttacattcatatatgaccttgtagaaaatgcattttactgtacctttcttttaaatatttggagggcctttaaaatttttttattctgacataatctcaaaatgacagaaaattgcaataacagtaaaagaaatttctgtatacactttacctgatgtactaattgtttatattttgctccatttggtttagcattttctctactaatgtatttttatatgtgtgcacattttttttctgatccatctgagagtaagttggggtcatggtttccacttatcctgaaatacttcagttgtatttcccaagaacaaaaatattcttagtacatttattcaaatgaggaaatgcaacattgacccaatgctattatctgacagttcagctccagatttcactaattgaaccactaatgccttcacgcttctttcttaaacaaagaggcattatattgccctcatcttcttttttcaacgtgcttcatcttgcttttttcaacacgtttctgcatatagataacccaatgttatcggcatgggcaaagtgcgtcacagtatgaatgcgccatatattatttactgtttcccccattggtgggcactcaggttatttcctacttttataattgcacacatcctcaggctgaatattagtgggtattactttggattaatgttcttttatttttccttaataaatccttcactggaatgaattactgttttgaggacacacagtgaggacaaagcaagactcacaatattgaggaaagttccttcaaaaggagttaaataagagatgctcctgattcacataatgtgggatcgggatatgaaagcagcacaattattctgagttttctgacagataattgtatcttcttagaaagaaaaaacaattaaggaacttcttggtgaagaacaattcttggaaaaatagttaacatgcatgctatctttttatggattcagtgctgtcttagagaacttggaccagaatgcagaggcctcgcttgctccaaagacccttagacagaaacaggcagacctcaccctgcacccagagccccatgcccacggcaagcagtgttctctggaccaggacacgcttctcctgtactctttgcaaacttccaccagtggggacgtttgctatttctgctctgtgtgaagcatttggtaccatctgggctggctgagtttcaacaaagatagtaaagaaacatttatcaagaaaaatcaaagtcggtctcgccaagtgtggtctagagagatttgcttccgcgatacatatgcggctctcttgctgctgggaaacacgactcaactttgaaacacttcaggagggacagccctttggatcttagcctgcagctactgtcaactgctcatgatagatggttttagtagccagagctcttggagatgtgaatgccagcagtctcaggatgcattccacagcattccgttgcacagaaagttttggcccctttggtagagaataagctcaaaaggacaaaagtagaagaaaggacctataaaggtgagggaagagtcatgcctcagtgagtaatgtttggctctgcaatgattagattcccaagaaaaggtcattcttggctgcacacagtggctcacacctgtaatcccagcactttgggaggccgaagcgggaggatcactcgtggccaggagtttgacaccagcctgggtaacatagtgagactccatctctacaaaaattttttaaaagttagctggatgtagtggcacatgcctgtagtcccagctattcagggtgctgaggtggtagcatcgcttgatcctgggagatcaaggctgcagtgagccgtgatcgcgccaccgcactccagcgagaccctgtgtcaaaaaaaaaaaaaaaaaaaaaaattgctcttaaaccacgagtcttgagattgacagcttcaaaatacaacactcttgtccagcaaagagcactctaaaagagctgtaaattccttaagcttatgatagaagatctttttccagtgactacccttgtggtgtcagttcataagactggggcggaggagggggagtggccttgccagggagaagaaagatgagctgtttcctcttgcctctgtgttaccaatcaaccagacagacaagcttctggcgcatctgagtgtctcaatcctgtgtgtgtgcagctcactatgtgatagatgtgtcactccaagatcccagcctagaaactggtacatgttattttccttggaaggctcaagaaatgaaagtaacagttggatattatattctatggggaaaatgcatgggtattttgagaaattattattctccagaacaatgttacttaatgtgtgtcttatagactggcagcatcagcatcacatggaaatgttttagaaaagcatatggacaggtttcactgcagacttagggaatcagaatctatctgtgggggtgggtgccagatacatgtgtctcatgagtcctctgagtaatttttatgcacactaaggtttaagaagctctcctgtggaagggttcgagtaaacatcgaatgcattgttaagaagaaaaccacaaatggttccatttgatgtcagtacgtgtggaaatggttaactcttcataataaaaatagacaaacaggcaaggcatggtggctcacacttgtaatcctagcactttgggagaccaaggctagaggatcatttgcatccaggagtttgaaaccagtctgggcaacatagagagacccccacctctacaaaaatttttttaaaaattagttaggcataggttggcaagcacctgtagtcccagctacttggaaggctgagttgggaggatcacttgagcccgggaggtcgaggctgcagtgaaccatgatcatgccactgcactccagcctgggtgacagagtgagaccttgtctctctctctctctctctcacacacacacacacaacaaaaacgtagtgaaagagggcattgcatatgaataagaataataatgaaatagcagtaatatatagcagttaacatttattgagtattttttaagttccaggttctgtgctaaacatgtatattctttatccaattttactcttgtaacaacctattttattgatcaagaaattgaggttcatatgtgtgaagtaactgcttggtaagatgcggaccctgggatcttatagccctgtgtccatgacactatatggtctgtcttggggacaagattaacattttattttgtcccctatatccccagggcctagcagaatgcttagcacttagtagggacttgcttgttgaacttaactgatcaaggtcaacatcttgcttttggtgtaaaaatgagatgcagcttgcaagctgagatgggagatgaattcagcctgtggaaaaatagaagacactgccatgttgctggagtgcagaaaaaatgtcagcacagaataagttacagcttgatcctggtagccgattcaatgcttctcccatctcatttattcggtctcaaccccttactagctgtatcattttagggaagtcagtcttatttattttccagcaatggtcagctgtttgagtgtaggaaaaggacagagtaagaaaggacaggtatttgaatttaagtagggctggggtcatgtgagacaagtaaaataaaaagaaagaggggcaagggagttgagggtctttccaaaggagtagctaaaatgcaccataaaattgaatctggatatgaatggagtaaaagcaagagggaatagggagatcaagagaatgtgttgggttcgagggactgattggtggagaatggactgacgaataggggaagatttattgcagtagaataatagaactaatgaattggaaaaatagaaattggtgtaagatagtagggtacttgaaactgagattgagaaagtggtataatttctgggataataggctccagagcgtgaccatggtaggagataactatgattgggggtgagcaaaggttgcaggaaatgagggggtgctttctctcctactttccaatattctttcttctaatctgtttttcttgttatcttgagtttacaaaatttctggttttatttatgctgtggatatttttccagccttttccctatgggctgtctgggtgcaggttatgggtgatacatggataataggtgcatcttggtttagagggtaactctttatttcttactgcacttatggaacacgagaaaaaaaagtattaaataatggctatggtaatggatatctttgtcttattccttactttaatggaattgcatttatcatgaaccatggtgctgttatttcagatagcctttatcctgttaaaattctctgctgtttctagataactacaatgatcttatggttttcttctttgatctataaatatgatgaatatattgaaaatagatttcctaagattgaaccatctttgcattcctgataggagtcattatgtattcaccttttagcagatagttagagtcgatttggattgaatgtattactgtggattgttctactgtaagtgagatgattgacattgtatccttaagagctgtgcaattctcattttctagtctgcttccattgactacctgcattactggtttctgaattgattcctaattaactacttcctgtttctccaagctgatgatttagtctccctcatcctttctatagccagttgcatcttcactgctgattccctgcctccttttctcctgtaagttcatcttttttttttgacggagtctcactctgtcgcccaggctggagtgcagtggcatgatcttggctcactgcaagctctgcctcctgggttcatgccattctcctgcctgggcctcccaagtaggtgggaccacaggcacctgccaccatgcctggctaatttttttgtattgttagtagagacagggtttcaccatgttagccttatagcctctttacctgggtgttctggagtcagggtggagctgagctctaatgctgctgacattgttccagccttctctctatgggctgtctgggtgctggttatgggtgatacatggataataggtgtaccttggtttagagggtaattcttcctttctttagctttttctttttgaatggaggtaaaattaacgtaacataaaattaaccattaactgtttttaaacgtacaattcagtgacatttatagaatattcacagtgttggacaaccatcatctctatctagttctcagaaattttcatcacctctaaaagaaaccctgtactcattaagcagtcactccccatttccctttccctccagcctctggcaactattaatagtagtctactttctgtctctatggatttacctgtttgggatgtttcatgtaaatggaatcatacaatatgtgaccttttgtgttggggtacacaaatgttcatagcagcagtattcacaacagccaaaaagtggaaacaacccaactatgcatcaactgctgaatggataaacaaaatgtgggatatctatacaatggaatattattcagtcatgcaaaaaaatgaagtgctgatacatgctataatgtggtgaactttgaaaacgttatgctaaatgaaagaagccagcctttcctgtgggctttgtggaaaataagcttagaaaacttacagttaatcttggtatgggaagagcagtgtaaaagtcagaaatccatttttaaccaacacagaccagagttgacatcttatcagcccatctcattttgtgcactgcttcagctatggatgttaataaaattaaatttctcactaaacaagtgtgatgccaaagaaccttccacaagttctgcagctgtcactgcttggtgcttaaacatgttggacagtattaatgcaaaaactgctttttctttttcagtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagattgtaagtggaaatgactgcagtgagcatgggtggtggaggttgggttatgtgccacctgaaatcagggagttcctcctcccttagctcctgtttccttccttccctacctccctccttttctgtcttctccatccctcactcctatctttccctcccttcttttccatctgcaattttgtattgtgagccaagaaaaaaaattagagctatttttttaatagagatgagaatgcctgtggtgtgggggagtgggtaggacaggaaatggtgtgatgtgttgctaagtgaaggcaagttgtgggagaaatgatggggctcagcaaataggggaacataacctacagggtgtggtgacagcctctctagagttgggtttatggatgatgcttggcctgcagccttctgggacatctccaccagcctcccttgagggtcttccctggccagggctccaagaatctgggagtctctttcttgtacatctaggcatcaggagttggttataacagccaattcactgagcatatatgatgtgtgacaaacactgggttaagcgatccgacttcatcggctcattttattcccaatgtagcaatagggcttatagaggttaaagagtatgcccaaagtcccatagcaaatatggggtggagtgggattcagcttctggcagtctgactttagcggtcatacttttttagccaccagctagaagcacagttccttgtcctgtctcctcttccctctctcagggcaaagctgggccccttctcagcctcagtcaaggacatgtctcagaacagacaatttccccaggatttttctccatgcatttcctcagcctcattctcaacccacctgtgtgcagatatacacatgtacacacccaattatgcaattgatatctgtatttcttataggcaataggaattcctgaatatcctgaaccctattaagacataagataacaaaagtagttagaactgttcttgtcatagccagtctaagacctctgcctgtttaagccacaggctgtcaaacagaaaaagctctcactccctggagagctagcctgggatggaaactgaatatgtttctttcagcagcttgtaatctttaaaactttctacctccaggtcttgtcctcttgtacatttattctgcttgagaaattactacaacctccactgatgtcttttctttttctctatgcagtcagctgaaagaatcggacaaagacagaagactgtcagtagagatttgggattgggatttgaccagcaggaatgacttcatgggatctttgtcctttgggatttctgaacttcagaaagccagtgttgatggctggtaagtaagattttgccttgaaagctaccatacagcttgctccatcaaacgcggggtcaagtatgttttcctttttctccaaaaattgaaatactaaaacagagtcccaaagtgaagtctggttgattggatctgccttgcagatatgttttgtttggtccttgtactaaaaacaaaaaagaaagaggccaggcctcgtgtctgacacctgtcatcccagcactctgggaggccgaggcaggtagatcacttgagctcaggagtttaagaccagtctgggcaacatggtgaaaccccatctctatcaaaaacatgaaaaattagctgggcatggtggtgtgtgcctgtagttccagctactcaggaggctgagatgggaggatcacttgaaccctggaggcagaggttgcagtgagcaaggtggtcagagattgagccactgcactccagcctgggtgacagagtgataaaaaagaaagagagagagagagaaggaatgaaggaagggagggaggaaggaaggaaggaaggaaggaaggaaggaaggaaggaaggaaaggaagaaaaagggaaagggaaaggaagaagaaagaaagaagaaagaaagacggaaagcaggaaggaaggaagggaggaagggaaggagggacagaaggagggagggagggaattagttctagtattttaaaaatctggggctagaaggcaacaattgagaacagttgaatagttaatgccccctttagacaggacatggattttctatttgtcaccgtcctcaccactccctattttattacatctgggccaatttactaaactacatgatgagactgtaactgcccagtggcttctttgtgcctgctgcccagacagagccgatttatcaagatgggagaattgcaatagggaaagagttttacacacatagagccagctaaatgggagaacagagtttttttatgactcaaatcagcctccctgaaaatttggaagctagggcttttcaaagatagtttggcaaggagtagggtggctagggaatgggtgctgctgactggttggggatgcagtaataggggtgtgaaaaatggtcctcgtgcactgagtccacttctgggtggggccacaggactagttggcaggtccaggtggggcagtctggttgtcaggaaggcaaaagcctgaaaagacatctcaaaaggccaatctcaagttctacagtagtgatgttatctgtaggagtaacttaggaagttggaagtgttgtgagctctgggataaaggctgataataatccatgtctacatcttagcagaattcaggctcctttcattctcctaacttggcaatatttcattagttttacaaaggcagtttagttttgggaaagggctgtcataatttaaaatatacaacaaatttctttcaaagttaggttggcggtctggtcggggtggagccattggttacgagaaatgcaaaaaaacctgaagagacatctcaaaaggccagtctacaatagtgatcttatctgcgggggtcattgggaaagttgcaaatcttgtgacctctggaataatggctggtaatcctttatgtctacaccttagcagaattcaggctcctctcatcctcctaacctcatggtccctcattagctttatgaaggtagtttagttttgggcaagggctattatcatttaaaatgtacactaggccgggcgcagtggctcacccctgtattcccagcactttgggaggccgaggtgggtggatcacgagatcgggagatcgagaccatcctggccaacatggtgaaaccctgtctgtactaaaaatacaaaaattagttgggtgtgctggcatgtgaggatcacttgaaccagggaggcggaggttgcagtgagccgagatcatgccactgcactccagcctgggtgacagagcaagactccatctcaaaataaaatgaaataaaataaaataaacactaaatttgtcacaaagttaacttggcccgagcccaggaaagcgtaagggcagtttggaggttaaaggcaagctgggggttggttagatcaaatctctttcactgacgtcatcattttctccctgttacaatttctgcaaagacagttccatgactggctccatggacactagagtggcttgtacacttcacctgaaagatatgagcaacccactgtcagatggtgtctgagaagctaccgcttccttgggagtccttagcaagtctggccacagatcatagatgtactggggtgttgttttcatagtcagctgctgtgtctcctttgtcctgaagattttattttgctcccttcctatggcaaaaaaaaaaaaaaatatatatatatatatatatatatatatatatatatatatcctccaatgttaccaacagagaggctgggtaagcccccttggcaactgtttcacagttaactgagtcaaggagtcagaagaaatagcttaacctggcactataactttgggagaagtggcaattgggctgctattacttctttaagataaattgtctcatatctgaattgtctcattcaggaccttttcagcttcaagtgaaagaaaataaaaatcaaactggtttagcgagaaagagatgtgtcctttggaccacacacacatctttcctttccattgttcaccttatgacttccttgtcttggctccatgtttcatcttaggccttttttttttttttttttttttgagacggagtcttgctctgtcacccaggctggagtgcagtggtgtgatctcggctcactgcaacctctgcctcctgggttcaagcaattctcctgcctcagcctcccgagtagctgggactacaggtgcccgccaccacgcccagctaattttttgtaattttagtagagatggggtttcaccatgttagccaggatgatctcgatctcctgaccttgtgatctgcctgccttggcctcccaaagtgctgggattgcaggtgtgagcctccgtgcccagcctatcttaggcttttcttgaaacatatattgagtgtccactaggtgctggtcactagaaacacatggaggtataagacagacatgacttcatggagcttagcttatggcagagggtgggttggggagataaacattgaacaaggaattacgcaaatgacaaatcaatgacaacatgatggaagatgtgaagaagacaggagctgagagttttgaacccaaaagtatctgagacagatttcaatcagtttagaaagtttattttgccaaggttaaggatgtgccagtgacacagactcaggagatcctgatgacatgggcccaaggtggatggggtacaacttgcttttatacattttagggagacgtaagacatcaatcaatacatgtgagatttacattggctcaatctggaaaggcaggacaactaaaagtgggacggggaggtgcttccgggtcataggtagattttacaattttctgattggcaattggttgaatgagctgttatcaatagaaaggaatgtctgggttacataaggagttgtggagaccaaagttttatcatgaagatgaagcctccaggtagcaggcttcagagagactagatggtaattgtttcttatcagacttaaggtctgtgttgatgttaatgctggttggcttttcctgaattccaaaaggaaggggatataatgagacatcgtgtctgactctcccttctcatcatggcctgaaacagtttttcaggttaactttggaatgcccttggctgagagaaggggtccatttacatggctagggggcttagaattttattttggtttacagaatgtaccccaaaagagttgtgttaaagcacaattcacaaatggttaaaaacatagttctcataagatagataatgggcattaatgggcattggccaaagatttccttagctcactaaggagaaaagcagcaggatgaatgaatgattccacagaaggtttgataaactgatgttcgtgtagtcagtagaaaaagatatgctgaaataactttgctcagttaaatataaaactgactgatatacaggacaatagaatcataagctttggggttatctactagaatgaaacaaaaaaaagattttggccaggcatggcggctcacacctgtaatcccaacactttgggaggctgaggcgggcggatcacctgaggtcaggagtttgagacgagcctggccaacatagtgaaaccatgtctctactaaaaatacaaaaattagctgggcatggtggcaggtgcctgtattcccagctactcgggaggctgaggcagaagaatcgcttgaacccaggaggcagaggttgcagtgagctgagatggtgccacggcactccagcctgggcaaagatttcacctcagttttctaaaagttaacatgtatctttgcagactagggaggccatctggggctgacctgatggtgaataataaactaaacaaagtaatattactgtgaggaaagaaatagctaattagaaaatgctctagcatgacattaaaagttcacacggtcatctttttggttttctttttcccccaagctttggatatttttccctaacatgcaaatgacttgactttgcagggtgtacatcagttactcacagtggatgtttcattctcattttaaatcaaacttaaagaggttaaagagaaagaatgcatgatcctcagggggtatcagtgtgacaggaggaaacataataataataattataataacaatagctactactcattgactcttaatagatgccaggctctgggttgagcttttccagatgtcgtggagtcacaattttacacagcactgatcaggtgtgcagaaaaaataaagcttatttcttttctataatggacttagactttctcatgcacttttgtgagctcctggtgaccgaggagaagggactctatatgctgcatgtggtactttctgagcttcactgtttcacttttctgactggtcactgttaacagcaaaacccagctctgtaaaatattttaaagaagtttattctgagtcaatataagtgactgtggcctggggaaacacaaacccaagaagctttgaataagtggtcctgaggtggttagattacagtttggttttacatgttctggggaggcagaagttacaggcaaagacataaatcaatacatggagattatacattggtttgggcccaaaaggcaggatagctttaaatggggcttatgggttataggagattctttaatttgcagttggttagagtaagactttgctaaaacttggagttaacagaaagaaatattttatgttggctgggcgtggtggctcatgcctgcaatcccagcactttgggagaccgaggcaggtggatcatttgaagtcaggagttcgagaccagcctggcccacatggtgaaaccccgtctctactaaaaatgcaaaaaaattagcaagttgtggtggcacatgcctgtaatctcagctactctggaggctgaccaggagaattgcttgacgcaggaggcggaggttgcagtgagctgagatcccgccactacacccagcctgggtgacagagtgagactccatctcaaaaaaaaaaaaaaaaaaagagtgtttaagttgaggatgctgtgcagcaagatggcttgcttatggtgcaacttcacctttgcctggcctggcgttagtcctgtttataatctgatattttattgccacaaagagtctgttttgtcagtcttatgatctctactttaacattcatgtcagtccattgttgtatataaactcccaaagaaaggaggcataacaagacgtgtccaatctcctttctctcatggctgataattctgtttttaaggtttttcttagatcctcttggccgaggagggggtctgttctgtcagtggggggccttaagattttatttttagcctacgttcctaaaccagcgcccactgaagtgggactggtcccacctagctttggggcatcattctggctttgtgctgaagatcctggcctgttgcttctccttgtgagttccctccatgcagcaccctctctgtcccactcataggccactgctgggcctggttcagggaggccaggaacctgcctgagtcctccccctgaggagtcttttctgctccttctgctgctgctggaatgatgttgcctggtgcatggataggtctctggccagcgttccagccgaggaggagggaaacccacctctccccaccacctgtcctttctccttcccaaggttctccaagccccaaagggaggggcttctcctacaatcacccaatgagttcatctagagctgattcactgagacggcaatattttagcagagaaagagtttaataaacacagtgccagccaagctgaaggatgggagtttattactcaaatcagcctcctccaaaattcaaagactagggtttttcaaggacagtttagtggtaagtgggggctagggaatggggaatgctgattggtgggttgagagtgaaatcatagggggtcaaagctgtcttctcatgttgagtcagttcctgggtgaggatcacaagaccaggtaagccagtttcgttgtatggattcccagtctgggttgcaccagctggtccatcagaatgcagggtctggaaaatatttcaaacaccaattttaggtctataatagtgattttatctataggagcaattggggagatcctgaatcttgtgacctctggctacatgtctctggagccagaattctaactttgtggctaatatgttagttttacaaaggcagttttagtccccaagcaaggagatggttagttttgggaaggagctgttatcgtctttgttttaaagttaaacgaatggccaggtgtggtggctcatatctgtaatccccgcactttgggagtgccaaggtgggaggattgcttcagttcgggagttagagaccagcttgggcaacaatgagatcctgtctcaacaaaaaatttagccaggcatggcggcatgcacctgtgctcccagctactcaggagcctgaggtgggaggatcacttgggcccaggaggttgaggctgcaatgagctgtgattgtgtcatcgcactccagcctaggcaatggagaaagaccctgtctcaaagtaaataaagaaacaaatacaaataaaaaatgaagttgaactgaaactaacttcttcccatagttagcttggcctaggcccaggaatggacaaggatagcttggagattagaagcagatggagttagttaggtccgatttcttacactgtcatagcttttctatgtcatatttctcttactgtcataatttttgcaaaagtggtttaactcccacacatgccatatccttcttcctgggctagtgcctgccttgtctactcccctaaggctgagagcagggaagaaaaaaacggcttaagaatagggatagtgtatcaggagtaagcccaaaatattactgcatttacacttagatgatcatttaattctccagttattctaggtttcatcatttccaaggctcagaatagttcagcagtgtgttagggatacacagcttgtaagcaacggtgctgggttcaggtccagatttctatgatgccagagcctaagcatatacaaattccattctgcctcctgatacagggttaggtggaaggctagagggtagacagctgggattttatttcggctttcctgactggatggatgctttgtgacctcaggtgagccacttcacctctctgtactacagctttcacagcagatatgccacccatcagattgattacaacaccccctgtcctccatccaccacttaggatagctgtgaagttgatgacataatagttggaagggaacttttccaaaataaaagccctctgcagatttttgcagataaaagtcctcctcagatttacggccaagacatttgcgatgctgtcttgactgtaaatggaccagatcctagacatttggattcttgcccctgggattctttgaacattatgtgatcttgagcaagtctcacaccctttctgaaactcagattcaccatttagaaggggatgggctccatcagctcttctgttgtgctgtaattgaagaccgtgtggcagaaacagcagatgcagctgtggaagctatcagatgtggtgcaccagccccaggccccctgtctgcctcttggccaactgccctgtatctgttgacaaatccgcctctttgtttctaattttgtttatttatactgtctcctttctttccccttcattttccagaggttcatctgttttatttacttatttattttcttcaaggaattaactctgggatttgtgtatcaattttgtttgttttctccttttctgtaggtttattttgtgtttggctttgactttcagttgaacattttactaatttattttttcttctttcgcctgactctgctctttaaaaataatgaatagcttttttgtttgtttgttttgagacggagttttgctctgatgcccaggctggagtgcagtggcacagtctctgcaggttcaagcgactctcctgactgagcctcttgagtagccaggattacaagtgcctgccaccacacccggctaatttttgtatttttagttgagacaaggtttcaccatgttggccaggctggtctcgaactcctgacctcaggtcatcctctcacttcggcctcccaaagtgttgggattacaggtgtgaaccaccgcacgtggccaaaaataatgaacaagcatttaagggaataaatgtttcctctgagttttgatatgctaacattctggcttttgctacttccttgagggcctgcagttgaggttttagtttcttttctaacatgctttaatttaggcattttttttaacccctagaattagatttttgtttaaatttttaatattaatgttaagttactgttttagtgctttcaagttagagaatatggcctgtgcacttttctttttccctcctgttttctttcctttctttcagcatagcttagtatttgttcaatgttgttaaaagttctgtggacttgcaagaaaaagattatattagctattcgtagagtatacttttttgtggagaaagaataaaccttttttcaacttttattttagattcacgggatacatgtacaaatttgttacctgggtatattgcatgatgctgaggtttggggtatgaatgattccgtcacccaggtactgagcatagtacccaacagttagtttttcaatccttgtcttcccctcccctctcccctctacagttcctagtgtctgttgttgtcatctttatgtccatgagtgtagggtatacatttattcattccaatgtattataaggtccagatcttttttttctgaggcggtgtttcactcttgttgcccaggctggagtgcaacgccgcgatcttggctcaccatagcctccgccttccgggttcaagctattctcctgcctcagcctcctgaatagctgggattacaggcatgtgccaccacgctcagctaattttgtatttttagtagagatggggtttctccatgttggtcaggctggtcatgaactcccgacctcaggtgatccgcccgcctcggcctcccaaagtgctgggattacagatgtgagacaccacgcccagctaaggtccagatcttttataccttcatattgtccttttgtttgcttgagctaaatgtgtagtgtttattaagtttcttcaggcaaaatgattcacaaacattctttttatttctaggggtttttgccttatctgtatatggcaatattattaaccacataactctacaagtcttattatattgacatgaagttatctttgttgcagctaatgcgttttctctataattttactttgttgctggcattcattcattcattcattgaatatacacagtgagcacctgctgtgctgaagagacactaatgagcaaaacagacaagaatccgtggcctcatggagttttctttttagttgaagaaaaataaacaacaattgtaaatgaacaaaaataagtaataaaacatggcatgtttgaggctgataagtgtcatagagaaaagtaaacaagaaatggggacaaggaatcttggggagtggagacattcagattttatagggaactcaggaaagaactcactgaaaaggtaacatagagcaaagatctaaagcaggtgaggagggagctgtgtggatatctagggagaggttgtcttaggcagcgaggacggcaagctcaaaggccctggggcaggagtgcacccggcaagttggaagagcagtaaggagactcctgtagctggagctggatccatgaggggagagtggaggaggattaggtcttggaggatatggggagagggttggcggatcctgtcggccttgtcaggactttgtcttctactctgaagaacacggggagccaaggaattaatgagattgaactgacctttgcatatgtcctctagttgtggtgtggtcgatcccttttccctagtaggtcctttcccattcttttatgtctaatctttctaagtcctttggtcttgtgtaacaagcggcacgttgttggatttttttttttttatttttgagacagagtctcactctatcgcccaggctggagtgcagtggcacgatctcagctcactgcaacctctgcctcctggattcaagtgatttttctgcctcagcctcccgagtagcagggattacaggcatgggccaccacacccatctaatttttgtgtttttagtagaggtgggccttcaccatgttggccaggctggtctcgaactcctgacctcatgatctgcccaccttggcctcccaaagtggtgctggggttacaggcgtgagccaccaagcctggcctttttttcttttttttttaaaattttactttaagctctgggatacatgaacagaaagtgcaggtttgttacataggtatacatatgccaggtggtttgctgcacctatcaacctgtcatctagatttcaagccccgcatgcattaggtatttgtcttaatgctctccctccccttgcccctcaccccctaacaggccccggtgtgtaatgttcccttccttgtgtccatgtgttctcattgttcaacttatgagtgagaacatgcagtgtttggttttctgtttctgtgttagtttgctgagaatgatggtttccagctttatccatgtccctgcaaaggacatgaactcatccttttttatggctgcatagtattccatggtgtatatatgccacattttctttatccagtctatcattgatgggcatttgggttggttccaagtctttgctattgtagctagtgctgcaataaacatacatgtgcatgtgtctttatagtaggatgatttataattctgaatctgaagatcttttttccacaggaaaatgttttaatgtttatagctataattgccatgtttcttatggtgtttctaaagttttctttttctttcctatttcattctttttttttcatctccttctaaacagataactattatcttaaatcagtgttatattacttttttttaaaaaaactttctgttattattaataatcacattttggtcttattacaaaaaaaaagcaaaaaacaaaaaacaaaaaaaactaatgctttggaatcagacttcccgggttagaatttctactgtaccacttcctagctgtgtacccttggcaagttacttcgcctctctgtgctgtgtttcctcatttggagataatagtcgtaattatgtcacaggattgttgcagtatcaaattagttaatataagtgaggtgcccaatgtctgctaaatagcactcagtaagtgttagtcattattgttaattgaataattattagaaaaatataagaaattggagaatttcagagaccccagattcccagtgcccataaccactattgaccctatagagagagagagtgaagcaaaaaatgaaatcttactgtgcatactatttggtaccttgcatttttcacctaaaaataatccgcaataaacataattgtggcaaaacttttgtgcccagctttaataatttcctaataaatttctaagcctggaattgatgactttaagcatatacacattattaaagggtttgccaaaatgtcctacaattttaaaaatcaatttacagtcttatcaatcttgtatgaaacttttcagtttattaacattaacatccagtgctataaatttcaaagatatgatacaaagattatacacatattgtattagaaattatgttgaacattttcatttgcatattgccatttgtttatatttatatatgactatgtccttttgcctttttcttattgacttgtaagaactttttatatgagaagaatattaatatgtctttcctgacatatgtatgttgcaacgttcctcctcctccttttcatgttgtaaattaattttggtaatatgcatttttcttatggtatataaagcattcggttcaactccaatctaatatgatagatatcaagccacttgccagaaacatttctcaagtttttcttttcattgactaattgttatctgaattatccatgctgtgttcactgtctcaaatgaattttttaattcagtgattatatttttcttccgaaagtagtctttcccactctcgtatttgttcccttttcacagatgcaccaacctcttgaatctcactgcaaatatgaattaggtagtttctagaatgttctctcttttggcagcagttgtatttcatgggagttactttgattctgcattgtttctttctatttaaatgactaaatttttcacacatcctattgtgcttatttgcctatccttatagaagggtgagcacagacatttctgtgtccttgttctaacatttcatatctggataaagggagacaggagtcttttgtattttttggaattctgttttgtcagatcaggagtcctgttcctgacatttgggcggggctacagtggagacaggtccataacaggcacccctcaagccagatggagagcccatcttcctcacgttggttctgtgcatctcaaagtcagaaggggtcctgctcctctctgagggggcacacgtgtcctatttggaggcagtagtggcagcgtccttcactcactctgtggcgtactggccaccgtgaacacacgctgtggcaccatgcccctgcccgctgcgccaggcactgacatgtctcctcttgcatatgaatgggaatcggcaaccctcacccggtcattgatggtctcagccggggtcattattgggctctgttggggcaccttttatggatgacagctggtcaattcccctttatctgtattttcccaagtgtgagaccccaaatactctagatggttcacagtcagggcataaataatattgaattgtgccccaagaaagcaattattttgtcagtgttctttcagttcttcaaattatggcaaagagaaaatctcagaggtctctgatatatcgttaacactctaacacttgctcttcgctgatctcccattaaaaaggggcaggggcaggctttcgattgagagcctttagtaagcaacaccatctacttgcacgtgcataaccttgatttccttgatttccatttgtttatttttttttctttttttttttattggaacattaattaggttttattttcactttttgtttccacagtaacatgtatgggattaggttacagtgtttatttgtccccaatcttttatttatttattttttttattatttttttttaattgattgactttttattttttattttatttttttttaaatttatttatttatttatttattttttattgataattcttgggtgtttctcacagagggggatttggcagggtcataggacaatagtggagggaaggtcagcagctaaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccattcaaccctgagtggacacagcacatgtttcagagagcacagggttgggggtaaggtcatagatcaacaggatcccaaggcagaagaatttttcttagtacagaacaaaatgaaaagtctcccatgtctacttctttctacacagacacggcaaccatccgatttctcaatcttttccccacctttcctgcctttctattccacaaagccgccattgtcatcctggcccgttctcaatgagctgttgggcacacctcccagacggggtggtggccgggcagaggggctcctcacttcccagtaggggcggccgggcagaggcgcccctcacttcccggatgggggggctggccgggcgggggactgacccccccacctccctcccggacggggcggctggccgggcggggggctgacccccccacctctctcccagatggggcggctggccgggcagaggggctcctcacttcccagtaggggcggccgggcagaggcgcccctcacctcccggacggggcggctggccgggcggggggctgacccccccacctccctccccgacggggcggctggccgggcagaggggctcctcgcttcccagtaggggcggccgggcagaggcgcccctcacctcccggacggggcggctggccgggcggggggctgacccccccacctccctcccggatggggtggctgccgggcggagacgctcctcacttcccagacggggcggctgctaggcggaggggctcctcacttctcagacggggcggccgggcagagatgctcctcacctcccagacggggttgcggccgggcagaggtgctcctcacatcccagacggggcggcggggcagaggcgctccccacatctcagacgatgggcggccgggcagagacgctcctcacttcctagatgtgatggccgcccggcagaggtgctcctcacttcctaggtgggatggcggccgggcggagacgctcctcactttccagactgggcagccaggcagaggggctcctcacatcccagatgatgggtggccaggcagagatgctcctcacttcccagacggggtggcggccgggcagaggctgcaatctcggcactttgggaggccaaggcaggcggctgggaggtggaggttgtagcgagccgagatcacgctactgcactccagcctgggcaccattgagcactgagtgaacgagactccatctgcaatcccggcacctcaggaggccgaggctggtggatcacgtgcggttaggggctggagaccggcctggccaacacagcgaaaccccgtctccaccaaaaccagtcaggcgtggcggcacgagtctgcaatcgcaggcactcggcaggctgagtcaggagagtcaggcagggaggttgcagtgagccgagatggcagcagtacagtccagcttcggctcagcatgagagggagaccgtggaaagagagggagagggagaccgtggggagagggagagggagagggagagggagaggagggagaggagggagaggagggagagggagagggagagggagagggagagagcgtccccaatcttttaagtctattttttttttcttgagacggtgtctcgctctgttgcccaggctggagtgcagtggagcaatctcggttcactgcaacctctgcctcccgggttcaagcgattctcctgtctcagcctcccgaatagctgggactacgggcgcgtgccaccatgcccacctaatttttttgtggttttagtacagatggggtttcaccatgttggccaggttgtctcgatctcctgacctggtgatctgcccaccttggtctaccaaagtactgggattacaggcataagccaccatgcccaaccttttttttttttttttttttttgagagacagggtcttgctttgtcacccaggctggagtgcagtggtgcaataatagctcactgcagccttgaccttctggactcaagcgattctcctacctcagccgctcaagtagctgggactactggcatgcgccaccatacctagctaaatttttttaatttttttgtagagacagggtctcgctatgttgcccaggctgatcttggactcctggcctcaggtgatcctccttcctcagcctctctaagtgctaggatgacagacatgagccaccacgacgacctgtttatctttttgtttgttttgttttgtttgtttttaacaattattttctatttgtaacaagtgatattgaatttccttccaaggaagaaataaaaagtgtcctttaaaattaaatttattattaaaaaagtaaaacagatatttcaacgctgatatacaaatctagcaaaatccacaaaggtagcatctgaatggataaagttaaagtttacccaaaatagctctgttttctttctattactttaatttgtaggaatccctggaagtccctgctgtgtggatagcacccttctcgatttccagcaaagatacagatgctctcttgtttttatatttcttttggtaatttccgtggaattttggaagaaaatttggaatattaaatgtggaggcgtagaggctcaaattgtcttctctgctttgaatcacctagcccatttttggaagctgcgtaagaagattcgtgaatggagagaaaacattgtgatgaaaattttaaactttggttaggaatgatctttgagagcgaggagttttggggtcttttttctttcccactgattcaaatgcttttagaatgtcccttttctttcctcacactcatctcatcctcttactagatgaaaaaatctttgtggtcaagaaacaaactgaagcccccatgtttattattatattagtagtagctgggcatggtgggatgtgcctataatctcagctacttgggatgctgaggcaggaggattgcttgagcccaggagttcaagactggcctgagcaacatagcaagaccctatctctgccagaaaagaaaaaaaagaaaaaaaaaacagccaggtgtggtgggatgtgcttttagtctcagctagttgaaagctgaggccggaggattgtttgagcccaggaggtcaaagctgcagtgagctatgattgtgctgctgcactccagccttggtgacagaacaaggccctgtctctaaaataataataatgacattagtcacagtaataataatcatgatgatgccactaattgaatacttgctgaatgccaagtgctgtgcttatcattttacatgcgtcattacatttcaatttcacaagaattctatgaaaaaggaatttgtattccaatttatagatgagaaaaacagaggcccagagaggctaaccagcctgtctaaggttatgagatgagatttgcacccagacatggtttgactccagggcttgtgcgcttaaccactaagggatgccgtttctcaaaaaggctgactacagcacattttgggaaaacttttgcagagaaaatagcatcatgaagtcaagtccatggtcacctaaatgcagttgagtgccaggatggcaaagtggcaccctatgcaccctatgtagggtgaaaggtagaaatgctggaagagcatgacaagagtgtatttacagtcaggcagtgggggttgcaatttgggaggatagggtgagaagatcacttgaggtcaggaattcaagactagtctgagaaacatagccaactcccatctctacaaaaaaatttttttttgtttaattagctgggcatggtggcacatgcctatagtccccagctactcaggaagctgaggcaggaggatcgcttgaacccaggagctcgaggcttcagtgagctgtgattgcactattgcactccagcctgggtgacagagtgagaccctatctctaaaagcaacaacaacaataacaacaacaacaagaaatttacgatgagggatcttcatagcattctttcagaataagaaactacttaatggacaaaaagtaggtaaaaatatacagtaatttaacgatataactaagaaaactgtgtaagtgtgtatagagagagagtgagaactttgcctcctatgtacatgtgatatacattttttttctgctgtccatggaagagttacaaaaatacatagtgtacctggtagtgtaccatgcacactacccccacccaacatactgaaaaacaaaccaaaacaaaccaaaaaaccctcaacgtatattttttcaagtagagctttatataggcctccttttcatatgctgatcaataaaataataccgagtcgagtcatgaaatgtgtcccacccccttgtctcccttcaggtttaagttactgagccaggaggaaggcgagtacttcaatgtgcctgtgccaccagaaggaagtgaggccaatgaagaactgcggcagaaatttgaggtgaggtttcttttctttttctcttctttcttttttctctttcttttttccttctttcctcctgctccctcctctttctttctctttctctcttattcttttttctctccttccttacttccttcttcctctctcttttctttccttctttctcctttctttctttcttgcttacttgcttgctttctcgctttcttcctttctctcttgctttctcttgcttgctttctcgctttcttcctttctgtcttgctttctttcttgcttgctttctttaccccccttttctttgttttttccttccttccttcctgccttccttcctctctctttctctttccctctcattctttcttttctttctctctctgtccttcctttgtttctttctctctccttccttcttcctttcttccttccttcctttcctcccttccttctttccctccttcctccctccctcccccctttcctttctttcttcctccttcctctctcttttcattctttctcccctttctctctctcttcctctctcttgtctctctcttctttcttcatctcctttctttcatcagtgggaaccagttaggtttgctgctgtgctgattttcctgtttatggcatggtttctactaagacttttcatgactctgagcctttgcaaggttgttttatctcctagaaaactctgattaatccttcaagaccccaattaaatgcccttgccttatgaagttattcctgcttccctgtctgcattcaggcttagacatttcttcaaaagtgctcattcactgcccaccattttgatggtgacttggactggaatggtagtcatggtgaatgaaagaagtagacagagggccgggtgcggtggctcacacctgtaattccagcactttgggaagctgaagcaggcagatcacttgaagtcaggagttggacaccagcctggccaatatggttaaacccagtctctactaaaaatacaaaaaaattagctaggcatggtggtgcacgcctgtaataccagctactcggaaggctgaggcacaagaatttctctgggtggcagaggctgcagtgagccaagattgtgccactgcatgatcagtaatgctctgttgcccaggctgcagtgcaatggtgcgatctcggctcactgcagcctgggcaacagagcgagacttcatctcaaaaaaaaaaaaaataagtagacagagaagtgatatattttggaggctgagtcaactaggcttgctgatggatggaatctggattggctctattgacagaatgatgctatatagttaacgaatggaattgattgtgctaatgacttcatgaaataccctgggggtagatcttcccagagaatagttttatcaaatggaaagcccttggctgtgaccttgagttacattgctggctctgctcctacctgaaataaatccctttccttctacggggacaaataaacaccattttcagctacctaagagcagcaggtgtataggacacatccttgctttacaaagaaaatgtttgggggaagataggtttgaatacttacattatatgtgcattgagtgattttagtagtttcctgaggaaaagcacattattttgttcccacaaactcaatacactgagtctggtgggagatgatcaattctagataaaccatgatggcctactaactccccaaaaatgtatataatagcatagctaaaatgaaattaatttttattattgttattcatcaaataatgacacacacaaataaaaaaaaaacgtgtaaagaccatgtaaagtcctgggaaagagaggtcaggtaccttgagaacatgtacaagagaaatgtcacgtagtttgagagaatggggaggtgtcaggaaggaaacagcaatggaagtttaccatgtaaaaagaggggaaaatgtattctgttctgcaaacagcatgtgcaaaggccctgtggttgggggttatatagcagcaatgtgagactgaaagaagaccagcctgggtagagcagagaaagccaaagagagtccaaggaaaggctgaggaagtaggcatgagtcacagtacgtagggctgtgctggccttgacaaggattttagcatttatcccaagagtatttatcccaaggactttagcatttatcccaagagtatttatcccaaggattttagcatttatcccaagagcatttatccaagagcatttatcccaaaagtatttatcccaatgattttagcatttatccaaagagtatttatcccaaggattttagcatttatcccaagaatatttatcccaaggattttagcatttatcccaagagcatttacccaagagcacttatcccaagcgtatttatcccaaggacttgagcatttatccaaagagtatctatcccaaggattttagcatttatcccaagagcatttatccaagagcatttatcccaaaagtatttatcccgatgattttagcatttatccgaagagtatttatcccaaggatagcatttatcccaagagcatttacccaagagcatttttcccaagactatttatcccaaagattttagcatttatcccaagagcatttacccaagagcatttatcccaaggattttgttttgttttgttttgtttttttgagacagagtctttctctgtcacccaggctggagtgcactggtgagatctcggctcactgcaagctccacctcctgggttcacgccattctcctgcctcagcctcccgagtagctgggactacaggtgcccaccaccacgcctgcctaattttttgtatttttagtagagatggggtttcaccatgttagccaggatggtctcgatctcctgacctcgtgatccgtctgcctcggcctcccaagtgctgggattacaggcgtgatatcccaaggattttagcatttatcccaagagcccagttaccacacgtggtatatttcagtacgtcagagttggttgcctctgtttggttacggggctttgagttctagggctctaaattgcagacatgaaaaggcagccattagtgagtgtattcctgtttctgagggcacatcgtacacagcaagataaaggacaagtttgtttgttgaaagaaacaaactatcaagtttgttctcccctcaacttgatagaaatagcgcttaggggccaggcacggtggctcatgcctataatcccagcactttgggaggctgaggcaggaggattgcttgagcccaggagttcgagaccagcctcagcaacatagcgaccctacctctattattaaaaaatatatatttaaaaaaaaataaaaaaagaaatagcacttacgtattcccaaattccttgtcttgagcctatgcccacccgacatgctggaagatagtgatagttctgacccagtggggtcctcccttcctgggaacaagtggaacagacacattggccttgagcttatcagtcattctccagtgaccttgataacagaggcttgttcccaaagtcttggactcaagcccaagtgaactgaaaaaagaaccttccctccaagtagaactaaaaactggatactgtttgataaaaattaagacaggaaggcagtctttccagagaacactttctgtctctttcccccaacttgctgatgaagtggtatcatttgctgctgttatagaaatgtactattacgggtgaaaaacacaaggccagtattttcttgtatataaccaagtctcagttttgcaaaatgatttttttctgtcctggggcagctggggtgacatttcagaacaccaaggaaaagatttgctacacaaacagagcatttgtctgggccagtaattggcttggaataggagactgttttatccgcatgcaagaaattgtgtccctttctttctagcaagagcctgcaaatgcttgtttatgcctgaattataatcgctgcatactgtacttgttgatttaaaaaaatgtttccaacagaccgaaaattgttctcaggctcacagaggaatttcagttgaccttgaacatgagaaatgtaatccctgggcgataaccaattagcacccggaatgactcagaaattactttcaagcctcttatctggaggaattctgagtgacagtaaaatcgagctgctagaattggggtaatagaatttcatggtagtgtgagcttggcgcagttaccacacgtggtatacttcagaacatcagagctggctgtttgcttagggggctttcagtcgaccgtgggctttggaaaagaagactccattttggatggcgcacagtgggatttctcagagtcttaaaatttatttgtataacaaagtgcttactgtgtgccatttatgattctaagtgctttgcaaatattaactcaggtaatttaatccttacaacaacctagaatggtaggtactattatcacgctattttacttttacaaatgaagaaactgaagcccacagaggtttaagtaactttataaggtcccagagccagtcattgtcctgggtttgggttttcccagaaacagactataaggattcaagtgcaagtactttatttgagaggtgatcctggaagcaccataagttaataaggaagcattgccagaaaaggtgggaaaccaggaaagtaagtattatcaagcagactactgctgtgggcagctagggtttaaccctgctggagaactctcaagtcagcgcggaatgcatgcctcagaatttcccaatcaagggacaggaagctgaggggttatccgtcggctccccttccgttgcaggctaagggctgctcccagggaaatccactcacccgcactttcaatgtgccctgtgcgctgtgcccgctcctataaccagaaaataagctacaggcaaagaatcacaggtgtttgctgttagcagccctaggtgtagagagcagcatgctggtggtgtcttggaggaacaccagcgattgtacctgtgcaatgtagcctaatggttaagtgtgattgcttgagagccagactgcctagatttgaatcccagttctgccacctccttgctgagtggctgtaagcaagttgctttgtctctctgagcttctgattccctacctgtaaaatggggaattatagcacttcttacctcatgaggttatgtgaggattgaatgaggtaatgcgtttagcagagtgtctcacatgtcatacatatccagatgttagatgctagcatcatggtggttgttataattattgtctcccccttcgggataaataaagctcagaacatcctctttctgggctttggaagggctgcttggaggttagggaaaatctacagggactcctagcctacagaggtccctgccccactgctgggtagctgggagtgcctgtagtagttccttgtaggggtggagtggcagaggaatctgcagttttagccaggacaggcattcatcatcgggagtggagcccagagtctggctgccagggcttctccactgtcccctcgtgctgtctggaaggtggcttggctctttgctcagaaatgctatttgctttctctcttagcattgagttctagggctctaaatcgcagacatgaaaaggcaaccattagtgtattcctgtttctgaaagcacatcccacacagcaagataaaggacgagtttaatttgtgcctcaattttaaaatgttcgctctttgatgcagtgtgtgctaggcattgtccccttggaacaatgggatatttcaaaggacaaaggacagggctcctgtcctctgaaggctcactgagtaggggccacaaacccaggtgttttcaggagccaggcaaacaacaagaaggcgaaagagcttggcatcacccagtgttagcagatccccttcttcaaaagaagctggggatctgggttttcatatctccaaattttcaacagttggcaactaattaaatattaaaatgacaacaaactctgtgcagaccagaccaacagggttatcagacttctttttttttttttccagggttattagacttctgatctagattctagaagttaaattaacatgcccatgagaaaagttataaaagcaagctgggagggagggaggaaagaggggtgccagccccagattcagaggagagaagggagtttctagtgctgagggatgaggctgttagctgctccttgaaggacaaggaaaaaatcaacccctcttcccacccccccaaaaaagtccttatctgtccactacgcaaagtcaaatgaagaaatcaggaagtttgaggtccgtgctcacgtttcatggggagtgtgtgctgggacccgcaggtggatgggaaagttcccaggatgggaaatgggaactggggcaggcaggacttggatcttcacagtctggagaatggagactgtgaatcagatgggtcctgagccaggattcaaagaaggcaggacacatggtgctaaggtgatggggcagcagggaggggagtagggaaagtgtttgggtcaggccagcttgggggtgatgatttaggagggtgtgaggacatagcccgagaaaggtgagacggcttctgtcctaccctggctcttttgtttgcagtttccattgcaaataagatgaccttgtagttttaactaccccctcgttgcctctacaccccaaatctctgtctccagtccagatatctttgctcaagccccaaacccatgtatacaactgcttactgggtatttacacttgggttaaacctcaacatatcttactgcaaagtaaactgaccaagtatattcacagcagcgttgttagtaggccgaaaggggaaacaactcaaatgcctgtacacaggagacgggataaacatcaacaatgagtgccattcagcaatacaaagagacaaattaccgatttatgcaaaaacatggatgcatttcaagaacattttgatgagtgaaagaagccaggcacaagagtacacactctacaatgctgttcagatgaaattcaagaacagacaaaactgacctatgggatagaaactggaacagagattgccttagtggcgggggttgcggggggcgtcgactgggaacttttggagggtgatggaaatgttccgcgtcttgtttggggtttgggttacatgggtgtgcacatttgtcaaaatctacagaactgtgcacgtgagattggtgcactttgcggtgcccacctcaagtttcaaaacatgaataaagagaaaatggcggatgctttgttagccatggttcctatatggtaacagtggaatatgcaccccatgagggagaaataaaccttgaagttttaagctgctgtggggaagaggggatctcaacatgcctgaaatcacaccggtcatctctgcccaccctcttccccacacttccaaacttgctcctcctccgcttcttctcatctcagtggaaacaaccagcatcctgccagttggtcagaacagaggctggggagctgtccttcatctccaatctcccttctcccttgcccaatctgctacccatctggggtcagtctgtctcccaaatagatccactttgttcagtctacactgcagacaactgagtccatcatttttttttcttttaagacagggtctccctttatcactcaggctggagtgcagtggtgcaatcatggctcactgcaacctccaactcctgggctcaggggatcctcccacctcagcctcccgcgtagctgggactacaggcacacaccaccatgcctggctcatcatttctctccttgataatgcagtgacttcctagtgatcactcagcccacgtgctggggggtctcctctccactcagagtgacctgttaaatatgtatggtcataccatagccctgcttcaaacctttcaaaggctgtctgtcatgctcatagtcagcctgaatttcttaaggtcctttcaacactttgtctgcctcctgtgccatatctgccttgcatttcatgatccagccagacgatgtttcattccttgaatgtgtcttcccctctgttccataaatgctgttcctgctgccaataccagtttatctacttcagcaaccccaacataccttttggacacagtatggaggacccaatcccagctagaatgcacgttttttcagagtatctgtatccattttgccctctgatgtatcctcagcacctagaggagcacttagcatgtagcaggtactcaacaagaatttttgatttgtttgttggtttgtttatgacagagtcttgctctgttgcccagactggagtgcaatacagtgatcagagcttactgcagcttccaactcctgggcttaagggattctcctgccttaagcctcccaagtagctgggactacaggcccactgccaccatgtccagctaattaaactttttttttgagatagggtctggctgtgttgcccaggctggtcttgaactcctggcctcaagcagtcctgcctcagccttccaaagctttgtgattacaggcatcagccaccacatccagcctcaataaatgttttttgaatgaatgaatgaatcttccctgatattcaaaactttggaaagatttattttgcctctttatcttcaaagcaaccaaataatgcaacaataataatagctaccattcactgagcatgtgttgtgtgccaggaatgatactaaggactctgtgatacatcatttcatgtcatcatctccatgtcttgaaaaggtgatgaatgtttaggaagcttcaatcaccaaatgcaaattaagtgccttctctgtgccatactcctctaggtaccagggaaacagtggaaagcaaaacagacaaaatccttgccattggggagcttacattctggtataaggagaaagatgataaattgggaaacaagtaaatatatggtttgtaagatggtgacaagtgttttagagaaaatcaagtaagtaaggcggatggagattgctgagagcaattttatgtagggtgttcagggaagagccctcttatcagaggtgagagagttctggggaaagagtgctctgagcagagggaacagcaggtgcaaaggccctggggtaagagcatgtttggtgcattcagagagcagcaaggaggccagtgcggaagtagaaaggaggctgaaatcagaggggctcagtcatctgtggcctttggcttttactttgagaataatgggatggtatatatattgggcagaggaatgttatgacttaactgatgtattctgggccacacagctgattcatgtcagaggattctaccacgaggctttttttttttttttttttagtgagagagagatgggatctcactctgtcacccaggctggtgggcagtggtgtgattatagctcacagcagcctctaactcctgggctaaagcagtcctcccaccttggcctcccaggtagctgggatgacaggtgcacaccaccttgcctggctaactttctttatttttgtagagacagggtcttgttatgttgcccaggctgttctcaaacttctatcctcaatcgaatctcctgtctcagcatcaaaaagtgttggaattgcaggtgtgagccactgtgcccagccacacatgagcttttaactccacagttttctctctgctaaacgtgaatccagtaacgaagtcctggcagctgcaggtctcccactcatggcttccagtttttgcctcattccaaagcacctgctgccactctgagccccattccacagctcatggcaaggagtccctctcccattgcactgaggacacacgtggccctcactcatccatttatgcaacaaatatttagttgggaactatactagttgtcaggaaaaccatggagaatgagaaatattccgtgtccacaacagtctccaatttattggaaggaaacaagtgaacaggcagttatcctccagtatttatgggaagagaagtggatgaaggaagaaaatcagaggagaacctagtgcagacagagagaatcgatgagggcttccctgagccatgaaaatgtgaaccccaagctgggttgctgaaggggagagaatagccatttgtaccacagtagcagcagcaggtgcaaaggccctgtggttggaggggcctgggacatccaggggagtgaaaggagaatgaagctacattgcagagaagaagcaccctagcaatgatggagctggaaagccaggtagggcctaaacacacaagtccatgaaagcacctcgatctttaccctgaaaatgatgggatgccactgagacattttaagcaggaggggacttggttggatgagaggctcactgtggttgtgtgtgaaacccagtgtaagggaaatcactgtgccttgtgcaggtgagagatgatggcaggtagtgatggttgagatggaaagaagtagatgaattctagagacagctgggaggaaagaaatgacagttctggttatggttgagacatgagggataaaagaaagatggagttgcaaaggatgtccgacaggtttcaggcttgtggagtgatgcatggctatgcttttcatggggacagggtgccggagctgcaggaactacagcttcccattgtgtgcctgtgccttcctacaagatcgtcctcaaaccctgagcatgttttctgtgtgcttcctttttgcagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtatggtatgatttggtggctccacctgctttggaaggaacatctaacaacacaggcacatttgctgttcctatgggacggacgtcctagtgggagagagagtaagaagtaaatagagccacactacactttgtaatgaataccatgaaggaaatgaatggagtgctgtgtcacaaacaaaaaggcgaccctttcagtctgaggaggtgacacatatactgagacctggatgatgagaaagaactagctatgctttcaaagagctaggaaagaatgttctcagaagagagcaagtgcaaaagttccaaggtggggacaggctgggtgcatcctaggaaccatcagaaggtgttggggcaaaatgtcactagcagaaggaggtataggacgtgatgttgcagagataagcagggcccaaggatgcaaaccttataagctacaatgaggagtttgggtttcactcacagtgcagcggggagccattgaacctttttaagcagattagtgacacgatcggatttgccttttggaaaagatcactctgacagccaagaatggaaacggttcctttcaaacagttgcacagtggaaggatgaccctgggactcatacagtgtttctggacgcttttatagatactgcgagatgctgttttactgaagttgagattgtgttataagtatttctgactcatttagtgttgttttggggtttttagtctctttgcgtgccacaaagatgtctagcataaatctcataccatgaactcaggtgtgcaaaaaatataaatttcttttccatctatgtaacgtaagccaaaaacctgggagttatccctgagcttccctctttcctgtattcccactgttcctggccaccgccccccacagccatgtacaatgcattggcgaattctgacagttccttcaaagtatatcatgtattcactaacttctcttcatctctctaataccacccaaatctaatcattaatatcacctggataactgcagaaactcctcagtggtttctcaatcccaatcttgttacctataattaatcccaatcccaatcttttttacctataattaatcgttacctataattaattgcaatcccaatcttgttacctataattaatcgttacctataattaattgcaatcccaatcttgttacctataattaatttactttctacttcgtagccgtaataattttttaaagcttacattaggtcaaggggctcccctgcttaagaccctccaatgactttccatccaattagaagcaattctatgttacatccttagcttgtatcaccctttatcatctggcccttgttctctgtgtgacttcctttcttctttctcctccccatcacccactgtgctctggccacaacatcagctcttgggtcactgaaacacacaaagctccttcctcccttagaggctttgtgattcagctccttttgctgtttgcaaggccggctgcttcctgcaattcacatctcaacttagacgccacttcttctgaaaaatcttccccaactacccactgaaaagttgccgctcattcactgtccattatgtttaactctctcatggcacccatcactgagcaatgcttttcttgtgtccttgttgattttttctctcttccctttctaaggtctaagctccacaagagtagggatcttctccgtcgtggtcgccactgtgatttcagagcctagggatggaattcattcagtgcccagattgaatgcgtggattctctctgtctgtgggtggcaagggcatccactgagatggactaagggatctgaaatgatggctcaaagtctgaagagcttcagcatgggatgggaatagagagtaagggcagccagtaagatggcccatccagtccctaaggttgggaataggcagttggcagtggtccacaacgttgtatggtttttaccagcagctctgagtatccctggggtggagatggagaaggagatggtggatttgaactaagcgtgggattagtagaatcagtgaactagaagattatggaagaaagagagttaaggattctgggaagagagatgtccactgcagatccacagagcctgtaccaagtgctcaagaaaagcatgttgaatacatgaatgaaaatggtatctagattgggttggggaagatgtctagcataaagagggtcatcacctgggtgggaaaaagggagtttagaagtctaaggatgaaaaaaaaatagatgaggtcaagatacgtaaaatgttaggaagaattgaggcattgagatttcaaacatggagcagtttctctgatgatgaggaagaaagtggcctaaataaagaagaggttctaataagctgagtttttacaaattaaatgagcactttttttttctttttgagatagagtctcactctcttgtccaggctggaatgtagtggtgcattacggttcactgcagcctcgacatgctggactcaagcagtccagctcctacccaagttcacatctttctctgacccccaaataactgcatgcaccaccatgcctggctaatttttgtttttgtttttttgaatcagaatcttactctgttgcccaggctggagtgcaatggcgccatctcggctcactgcaacctctacctccagggttcaagtgattctcctgcctcagtctcgcgctcggctaatttttgtagtttttaatagagacagggtttcaccatgttgaccaggctggtcttgaactcctgacctcatgtgatccgttcgcctcggcctcctaaagtgctgggattacagacatgagccaccgcacctgacctaatttttgtatttttttgtagagacatggtctcactatgtttcccaggctgctcaagtacttataagctcaagcaatcatcctgccgtggcctcagaaagtgctaggattacaggtgtgagccaccgcacctgtcctaaattatatatatatatgctttcttttttccttttttttttttttttttgagacggtgtttctctcttgttgcccaggctggagtgcaatggcacaatctcagctcaccgcaacctccgcctcccaggttcaagtgattctcctgcctcagccttttcgagtggctggcattacaggcacgcgccaccacgcccagctaattttccacttttagtagagacggggtttctccatgttggtcaggctggtcttgaactcctgacctcaggtgatctgcctgcctcagcctcccaaagtgctgggattacaggtgtgagccaccacgcccggccatgatattcttaataagcaatgcattcacatgattcatcattaagattatattaaaaggataaacactgagaagtcctgctcctacccaagttcacgtctttctctgaccacttactgctactgctttccctatgtgaacacttttattcagttaatttgcgtctttccagtccccctgagctaatttaacattttttattcttgtccttattaactcaaaagttcatgtactacgcctgtttttgatcacttaacaaaacagacgagaggatgtttgatggaggattggaagttctggagagtcccatggaaaggattggggttggggggtagtgggtggagtcgtaggagaatgaatcactggggagcaatgagagaatagatcatatgtctccatggaaactgttataataattgagaactctgttccagactggagatatagcatcagataaatcatagatgaaaacaacagtaagtcatgaaagcaaagtagaataacaaacacctctatgatcctttaaaacagagtaatcctttgcaactctagtgttgccaactagggttgtaaattaatgcaggttttatatttgaattccaactttgaacattttgcagtctggttaggtatatagatcaatctccataaacagaagaacacagctgcagtgatttgctcttccccttcgaaagatgaaagtgatggggctttggggtaatctgtttccacctcccttaacccaggaaaacaaaacaaaacaaaacaaaacatgtttttaaaccctaatggccaggtgcggtggtttgcgcctgtaatcccagcactttgggaggccaaggtgggcagatcacaaagtcaggagttcgaggccagcctggccaatatggtgaaaccctgtctctactaaaaatacaaaaattagccgggcatggtggcaggcgcctgtattcccagctactcaggaggctgaggcaggagaatcgcttgaaccgaggaggcggaggttgcagtgagccgagatcgtgccactgcactccagcctgggtgacagagcaagacactgtctcaaacaacaacaacaacaacagccccactaataatttgtggggcaactagggaatggcacaagccttttggtaagccctgtaaaaatgaaacaaggcaggaagcaatggtgaaggacattgaatttcaaatgtgtaagcccgtttcaaaatctttcaaaagaagaaaactgtggagagtttgtttttttaaacaggcagaagtgtttacctggaagggctatcttaccaaagcagggcctgttggcatggctggcttactcggaggtagatgccttctaggacttttaatacagagcattcaaacgtgtcattcacgtttaaaaattattttatttctcaacttttattttagatacagagggtacatgcgcaggtttgtcacatgggtatattgtacccaggtagtgagcatagtacccaataggtggtttttcatttagtgcttaatggtgcttagaattttatccttaactgtctgtttttataatgccttgaaactttgagttttgccaacgtctttcaagaattgaactttgaatgattgctggagtcaaaattatgctgcatatatataaattgggcagatttgtaccgtccggattgatgatacaagcttaccttataaagtaaatacagcaaatacttgatcaagtatatacacagcacaaggataactctttatattataaacgtgattcctctaaccctaatgtgctgccataataaacatgcattaaatatttaatgaatgctaatactgtgtgtcttctgagatttcatatgtgctcatggtaatgatttgtatgatccacgtctttaaaaaatagtatgcaggaaagtttgaatggaggctttcttgttctcttatacccctgactcttgcctatggatggaactgagctaatgtacgtgagttgagatgggatcagggggttagaaaggagctgggggaggcagctggtgtgctatagtggacatagatctataaccataaagaagctgaaagaagcttcagcacagaagatctatgtaaaaatggtatttactggaaaacagaaatagcccaaatggtatattcataataaatacaaaaaaaaacgaagtgactctctcctctctctttctgtccctctctcatgcacgtgcatctatctatctatctatctatctatccatctgtctatctaatctatcatctatctacctatcatctttctgttatctatctacccatcatctatctatcatctatcatctatatctatcatctgtttatcatctatcatctatttacctattatctgtctatcttattatctatcatctgtctacgtatcatcaatcaatcaatcatctatctgtcgtcatagaaagattttcataacatatcaaataaaaataaaagcaaattatggaacattatgattggcaatataaaatgtgtatagaccaattccttttatgtaatatactcatggtccctgctttcattaaactttttcttcaacatttcattatgaaaatttaaaaaatggaaaagttgaaatgattgcataatgaacatctataacacccaccacctggattccacaagtaacatttgactgtatttgctttatcatgtatccatctgtctatccgtccatcaacgcttttttaatgcatttcaaagcaagttgcagacatccatacactttacatttgcagataactgcaaatgcactttacattcagcatgtataccatttaaccagaattcaatatttgcaatgattattttaaaggtaaaattacacacactgaaatgcagctatcttaagtatatcattctatgagttttgaaaaacgcatagtttttaaaatgcagtggaggtatacacattcatttaaaaaatcacacaggcatgaaagcaactgtgatgtttagtatgttccatgggcacctgcgggagtgggatttgccctggttgaagccagagaagtcttctgtgagaaagtggctcgagctatagctaaaggacgagttaagttaactatgcaaagaggggaaatagtaaatgaaaatctcagaatgtctctttgttcctggcccccacccccaaaataggcttggttaatctgtgtggctgacagggcacctaaacttttattagggtagattcatctgctgtaacaaatagacccccaaatatatactggctcagacacaatagaagtttaaaattttcattaaacttctaagtttaagacgtttaagacaggcgcgcctggccacacccactctctccatatggtgattggggacaaggtgtctttcgtcctgtatggctccattaatccctagagctttgtttttctctgcagtcagagggtggaggaggcacaagctgcttcttaaaagtctcagcttgggaagtggcaccaatcatttctgcctactctctattagagaaaatatagccacgtggccacacttcagtgcaaaggaggccgggagaacaatttgggtggatgacacgtcgtctcagccacattccctacttttcagtcctggctgcaatttttcacggtgacacacaaaagaccttctgacttttccctttagagctcttgatgtatcacactccacacacaaaaaacttcaagtgcctcttttctgtgacatttctttgtgttcaaatcatggagcacgccaggtgttagtggtgactttcttgaagctagcacgagccaggaataagtcaagtaggaagaagtcagcagcttatgaaattaaaaagaaaaagtgaagttactatagaaactaggtgcccaggtatcacattttttctcttttaaaaatcccatccagctctgttgctgtctatgaatctaagatgatctaaaatcagaagcagagaggtgagagacagaaccattaagcttccccatctagtgcttgacttccctaaaataatcccaggacactgaaccaatgacattaaatgcctgggtgtatcactaaggaggctgtggagggtctggtggtggccccttccactagggtacccctagaaacttggcatttgtgtgacactctccaagatgctggcatcaacttttgtagctcaaaattcagaccgtacaacagagttgactatagtcttggccaagttttccaaatattagtcatttatgcacctgttatgggtttttccttgccattacatgcctcctttattcgatcatatttttctttaaagtgactttaacttgacttccttttcttcttcttaacattgccctaagcaataatatatgtgaaatcacaagtttgatgtaccagttatacatttattttaatgtgtttggtttgatataccagttatatatttattttaatgtgttttaggaaaatatattaaaagaagagtaattttgttcttgtactagtacctgaaccacatttggtgaaaaactgtcataaaatcttacacttacacaatgtaagattgaggtgatttggcagctcgattaccatggtatttctaagaatgtaaagtcttttgttacaattcgtgtgcgtacctggaagttacaaaaagtctctgttcatccccctcctccatatcctttccttcaaataaggaatatgcgcaacactgcctgtatccttaaaaatctttcgtgtgatcttgacctccctctaccctcctttactcactaaatatatccagacagcaaagctactctttggagattttctaccttcatttcctccccacccactccttccttatccttttgtattatgtctcctccccttagcaactttcagaaacatctgtctcccaggttatcagcagtcttgtaactcatatctctccagatctgagcatgaggcatcctggcttgctcaggggagtagggcaggcatgaggggaagggaactggaaataagattggaatccatacattattctgggcagaagtcatcacctttacagtaacttcccactgaaaggcataactaaggattcattcattcaagaagtatttattgagcatctactatatgccaggtacccttgtaggtacagaggcaatgtctatgaacaaaacaaacaaatatatctgcctgccctcatgaaacttatattctagtggtagtgatggtgacgacgaagatgatgataacacctaacattttttgggtccttactatgtgccaggctctgttataagtgcttagtatgtattcattagctcacacttactctatgatgcagctactgttgtccccattttacagatgaggagagtgagatgcagaaagttggaataacttgctgaagtcacacagctagtaaatggcattaaacagatcagctttgatttagatgtgtatgatttggggctttttttttttttttttttttcttctagagacagggtctcactctgtcacccaggctggagggcagtggtgcaatcatagctcactgcagccacgaactccttggctcaagtgatctgcctgcctcagcctcccaaagtgctggcattacaggcatgagccactgtgaccagctgattttgggatcttgattgcttgaaacttaacatgtaatttcctagttttaacagcgattccgtggaatgtcacaaacatattctaggaggttagtcatttttccctcttattttctcatctttccctctaagtgctaagcagagtttatggccaggtgcagtggctcacacctttaatctcagtgctttgggaggccaaggcaggaggatcacttgaacccaggagatggagcaacaaagggagaccccatctctataaaagcaaaaaacaaaaaaaaattgcatgccttattttcagtgtaagttgctgccattagacaaaccacatactcctagtgatggagggctctgggttttctgttcatcctcatcactctgtgcttattggctacctgtccatgtgtaaataacacatgtgccctgtgctcattggaaccgtgagtcatccgcagggattcctaagagggcccatgagaatggctttcactcctccagcctctgcccttctgacctcctccacaggcttcagccttatgggagtccccaagtcttggaagcatctctagtgagtgcagtgactccttagctggttccttttcaaccttcaacctccattttcttaacccttaccaactctactgcccagctgcacccactccaattccactcacaccctgcccattatcgccaacgtttctgagctcatgctcattgacaaggaccatgccatggatttgcatgcattatatcatattaattcacaccataatcctgcaaggtagtcactgataatcactctattatatcatatagaaattgtaaggcagagaggttaagtgacttctccaagaaggaggcgggaccttgaaagctggttttgtgatttcagttgcctcttgccatctcttctccactttggggtccacacatcttcccaaacccctagtttaaattttttttttttttttgacaagagtctcactctgtcacccaggctggagtgcagtgacgtgaccatggttcgctgcagcttcaacctcccaggctcaagcaatcctcccatctcagtctcccaagtagctgggactacaggcacatgccaccacacccagctaatttttttattgtttttgtagagacagggtcccactttgttgcccaggctggtctcgaactcctgggctcagggaatcctcctgccttgacctctcaaagtgctaggattataggagtgaaccaccatgcccagtccaaaccactactctttcctcttccttttttcctttctttcttccttccttccctttctctctttttgacttttttgaaacagcagttacaaaacgattacaagagctacctaatgaggccaggtgtggtggctcatggctataatcccagagcctctagaggccaagcctggaggattgcttgagctcaggagttcaagaccagcccagcctgagcaacatagcaagacctgatctctaaaaatgtgtttaaaaattagccagacacagctggatgcagtgggtcatacctgtaattgcagcactttgggaggctgaggcaggcagatcacgaggtcaggagtttgagaccagcctggccaacatagtgaaaccccatctctactaaaaatacaaataaaaattagccgggcgtggtggcgcatgcctgtaatcccagctactcaagaggctgaggcaggagaatcacctgaacctgggagtcagaggttgcagtgagtcgagatcatgtcactgcactccagcctgggcgacagagcgagactccgtctcaaaggaaaaaaaaaaaagccagacacactggcacacagttgtagtcctagctactctggaggctggggcaggaagagaggttgagcccaggagttcgaggctgaagtggctatgattacaccattgcactccagcctggacagcagagggacaccctgtctcttatatatttagaaagctgcataatgacatttgtgggtttctccttcttccatgaaaaaaaaagcaaaaaatggtatctcatgactgcattggtatgaagacaaatatattaatattacatattaaaacatgtacttccacctaggttcacttttttccttgtgatttaaaaaaaaaaattaaagtgccttatgaaccttgaaaacagcatgggccctgagcactgtgcctggtgggttttgatggagaagtcagccctatgttccagctccagcatctcaatagcacctccctctgcagcctccaaacttttcttcccaaaggccagggtgcttaactaccatgctctgtgagcatgagagagcattccagagttccaggccccagacctcagtgtcccttttttttttttttttttttcctttttgagacagagtcttgctctgttgcccaggctggagtgcagtggggtgatcttgagtcactgcacctcccaggttcaagcaattctcctgcctcagcctcccgagtggctgggattacaaacgcctgccaccacgcccaagtaatttttatgtttttaatagagacagggtttcaccatgttggccaggctggtctcgaactcctggcctcaagtgatccgcctgcctcagcctcccaaagtgatgggattacaggcttgagccaccacacctggcctcacagcatcatctgctggagccaagcccggcaccagattttaacaggaagaaattgcctgaggagattaaaaggcagcttagttcatgccaggaacaaaggccttctctaaagtctgagcttctgttgtgggagtctctactaattttaatctcattagtggtatgtattcacacacagacatatacatacatacattagatgtggttatataatcctacagacaaaagcacttccctgtacttcagcctgctttgctatcttcctgcaccatatggtgagttcctttatcatatggttcacagatagctcaaagtgtttgctacctgtttccttaatcctcttccagagaacctttttgacatttgctgtctgatcttggattcctgccttctctttggttctatcgcaattatgtcacttccctgcccccaccaagccttcaacctttccttctttcatatgcaattctgattgcagcgtgtttttttttttttttttgccaactcatcttcccagatcctcgtgaggcccttcttccaccttcccgaattttccaggtctctcctcaatgaagtgacttactgctcttccgcagcctctgccttcaattctcagaaggtagtatgttacaagacaagataaggttcatttttctcaagaaaataaattatatcaaggaaaatgaaatgtcaggaatttaagttttacaaccttccatctgctgcaagtagattgtcaagccagagtgagtaaagcgggtatttgctgagaagacatggcttgtttctgtgtatctcaagacacccagaggcaagaagtgccacctgaatgagagagcttccagcagtctgataaccatggctccatctggggggttgtaggggggcccccagcctgtcatccctgcttctcgatgacatctctctgcagatacgcatcagcaccacctctctcagccttgttgatgcttctcaagtctccatgtctaattctcacatgtagaatatcctaggaatctaaaatcccgggaaagaaaaactgatgggccagtgtggaccagggatccctaggatccaattcactgtgaccggggaagcggttacttttccaaccatccatcaggaaagatgacaagaaaagcaaataggatgtgggcagttttcctatgagaaagaagaaaacgacgggcctgtctggcacacaggccaaagtgggagtttcctttaaatgtgtattattttttattttaatttttttattttgtttatttatttatttttgagatggagtctcactctgtcgcccaggctggattgcagtagcatgatctcggctcactgcaacctccacctcctgggttcaagcgattctccttcctcagcttcccgagtagctgggattatatgcgcatgccaccatgcccggctaattttttttttttttttgtatttttagtagagacggggtttcaccatgttggccaggctagtcttgaactcctgacctcaaatgatccatctgccttggcctcccaaagtgctgggattacaggtgtgagccactgtgcctggccttttattttaattttttagagacagcatctggctttgttgcctaggctggagtgcagtggcatgatcttagctcactgcagccccgaactcctgggctcaagcgatcctcctgcctcagcctcccgactagctgggactacaagtgcatgccatcgtgcctggctcatttttgttttttttctagagatgggatctcattatgtagaccaggctggtcttaaacttctggccaccagcgatcctcctgcctcagcctcccaaagcagtgggattacaagtgtgagtcacgtcgctgggccctgtgttttctctaaaatgttgcctgattctttgggaaaaatatcgcaaagataaatcaagtcctcttgtagaaggaccagatagagcccattaacatggaaactctgtctcaggtgatcattcatggctactggtccaattattgtgctatcatggtacctgccatcctctgcatatccatctcaactttatctctatgtattatttcagaaatttacagtcctggtaaaatgaatccctggttactaacagcataacccataatcttttctataatacaacaaacataatggcagaaatttgtggattgtaatcatccaacacccatgataaatattttggatgtacaaatgtggatggtacctatgattattcatgccgtagttgtttcaaacccccaccccaccccacagtttcaccttatgtactgacctcattgaacaccactgcggagattgataacatttttggagcactgggaactcatctgagtgttttataggcattgctcatttaatcttcaccatgggtcttgtgaagtgggtgctgttattatctgcatttttaaatctgtagataaagagacagagtctctattttgcagatgagggaatagaggctcagagaggtgagaagcttgcagtcctgaagcggtggaggcaggttcaaaccagggagcctggctgcagaatgtgttgccactcagctccatagtccccttgcatccagtgccccctactcctgctgtgctgaaacccgttctctattagcagtgctctgtaactccaacaacaaaggggggcagtgcttacaaggcagatcagattataaacaagctttcttcctgccacctaattgttgccatgaatgacaggactttaagggtttcatttcattctctttcagtagaagccatcaattattagtttattttcccagcaaccatttaaaaaagagtcaaattaaatctgcttttattttaactatccagctttgtcaaatataacataggattcaaagaaatttgactaagccatatatgtcaccaatgtttattttatttatgtatttttttttggcatttctgttcttttgtgagtgtgagtggtgagaacacttgggatctcctcccttagcatatttcaagtatataacacagtattattaactgaattaccatgccataccttttaaattgctagtacttatttatcttgtaactgaaagtttgtaccctttaatcaacatctccccattttctctactcccagcccctagcaaccaccattctgctctctgtttctttaagtttgactattttagattccacatatgtgagatcatacagtatttgtctttttttttttttttttttttttttgagacacagtcttgctctgtctcccaggctagagtgcaatggcacaatctcggctcactgcaacctcacctcccaggctcaagcgattcttctgcctcagcctcctgagtagctgagattacaggcatgcaccactatgcccggctaaattttatatttttagtagagacagggtttcaccatgttgaccaggctggtctcaaacccctgacctgaggtgatccacctgtctcagcctccccaagtgctgggattacaggcgtgagccaccgtgcctggccccagtatttgtcttttggtgtctggcttattttgcttaggataaggataaggtgctccaagttcatgaacatttatttcagctcaaaagaaccgttcagttactggaattgatcaatatcaattctattggtaaaaatcaattctactggtatcaacaattagacgacacagcccagagtgtgaaaatagtagttctctcgcatttcttgttacaacccaattagacatttcttattagacccaaccacacatcctcatttaaataccagggccaggtatttcaggtttcaatctccttgttccactcctcccctttctagcagtcactgtgagtcatcccttctaggggtgtagtgacatttgcttaacaatagcaagtccacagaaaccagagatgactgggctaaatgcaccttcattctaaacttcgtttcacactttcatggctttctcagctagtgggcaaaaatgctacttgattaaattacaggtgtggcatggcctcattttaaaaggttgaaatcttaatgcaacctgtcaatctgacctctgaaatgaaaaattagcttatctatcacacagatccatgcttttatcatctataaagagatttttaaatacagaaaaccttacgtaataaatcaagaaatagccaagttgtatcatccgagttgatctatacgccggatatcactgctcttcttttcatctggccaacgtgaagactgtattcgaaaagtgctgcagtcctacctacatccacactattaattcccaagcatcttctccccattatatcactttccagtttttcctgaggtacgtcttcacttggcagagtctacccagttgccttctcctaaacagactgttagaagtctgaaatcatttttagactgctggcttcctctttactgctagaggcaagtgcatttgattccttcaaaccacatgacttcgcatcagactgatgtggccactgtcaaatgtaacatttaaacatatgtttgtgtggacatatgtgtttggaacatttcatccgaagtctgacgcttaagaatacactttggaaaatcagaattagggccttcaagataaactagaatgtgataggacatcttcatttctggtcaaagttggaagtttaggagagcctcaaaagtgaagaattcgccaacaaccatggtgaatgcagtgtactgagttcttgtaaccacccggtgggatcttcttgcctgctccccagatagagccgatttctcaagaggggaattataatagggaaagagctttacacacaaagactcaaatcagcctccatgaatatttggaggctagaatttttccaagatagtttggcagggagaggaggtggctagggaatgggtgctgctgattggttggagatgcagtcataggggtgtggaaaatggtccttatgctctgtatccacttctgggtggggtcgcaggactggcttatgggttcacgtcggggctgtccagtagtcagaaagggaaaagactgaaagacatctcaaaaggccaatctgcagttctacaacagtgatgttatctgtgggagtaattgggaaagttgcaagtcttgtgacttctggaataatggctagtaatcctttatgtctacaccttagccgaattcaggctcctttcatcctcctaacttggcagtctttcattagttttacaaaggcagtttagtttgggggaagggctgttaccatgtaaactatacactaaatgtttcccaaatttagcttggcccaagtccagaaatgactaagggcagtttggaagtcaaaagcaagatgaggattggttagatcagatctcttccactgtcatcatttagttataatttttgcaaaggcgatttcattctttgctatatgttaagctgttaacatgccttatgtcatgaaatcatcatcatggccctactaactcttgttaatggactcttgtctatattttaccctgatatccaacctgctgtgagacctcttgcttttgtttgtttgtttttattttttgttttttgagacagagtctccctctgttgcccaggctggagtgcagaggtgagatctcgggtcactgcaacgtccacctcccaggttcaagtgattctcctgcctcagcctcccaagtagctgggattgcaagcatgcaccaccatgcctggctaatttttgtattttttagtagagacggggtttcaccatgttgacaaggctggtctcgaactcctggtctcaagtgatccacctgcctcagcctcccaaagtgctgggattacaggcgtgagccactgtgcccggccaagacctcctgtttggaatggctttcccctccattccaggcctctggttatcagagatgaggtagcttaagcccttcagtgcttaatccctggcccaggcagaaggagggctttggcaaatccgcatgctagaaaagatgagtttggaagggcctggaaaccagggtacatagttccttttcccttgagattttagaagttgacagacggtttgctggttttgtagggaaatcctatctgccacagagcatgtggattacccagggaggatcctggaggtcacgtgcccagtaccacctctaagcacagacagtatgaccttgcctttcactctgggctttgtgtaaggatctcccaggacatagatttcatagcgacattggtcgattgctctgattcactttctgcctttctctttcttgcatatggagaatgtgggaaagaatcccctatacacacccacaggagttagaacatccttcttatcctccataatcgtgccttcaaattaataattatggcttgctgtgtgttgggccctgagcttaacctgcattatgtcacttgatctcacaacaaccttctgagggagaaactgtcattattccccttttatggattggggaactgagactcagagaggttgagtaactcagccaagaacacacagcaaaccatatgatagagtcaggatttgagctcatgattccaaagtctgaacttgaaccttctatgactataattctaattagatataagcttccagatcatcagactctgtcgatgccataatctctttcttacatggcagagatggtcaggatacctgccacgtggtaaagacgtggatgcagaagttaacctccatttgattagcttcggtgcaccaagctgcacccaggtttctctcgaaatcctgctcctgagtgggtgagtgccccgggaagagcaggtggttggcgtttgctcagttttccagcccctgatcaccctgatggcctctagccagcttttctctctgtcctcctccagtgagggccaggcctggcacaggcagcctcccaatgtttagaaggttccgatttaattggtctagagtgtggcccaagcatcggcttctaaaacctccacagggagttctaatatgcagcagggagaagcagcagctcagtgcagcaggcaaggctcgtccacggaagggctgggggaaggaaggagatcatatttgccttaaaacttggagttgagctcatctgacctaccctctgcaggtcttcagggggactgggaagaatccatgcaggagatagccccagagatcaaggggatcctcaaagagatgggatcttaagatagagggagggtacactccttgcaacagatcagcaccctgaccctgtacccagcctcgtccacaaacctgctccctagtgctgggcatgggatacagagctaggggtcgtgtggtcccccggaggcctacagtatatacacatgagctgtaacttgcttgtctgtccctccccaagttgacctcagtttatcacaccttactgatgctcttctgccaatttagtgtttgaggaccctgtgagccctaaaggtctctttctcttattttattattttattttattatttcatttatttattttgagatggagtctcactctgtcatccagtctggtgtgcagtggcatgatctcggctcactgcaacctccacctccttggttcaagcgagtctcctgcctcagcctcccaagtagctgggattacagatgtgcaccaccacacctggctaatttttgtacttttagtagagacggggtttcaccatgttggccaggctgttcttgaactcctaacctcagatgatccacctgccgtggcctccaaggtgctgggactacaggcatgagtcaccgtgcccggccgagataggatcttaagacagagggagggtatagtccttgcaacagatgagtaccctgatcctatacccagtgtcatccacaagcctgctccctagcagggatgggagagggagctagggagggaggggcatgggagagggaactagggatcgtgtgatcccctggaggcctacagtatatacacatgagctgtaacttgcttgtctgtccctccccaagttgacctcagctcaccacaccttactgtgttgaggtataatttacagaagactcacttgtttgtttcatgtaatcttgaatgatgctcttctcccaatttagtgtgtggggacctaagagccctaaaggtctctttgtctattttagatgcaccatctgaattcaagttagaatcttttcccaatcactgtttgttagtcaagcttgcagactgtgacagtgctagatgttttggtctcttcttccttgcctcctcctcctccttttctgattctgttgcagggatgttattaagaacaccatccacagcacagtgtgttcaaacatccatgcaaaacatttctcttagacctaagttctagagaaagcttatttttctcctcaaaaaacgattttcattatagaaaatatgaattttgttatgttgcatatatttctgattgctttggtttccaggaagcagaaagagaaagtaggagagagagaaagagagagagagaaagagagagactgagaagaaaagagggagagaaaaaaaagaaaagagaacgaaggagagagggagatggcaaaggagggaaagagagagtatatatctataaagtatatatgcatacatgtacacatacacgtgtatttactatattctttttttctttttgagaccgagtctcactctgtcacccaggctggagtgcagtggcatgatgatctctcggctcactgcaacctccacctctcgggttcaagtgatactcctgcctcagcctcccaagtaactgggattacaggcgtgtgctatcatgcccagctaattcttttgtatttttagttgagacagggtttcaccatgttggccaggctggtctcgaaatcctgacctcaagtgatccaccctccttggcctcccaaagtgccgggattacaggcatgagccaccaagcccggccactacattcatttttaaccacctgtgttgaggtataatttacagaagattcacttgtttgtttcatgtaatcttgaatgatccctcaaattctttgtgaaatatgagttggatggagccttatgtaaattaaacaatgctgacacccaaggaactgaagatctttagtgaccttgatctgggagatttttaaagcaacttctcctactcatgaaatcctttcattcattgattcaacggatatgtattgagtgtcaactgtgtgctagatgttggggacatgacagtgggcagctcaaagaaaatgcctgccctcatggagcttccactcttgtgagggataaaaataaacagatagatattaatataatgcccgtgtggtaagtgctgtcaagaaaaacaaaggaggggaaggggatggaaagtgacaatggggcctatgagtttagagaaggtggtagggagggtgttggtgacagggtcacattggagtgacctgaacaagatgagggagcaaactgttgagtgtccctaggggaagagtcatgcaggcaggaagagcaaaaggcagtgattctgagaggtgagattgagtcccaagtacagtaggaggacagaggaaagccttaggaaggtggagtgacatgaacaaacttaagtttctaaagcatcgttcaggtgtatagagaatagaatggaccaggtgcagtggttcatgcctgtaatccagcactttgggaggccaaggtaggaggatctcctgaggccaggagttccagacaagctggggcaacagagtgagacctaatgtctaccaaaaaagagagaaaaagagaatagaatgtttatgagagcgagaagaggggaagcagaaaacagggtaggagacaactgcaggaaaccaggctaaggatcaaggtggctcagatcagcaaagaggttgaacttagtatatattttgaatgtagagctgacaaatcttgtgattgtactggatgagagatacaggagagaggaactgagggtgactggatttggctttggacttgtggcaagtgtatgttgaagttgagcagttgggaagcaagatcttgggtccctggctgtctctgcccttgcacactagtgtggccatttgcactgctccctcaggacaaagctcccgggccagttgaaaaccggaggttggtgctttgtacaaagctcaccatcagccccctttgttgtttggtgaaaagatgatgttgacgatcaccactgtaatgggtagaattgtgtcctcgtaaacaatgtatgttcaatttctaatgaaggttgcctcacttggacatagggtctttgcagttataagcaagttaagatgtggtcactctggattagggtgggcctgaatccaatggctggtgtcctcataagaagagggatatttggataccgacagaacacacagggaagaataccaggggaagacagaggcagagattggagtgatgcgcttaaaagccagggagtgccaacggtagctggcagccagcaggacctaggagggaggtgtggatggaacagatcctccctcagaatcttcagaaggaaccaaccctgccagcaccttgatttgggacttccagcctccagaactctgaaataataaattccttttgtgtgaagtcactcaggttttggctcttccttttggtcatgctaggaaactagtagaaccaccaggtattaaatatttataatttgccatgcacagtgctaagttaaggtgtgcactaagatactttatcccataaaactctctcagcagcaccaaaagcaaagtattgttggcatctccattttataagatgaggagaagattgaggttcagaaaacagtgaatttctcaaggtcgtacagcttgtatgtggcaaaacttggacacgtaccaggttttctaactctaaaagtccatgccctaaccattatgcaacgctgggccacagtcaggggccgagattccaggcacgctttgccattgggattcgccagtaaagttcatcaccacaaactttccagccaggaatccctgggctactttcctctgttttatttgctgtcatcagagttctgctatttatcacatctctcccagaagattcttgggggaacagatgtggcttggaatttgataagaacgtcacttcaacacatcctttcagtctgtttggaatcctcaccctggagagagagggacagctgaacaaacagcccacgccctctatgttggtattaaagtttctggaagctccagaaactgcttgagacaattaataagagatcatttccatttaaaggaacatttttgaacgtgggcatcaccagccagggcaatggctacttttctgctcttttcctctcccatggcaaaacttcacagcatatggccgggcgcggtggctcatgcctgtaatcccagcactttgggaggctgaggcgggcggatcacgaggtcaggagattgagaccatcctggctaacacgatgaaaccccgtctctactaaaaatacaaaaaattagccgggcatcgtggcgggcgcctgtagtcccagctactcgggaggctgaggcaggagaatggagtgaactcgggaggcggagcttgcagtgagccgagatcgcaccactgcactccagcctgggcaacagaggagactctgtctcaaaaaaaaaaaaaaaacttcacagcatatgtggaggcagaaaggtctgcccaagccacttgatggaagcagggccgtgtttgtcctgcttattgggcacatcaccagtgcctagcatcatgcctagaacaaaattcccaatagagcttgtagacctgatggaagaactggaatcgtgactgcagcatgaatgcacaccaagctcatctcgccaagcaaatgttagtggttgtataagaaatagaaaaaggaaatgactgttctctctgtggctatgtgcaaggtggataggaaaagaggaataggaccaggatctaaaactgaatttaaaatattccagcactgatttgctcaccactgaacacttggcacttagggcttgatgatgggtgtgtttaagggcatggatttaagggacaggtgactaggtgtcacttcctagtggaatacggacgagtcacctagctttgttaagccctcccttcttcatctgtaaaatagggatagcagcagtttccaccttacgtatttactgtgggaattaaataagataatgcatattggaagtaatcagtgggcatgtacatggttattgttataaagtccaaactgtcccaacgttgccctttttttccttggcacaaacactaggcctttgagtatcacaaattctttgtccagccaccctacttggtggctggatctctgtgattctattagagacaattgtctgctacatctcagagagatgggagtcagcatctgcaatttgatttctgaagcttaagtgctcatatccttataggaatcataggccaaggtttgtagatccagatcgtttaatcctaaggaagcactgttcttttccctttggctgaaatatgcctcctgtgtccccgccttgctagtcctattgatacttcaggtgtcagcttaaccatcacttcccgaagagcatcttttgctgacccactcagcgatgttaagtcttccatttaaacactccaagagcaatgtgtacttctgtttcaggggtctcattatgattgatgttaggtagttatttgtacaggagtgtaagcttcatgagggcaggaaccttgtcgttctgcattcctggtgcctatctcagtgtctgacacatcctagaccctaaattaatgttaactgaaagaattgtctagtcttctaggtgctggataaaactaggaaagttgatgcatttggaaggcccaatgaattccatctctgttgcctctctcagttgaagctttaaacaatattgttattattgattgaaaagagcatgcataaccaaacccaaggtggcagggaccactgctgaccaagctgggttgcaaattaaactgcagccatttttgatcatgtggttactcttcttttccctgatccttcttgaaacacttattctaaaacgagggtcagcagactattggaacccaggctactgcttatttttgtaaataaagttttattagaccatagccacactcattcacttgatccagaccgccctgcaaagcctataatatttcctgcttggccctttatagagaaagagggacttgataaatctgttctagttatctattgctatgtagcaagtcattccaaaacatagaagcttaaaacaacagccatcctatattatctgtcatggtttctgtgggtcaggagattgggaatgatcactggttggttgtggcttgaggtttttcctgcactggctggagcacctggggctgcctggtcatcaagcttatcaggtagtaccagggtttcttcatggggtcttgttccctggtctagcattgtgtcttggggtagaaaggaaagaaactgacagaagctacagcctcagaagtcttgcagggtctcttcaccacattctgttcattaaggcagccgcagtgcctgcccaggttcagagactctggctctgattggaggagtatcaaatatttgtagacatgttttaaaacctctataaagtatcacttccttcgtgctatggggacagctctcaaaatgtaactccaagagaggacagagagatttatatcgaaaatgaaagcttgattagaatattaagaagaaaaggaaagttttctctcatcctattaatgactgctgagaaagtgttaggaaaatcaggatggaaggattctgtcagctttacctactgacatctcctagccaccttattaaatgaatcaattttgataatatctggtgattataatcaacataggaagaatatgtttattaaaatgcagactcccaggtcacagcccagagctcctgaaggagagggagtgcttggaatctatatggtaagcaaagaccctcaagtgattctgacataggcaagaggcactgtcctttataaagactggaatttgccttgttttaggtcacatactgacatgatgctacttggcttcatgtattttaattattagtaagaatttgagctacctatgtaataattttgttttagggatctctaagatacataatccattcaaagtaatataaataaaaataactttattggaggaacataaaggtttcaaacagaaaatggctaagcctcatgagagattggaaactgaaagcaaggcctctgcttgttctcttaccttctttgtttttttccccctgcctcaaacatctattttattcctctttgcctgcacagtggtagaaaaggaccacgctaggctgagtgtggtggcttacgcctgtaatcccagcactttgggagacctagatgggcggatcactgaaggtctggagtttgagaacagctggggcaacatggtgaaaccccatttctactaaaaatacaaaaattaaccaggtgtggtggtggacgcctgtaatcccagctacttgggaggttgaggcaagagaattgcttgaactcgggaggaggtgaacgaagatcatgccactgcaccccagcctgggcaacagggtgagaatctgtctcaaaaacgaaaaacagaaaacaaaacaaaacaaaacaaaaaaggaccactctaggaagatctgtgtattctctgttgagggacccaggactgactcctcagagtaccctaattcaaattcttgggagggggaatccgattggcttggctcaggttgaggaacttacctctgatccaatcagctgtgaccagctgtatccactgcccaatcagaaggttcttctaataacacagagttggaagaagtgaaaggcatgctagggttttcatttccaaattaaactgcagtcattttttatcatgtggttactcttattttccctgatcttcttgaaacacttgttgcaaaacaagggtcagcaaactattggagcccaggctattgcttattgttgtaaataaagttttattagactacggccacactcattctcttgatccagaccgtcccgcaaagcctataatatttcctgtttggccctttatagagaaagtgtcctgactcctgctctagaattcagttcgcttctatgtctaaatttttgctatgccttatgcatgcccgttctgttttccgttaatcagtatagggcatgttgttgagggcagggcaagacactgggaatcttcacacacccctgtttattgatttttaaaactatctgtacaaatgcaatagtatctcctacgatgcggagcacatagcattgctgatttgcaagaagatttcaactgctacttgagattgttttaggtgccgtgtagttgcactatgaaataaaattaaatcacgttatgataaggttatttctgtgtctccttttactctttctaattacttgaacaagcaaatctcatttgatgacaatatgctctctaacaactttctaatacaattttttcctttaacaaggagaagatgcagagcctgactcagaaccttcagcagccagcagtatatagctagaatttactggcaccgctttgcttttatttatttttatgcttatcttccatttatgacttgtgatactggcttgccattaatagtggtgatataaagtttccttttcaaatttagttaagttgaaatgtgactagatttttaaaatgctaagcaaataacagtttaggtggcaggaagaaatgtgaaaaaacggatatgaatgattgaagtgcggaaatgcctgagctacagtaactgacatagttacaaagcagccctggtgcccagaggaggtagtggccgatttggtctgaatggaacctccagattagaggaggagataacagcccagtggaatctcagattttcaaagcagtgcaagagcatggaaggacgtcatagacagtgggagtcgaatgttcaaaggaaaagaaagaacaggatgtggtcatggaattgtttggctttcaagagccactgaagggctttcagcattcaagtggcacagtcagagctgcattttcagaacagtcattagctgaagcaagttaatctccctgagcctcagtgtgtttatctacgaaatgggggtaattgacacagatgtaggatgtccacccctgtccctggtgaagggggaaattcccagccattctgccctgtctctcttccatgtggaaggctaagatgtcctatcatgactgcatctgcactgaaggtgtctagggcccctccttctctcgttttggttgggggaatgggagatagttgcagatattcaggattgttggatggtgccttgaccggtggtgatgggtcagggagagtgtattagtccgttttcatgctgctgataaagacatacccgagactgtgtaatttatgaaaaagaggtttaatggacctggggaggcctcaatcatggtggaaggctaaagtcacgtcttacatggtagcagtcaagagagaatgagagctaagcgaaaggggaaaccccttataaaatcatccgatcttgtgagacttattcactaccactagaacagtaggcaggaaaccgctcccatgattcaattatctcccaccaggtccctcccacaacacgtggaaattacgggagctacaattcaagacgagatttgggtggggacacagccaaaccatatcagagggtgtccactgtcaaggacagctcagcaccaagcccttcttactgggctctggagtttctcagctgagaactcttcttctttccatctccaattcctctgctcacttgtcttccagctaagtcacctccctgccccctccctgcacatgtcccggccccagctctctctggaatccaggagcaggaagtccctgtctccacctgactctacatcttaggaaagtgactcccttgagtcattgtttctgtgttagtaagcattgaggaaggaaaatacatcccttgggtaccagggagagaacagagggaggcaagaaataaactgaaggtgcccatcctagcacttggagccctgtcttgccatgcacgtaagcagagggtctgcaggagccactcagactggcagcttttcttttttattgtgctggggaagaaagaggttaaaaagagttctcttgctgtggaagtgtgtgacagggaccctcttcctaaggtgtcccaaatccctgcatctgcctggcctttgtcactgtggctgtgatgagagagaagatggtgaggacaggagataggaatgctgtgagctggcaagctcagctcggaagcttcagtgcatgggtgcatgatctggaagcttctgtgcatgagtttagccagaccttttgctgctgggataagagctgagtggggtgtgcagagctgccttcctgctgctaagcttattctatatgtcaccccttctagcctgagtcctctgttgcatcctctggtcctccagctgagttgagtgtagcatctaatttcctcaatcacctgaactctggccctgattggttcccttaccctcctgagccttaatttcctgcaatatgggattcacaatggcacctacttcctatgatgttatgcaatacaaatgagtaacaataagtgaaaacctggaattgtttggtcagtagaaaagtgctcaaaaatgtaatggtggttagtattgttgcctgcaaaatatctgacacagtgcatgcagtgaatacttcaatctgattctttcttcctccaggaagccttcctagaagtccccaaaccaggttaggactcttcgtaatggggttctgccttgtgcttcctacagggcttcttgagacaatctgctggtcattgttctgtctggcataatcacaaccaaagaatgttcaaagaatattcccccggttgggagagtgggagagggggtgacacgcagaaaataccgatgtgtctgtgagccacactggttaactggccctgaatatgaccacagcacagctcatagaaggaagccccaagacaacaggagaggctgttaaaatattaaattaatcatctctgtaattaatttgcaaaatatttcttcctctctggagttaagggtcagagaacgtgcttgtttctttattgctgtatccccagtgcttagcaggttcttagtgaacattaaatacttgaattaataaaggaacaagtgccctaattttagttttgtcagtcattcactcattctgtcattcaacaaacatttattgaacatgtactatgagccaggagctattgcaggctcttgggttacaccagtaaaccaaaacagcaaagatacttgccctcatggggcttaccttctagctgggcattgacacattgcctgttacctcagagggatcaatatacaatcatctcccctggaaccatcctctcttgattgagttcagctattcaaagtgcgaggtcagggctggatgcagaatcacccctgtaatcttagcactttgggaagccagggcaggtggattgcttgaggccaggataccagcctgggcaacatagtgagaccttgtctctacaaaaaataaaaaataaaaaaattagccggacatggtggcacttacctgtagccctagctacttgggaggctgaggcaggaggatcactgagcccaggatttcgagtccgcagtgagctatgatcatgttactaccctctaggctgcagtgagtcatgatcatgctattgcaatctaggctgggtggcagagcaagaccctgtgtctgaaaatataaaagtgtgaagtcaatagaaaacattacctgttgtttcagagtcaacagaaggcacctatacaaagctaagtgtggctacaaatgaacaccagctgctcataactggcccccagactccttccaactgccctgacatgcttgctctctttcccaggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggtaacttgtcccatggccctgggtattccacctccagggcttcaccaggctttggccaaagctatcttagcagcacccagcacagagatacctgcacccttccctttctagacacagaaagatgtaaggcccagggaagtcagctgagagttctgaggttgctactgagaaacgctctcccctgagacagatgctgtctcaacttagataaaggaattcaggcaactggttttataattaacagagcagggcctttctctgacagcaaggagtgacttggggacaggagctgggtgaaaaggttcacagcttgtggatctagatggttccattcagccctctagacctttggataaatgcacaagtacatctctgcaggttgcctgaggcctttgcatgggcctcattggagggaggatgttgcctgagaacacagccctcgaggactctcagggaaggtacacagtgtcctgggaaggagctagtgagttcagagccatggctgccaaggtgagaagggagcacttgtccatttgtccattttctgctcttgactgtgatttcaaccctatctgcaagagcaagagtccctgctttaagtaacctcttacctttccctgttcaaattagaccttggtttccatacccagggatggagaggccagagcccaaatgcaaaggggtacaaagttaattgatgccttttaggattctcagggccaatgacctggtgacttaagatgttttggggacttttcaagattaattttgactctatccagttctcaacttactgagtagagtgactgattttagagcccaacccatatatgagatgggacactacagtactttgcatctaatttgatgtctttagtgatttccctctcactttaattcttttcttttatctgttctattatctgctgaagatatcctgggctgtgtgacctgtagcattttcacagtctggatttcactgactgtacggtcttggggcacctcaacatgtttcctctgtcttctgtatttcgtgcaattggcagctggttctggaggcttggtcagactcagctaggatctctttggcaagaccatagatggtgacctgttctttcatctgaagtcgtataatggcttgttgtctctcatagtgaagttggcagcgactgatggttggtgcctagatctgttaactcattagggattgtaaaatggtgatatcctaattctatcatttatttttcatttactagtgagaatgcctttataaagaagggcctcccttcacctattacttagttccctagtggtatagttcctgtgagaaaggcaggataaatgcttgattctttctctttatttaatagttctcaagataataaattggttcactgttgtgctccaagggtggctaaagttggcttttttttttctaaatgggtctggctctgtctccccagctagagtgcagtggcatgatcatggctgactgcagcctcgatctcccatgctcaagtgatcttcccacctcaacctccctagtagctaggactacaggcacacaccaccacgcccagctaatttttgaacttttagtagagaccgggtttcaccatgttgtccaggctggtcttgaactcctggactcaagtgattcacctgcttcggcctcccaaggtgctgggattacaggcatgagtcaccatgcccggccaaagttggcttttaaaataaactgttttgagtggaagaagagacaatagaaagaaaaatattaagtgaatgataatttacatcatgcaatggagacttggcaaagaccaggaaaggggtacacctaaccttactagtccaaatctctagtcttaccatggggatttaaggcctaaaggtgttcaagtggtgatagagacaaggctgggatttaaacctctaggctcccctactcccttaccttctcccttttccattggttatccccagatggattcattgacatcatcaggcaaaggacagtctccgtccagtaaatcaactaagtaagaaagggaccttgtgcccagcatagaggctgagcagcagcagttttccattttagttggatatgttgagagtgggagaaatgaatcatgggtgactaatgttcattgtagtgtctttgtggtttattattttaaaaatgattaaatagagtagatttgagattattcttttaatattgaaccaacctactcacctatatttcaatatgctttctggaattagagagtaggggctgggtgtacatggaaattttgcagaagtctgggtcccctccagggattgtcatgtgccagggaagagagactgagaaccaggagagcctagaacacaagagcccagtgggtttgggtcttgcatggtgacatgatttggctgtgtccccacccaaatctcatcttgaattgtagttcccataatccccatatgtcgtgggagggaccaagtgggaggtaattgaatcatgggggcggttacctccatgctagttatgatagtgagtgaattctcacaagatctgatggtttaagagggacttttaccccacttcgctctgcacttctccttgctgctgccacgtgaagaaagacacgtgtgcttccctttctgccatgattgtaagtttcctgaggcctctctagccatgctgaactccgagtcaattaaacccctttcctttataaattatcccatctcaggtatgtctaatggactaatgagaatggactaatacacatgggaatgaaggcctcccatgttggagaccaatgcaagtaattgaatcgtgggggcagtcacctccatgctagtcatgagagtgagtgaattctcacgagatctgatggttttatgagggacttttaccccatttcgctctgcacttctccttgctggtgccatgtgaaggacacgtttgcttccccttctgccgtgattctaagtttcctgaggcctctctagccgtgctgaactccaagtcaattaaacccctttcctttataaattaccgagtctcaggtatgtctaatggactaatgagaatggactaatacacatgggaatgaaggccttcccatgtggagaccaatgcagaatctccccaaccgacaagtccaaggatggaacagattgctttctcagttgttgagggtctgatgaagtctttaacctatctctagggattgtatcgattgaaagaaaaaagtgcttggagagacgcactcactgcaagcaagagaccctgagatgccaagtgcagttggctgaaggaagagcagatccccttccatctcacctgcactctgcgcatatgctcattgagtgaaatgctccaatttaaattattttttctcacttctttgtgggctaagcacatatattttaatgttgcataaattaaatttattttcaaagacttataataatgcctactatatgtgaggcacaaggcaaacaattttaagtctcttgacaacttagataggttctgtcatcattcccattgtgtagaccaggggactgaggccacacagctagtacatttcagggccaggatttgaacccaggcagtctggctttaaggagttttgcatttaattgctatgctctgagatctttttaaaaaaacatgtatatgtataagtatatgtatatgtatatgtatatgtatatgtatatgtatatgtatatgtatatgtgtgtgtatgtgtgtgtgtgtgtatgtgtatgtgtgtgtatgtgtatgtgtgtgtatatgtataagtatatgtatttttagagacagggtcttgctctgtggcccaggcttgagtgcagtgaaacaatcatagctcactgcagccttgggctcctgggctcaatagatcctcctgcctcggcctccctagtagctaggactacaagcatgcatcaccacgcccagttaatatttaaaaatattttgtagaaacagggtcttgctatgttacctaggctggtctcaatcttctaggctcaagcaatcctcttacctcggcctcccaaagtgctgggattacaagtatgagccaccacacccagcctgaagtcttttgagtgtggatcacccaaagaccactccacctgacacccctgggttagaatccctcctgcaggcctgtctccaggctccaccaggagcctgtgctctaatctagccatggtcacctctcacctgttcagtgaagccacactacctccacctcttagcttccctatctctgcataaaacttgatgttccatctgagcctctaccatgcatgggtcttcaacaacgttgcttcattccagcctcacaaaaatcttgcagtgaaagggattatctactctcccattttgcaggtgaaaggattgagaatcagggctgcatggtagttcttcctcgacacagcactgggtcattggctcattgagctcagagcccaagcttttgttagtacatcatgttgagttgccaccaaaatggccttgacaatgatgatacaaacaagaacaaaaagcagcagctaacagtaataggttgggcactctactcagcactctagctgtattatctcattttatcctcctgatacctctattggaaaggtactattactaactttaatttacagacaagaatgctgacattcagagaagttaagtaactggtgcactgtcacacagctgctaagtagtggagctaagatttgctctgcaagactctagaaccccaaacccggaagcctttgctaacctacctgtgccttaacttcacattcctggttttggcttatagaatattttcactttacagccaggcacagtggctcacacctgtaacaccagcactttgggaggtgtaggcaagtggattgcttgaatccaggaggtcaagaccatcctgggcaacatggcaagatcccatctctacaaaaaattagctaggagtgatgcacgcacccgtagtcccacctacccaggaggctgtggtgggagggtcaactgagcctgggaggtcaaggctgcagtgagccatgattgcatcactgcactccagcctgagctacagactgatactttgtctcaaaaaataaaataaaataaaataaaatataaaatattttcactcttacgatcacatctaatcttcacaaaagcactataagtattatggtccacatttctattcaatggaaactgacccccagaaagatgaaatggctcaagttccacaatcagtaagtggcagttccagggcttgagctcaggttttctaatagccctttgggtgtttttttttttttttttttttaatactatggaagttactccgcttatcctacagggatattgcaaggattagataagattttatccatgggaatgattattaaaatttagggagcactgcatatacatgaggcaagccattgttatcatgactaaaatgagcaggaaggtgacacctctttctggggatgtccttgaaaatggtcatctggctcctgctcattttctagcattgcatggcctggatctgcagagcagggcttcagaggaggcagtggagctggaataggccatatccctaaaagggcattactgcctgtatacagagggtattactgcctgtatgctgcctgtatacagagggtactaatgcttattgattatttcaacaaagacttattcattgaaataattgtatcaggccccattgcatcaccatgatgaggtacaaaacagataaagtccctgtttctttggaatttacattctcttgggggagactgataataaactataataatgacacaaagtaaagaggatggagatggatggattggggcagagagatgctatttttgataggatcatcaaggaaggtctctctgataaggatgacatctgagcagagaccagggcaagcaagggagcggggcatgtggctatctgggggcagagtgttccaggcagcaggaagagtgagtgtgaatgcccgcggcatgagcatgctccgcgtgtttgaggaacagcgaggaggccggtgtcgccccggtggattgtcattttgtattttgtgacccagaattctttttgaatcagctacctttaaaaaaaaaagagacaaatccaatataacatgctgtaaatttgatgtttttctttctagagactcagaattttaaagataaaagattcttaataggctcttaaaaaatctcaaaagtggccaaaatactggataaaagtgaaagagacaaccagcaatgtacaaaaccattttttaaaaatcaatttttaaatgatgtaaattcgatttttaaaaacttatttaaaaaagcaaagttacatcagaaataatcttatattggaataaaaatatctttcaaacatatgcacagcacggtgttaacagaaaatgtaggatattaaatcctatttaagatattattttaagtgtgttaaaattgaatattcacatggaaaagaatcagaagggggcataaacaaatcaaaatattgatttgatttagggaggggtctgtggataagtgccttctttttgaacttacatcattgcagaagtagttataatatagttgtttaagttttttttaatgtaccacaagatggcaaagttaatatccaaatagatgcaaaagctcccagaagggggttgagttttcagagatttgctcattagatggtttaggcaaattgtcctagaagcacaaagggataataagcctgtactccacagtcaggtgaatctggatctgtgattgcttgctagatgacctctaggaagtcacttaacagctctgaatatggatttcatcatctttaaagtgggcataatcagggaggattgaaagagatggtgaataaaatataataaacatgaaatggaggttgccggcattattagagctggactggaggtgcaccttgctgcataggtacgaaagaattatgtttcttccattccttttgcagtttttctcagggacaattgtcagcccggcacattcatgcaatttcccaactgccagtgggcacaggcagttaagtttctttagcaaaacatctattttaactgttttcttttcaattgaacatatgcacctctttttttttttaaatagaattagattttatgagtcattgaaggacagaagttacttcctccccaaatttgctgccatggcccagcaataactcagttgcaaggcatgctgggaggaacgtcaattcagaatgcaagagaggacagggatggggtgaggatgattcccacatgtagagtggacccctgatggcccaagaatgagccccgagaatgtcccaggggtcctggtaactcgggctcagctctgggctggcagcagtacccaaggatatggttggacttaagggcattgctgcaggtggctctggctgttgtctcagtcagcagtgatcaagttgtaagaaacagaacaccccttcccctgccccccaccaaactggctccaatagctccaaaaaaacagagaagacttttttttttttttttttttttttgagacaggatctccctttgtcacccaggctggagtgcagtggtataatcatggcttactgcagcctggacctcctgggctcaagcgatccccctgcctcgacttccggagtagctgggaccacaggcatgcaccaccaagcctgactaattttttaaaatttttttgtagagatggggttgagacctatgttgctcaggctgctctcaaactcctaggctcaagtagtccccatacctcagcctcccaaagtgttggaattacaggcatgagccaccgcgcccagcctggagaggattgttgatgagaaattagttaatgcgtgcaatgtaccttattcaggtgatgggtgccctaaaagccctgacttgaccactatgcaatctatgcaggtaaccaaaaaaagaggattttattggaaagaaaccacccaaagacaaaggtgtacctgggcctcatgaggagctagaatctgtaatcctaaagcagtctagaatagatttctaggtttctttgtccttgctttctttgtttctcactgctcctggtaaacatgacttcgttagctccttgcagtttgcctatctggcaaattccctgcatttcagatcatagtcctgggaaagagaatctggttggttcagcttgggtcaggtgtttattcctggcccaatcagctggcaattggttgctactaactcactaggaaccttttaaaaggggttgtatctacagggagggaataattggtgctcatgccaggtgagaggcaccatcttgagtccaaggagactaactggattcaagcaggacatagttataggctagtggtacaaacatggcatcattgcctcccaggggaggaaactggtgagagcttggcaggtgttagtgctttagccaactaaagccatccaaggatcttgagtacaggaaatgaatcagaaatgcaacccaggcaaatagagctggggcaggtgggaatagacacagccttatgctctctgttttcttgatggtggcctttgcatattcattcaataatcaaagatctgtggaattccgaggaagaatagaggtagttctagcctttgaaaactttggcctctatgtggagggacaaggcttagaaagctgaaaacaaacaaacaaaaaagctagaggagcatcaattgcttgattctaacagtgattgcaaggctataaaatacagaggaagggaaagttgtgtgtgaacacatgtcattgagtgcacacttacttgggtaaggctttttgagtttgcatggacttgacatgcgtcatctgatgtatcttggcaacacccctatgaagaacaagctgtcattacccccttttgggaaggtagagactctaagtaactgacccaaagtctcagagcaagtatccagtataactgtgactagaacccaggactagctgataccagaaccagggctcttaaccacagcactacacagcctctctggagagaaacagatggttctgagcaataaagggatcagcttccagacgggatgaatccacagaccagcttggaaaatcattaaagatcattaaatagacaaattcttgcagcaacttcccttggagcatggtacatagagctgcccacgtggtcggttttctctgttcatggtatctgattaaaagtggcaagtgtccccctggcagtcacacaggcatcatgttacactccactttcagctgtcttaggggaagattgtctctttgaattcccttgcttcctctggagacctccaggtgaattctgcacctcccacctagtcatcattttaaatcagactatcctcatactcatgttccaaatttgggaaattctagccaaccattttgcataatgtagtgacagacagacatttagttttatttatttactgattatgagagattaaggagaaagggaattttaaattacctgaaggcacttgaagcttagagggcagcggtaatagtgtaatgaagaatcacaataacaatgacaattttgaagaagccctttaaagtcaagcagactagccagtttgaagagaaagatggtgagtttgcctttccgagcttttaattggagttgacggtggaacacccacgtagaaacgtcctgtagccagctggagctgactggagctcaggagagagggagaggatagaaatataagtcaagactcatcagcccagcgagatgagagttgaaattctgagctgtgacaagttcttcttggaaaattgagtaagtaggagagagccaatctggacttcaagtcgatacgcaagaaatactttttttgattttcatatattagagtccaacaaataagccctaatcaaaaaacactgagtgtggtgataaggaagattttgcaataatttcgtaggaggaatggggaacaaaggcaaatttaagggtgctatggaggggaataatatgtaagaattagaggcagtacgtgaggtccatttagttagccgaagcccccatagttcactctttatgcctctcatgcactttcttttatcgcattctattttatttatttatttacttttatttgaaacagggtctcactctgtcacccaggctggagtgcaatggtgcaatcactgctcattgcagccttgacctcctgggcacaagccgtcctctcacctgagcctcctgagtagctgagactacaggtgtgcgccaccatgcctggctaatttttttattttttgtagagccagggtcttgccatgttgcccaggctgacctggaacttctgggctcaaaagcaatccttccacctcagcctctcaaagtgctgggattgcaggcatgagcccctgtgcccagccacattctattttagattagggtttgaattagttgtatacttgttttaaccaagattctgaattccctgagggcaagcctgaaccttattcatcgttttcatccttttaatgcctgcctaatgccatgacttgcaaaaataagcgctcgatgaaagttctaaaactcacttctctgctccagattggctctggattgcctctgacaatattttccagattttgatgttgcttactgtggagtgggagatgaacctggtggtacatgaacacattgcatttatttttaaaataagtcatttaaaggattgatgtaccagagccagactggatattgcataaagatgatggactccagatatgcacttcttttctacagagaggatgaatttccatttatgactttagtatgaaatttaaaatttttaaaataattgtgtttaagttttttttaagtgagttaataaaaatacttttaaaataagtcaattttagtagaaaaggcagacaaacttagtaaagatttttttcttttctttctttctttttttttttttttttttttttgacacagggtctcactcttccccaggctggagtgcagtggcatgatctgggttcactgcaacctccacatcctgggatcaagccattcttgtgcctcagccttccgaatagctgacattagaggtgtgtgtcaccatacctggctaatttttgtatttttagtagagatagggtttctccatgttggccaggctggtctcaagctcttggccttaagtgatctgtccaccttaacctcccaaagggcttacaggtgggagccactgcacccggtccagatatgtacttgttttctatagaggggatgaatttccatttatgactttggtatgaagttaaaatattttaaaataattgtgtgtaagtttttttaacggagttaataaaaatatttttaaaaaataagtcaattttagtagaggaggcagagaaacttggtaaagatcttaaagctggttgggagacaagtcacgtttgggtggatggtcttaggcagtgcatcataatctggtcttaccctacctttccccttttttcttttatatgactccatgaattttactccccctctccagcaataatagccatcaaatcaggaacgtaagtgcttagttgtattttccacaatatacgttaaaacaaatacaaagccataaaggtgaaaccatcatacatccatggactacctaaaatgatctcctacccattttgggaaacacggccgtttggaaatttatctggcccctgtccctcgcctgggaatccttaacatctggcactgtggattatccacagaaacatctctggcaatagagttgctcctggcatagagtgggcatcattaagtgtttgttcagaaataaaaggacagtgagatgccaaccgtaacatttaatagcttaggcactggtgtgttgaagccacatgctcagtacagttcaaagatgatagatcttagggtttccctgcatatggttagcggtagaaacataccacaaaacacgaccttacctacagtggagcgatcccctgatgtggggattccgactaatgagtctggggggcaagccgagttcttccaagcagaaagcaagcaagtgaaatctctctctcacttacttctctctctgtggccaatgccatctgctagctttaaaaataatttttaaaacaagtgttttggttctcttcaacgtgcagcaaagacagatgctatttttaggcttgttttctattaaaaaaaaaaaaaaagccaaagaaccaggggctgggtgtcggcagttctggcttactgtctgcattttgccaccaacttgtatgtgaccttttggcaaatctcctatgccttggaccctgagaatataagtgatcatttcacctccttttctcattagacatgttgagagggtgaagcagtattggtctgagaaataaaaaccattttctaaaaattagtcagtgtgggcaacatggcaaaaccctgtctctacaaaaaatacaaaaattagccaagtgtggttgtgtgaacctgtagtcccagctactggagaggctgagacaggaggattacttgagcctgggaggttgaggctgcagtgagcagagatcacgccattgtactccagactgggcgacagagtgagaccctgccacagaaaaaaaaaaacaaaaaaattggttaacttgtgctctcctgtaacctgccagcttctgtcttgatgtaccactaaatctccatgttccttctctcccatcctggactggaagctctttgaggggaggacacatccacacatccatacaatgtctagctcagaacctttcacacaagatgtacccactggaggcagcatcatgaggggttgagagtgtagagtctggaacccaatgcctaaggttcagaccctggctttgcagcagcttatcagctgagagaccactggcaagttacttaccctttctgagcttcaactttctcctctttagaagggagagaatgattatacttgtcacattgagttttgtagagggacaagtgagacaaaatatgtaaagcattcagctcatcacgtggtaagtacccaagaaagcttaatttcattattgttgttgttataattattaggcactcccacatttgataaatgcacatatgactgttacatataagataaagttctatgtgctgtatggaagatttttttaaatggtgaattaaatgcttgttatatggccagcatcatgttagacactctacacatgtgtccttgtttaatattctgtgggcaagtgaaaaatgtcccatctacaggtgaagagaaagcccaaaattagattaaataactgctcagtgttgcagttagtaagtagtgcaacaagacttcaaatactgtattgacttaaaaggtgaaatctttgcttcactttcccaccacctcttctcccggttttatagcccctcacaatagctttgcaacttttgacagcaagtcaccttttacgttgtgactcagccatagcaacatataaatataaccaaaacatatattccacaaaaagtacttagtggtgttctgtgcagcatgcactgataatttccatttcatcatttcattatttttctttcttcttctactttttttttttttttttttttttttttttgagacagtttcactctgttgcctgggctggagtgcagtggcaccaccatggctcactatagccttgaactcctgggctcaagcgatcctcttgcctcagcctcccgagtagctgggactacaggtgctcaccaccatgcctggctattttttttttttttttttttttggtagaggcagagtcttgctatgttccccaggctgttctcaaactcctagcctcaagtgattttcctgtctcggccctgccaaagttctgggattacaggagccagccaccatgcctgacctcttttttctattatttttttttaagttgatcatgacccaccaaattgattcaatcatcaattaaagtgagatacaacttgagtttggaaaacacttgtctggcttcaatactcaggcagtattgccaggacatctcattttcatcacatttacagtttgcagccctgtgtatgtttcattccagcccctcagtcagtctgttagagattatcgcatatgttatcctcattttataaatgaagatatcaaggctcagggatgtaaaatggtcttgccaagcctccccagtagtcagaaaacgtggagtcagagctttgattccaaccttctgactgtatgaatgctgctttggagacccagtaactcctgctgcctcgaggatcacccatttattcacttaattaatgtatattgatggctcgctttggtcaggcatggtgctgggctgttggtacacagcggtaaacaaattttacatggctcctggatttgtggaacgttcagtcacatttcgcattagtccatttctttcagagtgagaccccgaacctttgtgttagcctacgtgaccttacatgatgcgtccctcagcaccaccctgggctcatctcctaccctgtcccccttcttctttcttctccaagcacatgaggtgtgctctagcctcagggccttcgcacagcctgtttctccgcctggtaagctctcactctcaatacctgcatagctgctttcgtcatctccttcaagtctttgctgaaggatcgccttctaaataagattatcctgaatactttattgaaactggaactcctttctcccatctcatccagctggtactcccaatcctccatactttgctctgtttttcccccgtggcactttttaatcttttagccttctatttttatttttatttatttatttattttttgagacagagtctcactctgttgcccaggctggagtgcagtggtgtgatcttggctcactgcaacctccacctcccaggttcaagcaactctgctgcaccagcctctcgagtagctgggactacaggcgcacaccatcatgcccagctaatttttgtatttatattttagtagagacagggtttcactatgttagccaggctggtctcgagctcctgacctcaggagatctgcccgcctcagtctcccaaagtgctgggattacaggcacgagccgctgtgcccggctatcttttaatattctatataatttgtttattatgtttagcatttattgccttttctgtgtctacttgctagaatgaaagacaaaggccaggaatttttgttggttttgttcactgctctatcctcagcacccatctataacctggtacctagtaggactctgtaaatttgtttttacttgaatagatagatgaaataaataaccatcaagttcaaaatataattaacaaattatgatgtggtcagagattaaaaaaagaaaagaaaagaaaaaagcccacaggctttcatgaaagagtataacggcagacctaatttagattgggtgggttagaggaagtgacttttttaggctgagaacataagagggacttcagttcccaaattcgttagcgcagactctgccattgcaagccaaaggaacgtagcgtaaaggagagatttcacccaagcagaagtctctaagaagagataaagtgattcattcattcatttagcaaacaccctctgatggaaggagagaaacgagtcacatattggtgttgcccaagggccaaaacacacatctgacttatttaattccagcaacatcactgaggttctactattatctcctcttgacacacaaggaaacccaggtgttgaataacttctccaaatacatccagctattaagagacagagctggatttccaaatgaagtatctttggcaccaaagcttgtgccctttccctctctgggcacctgctatgtgctagttgtgctatcagaaacagggcttacacagccaacaagggcatagcccctgacttgaagaagttcacaatatcccttgaaagacatgctgaaaaacttccctgattaggacacagatttttttttgtccccagttcttttacttctggacatgccttcctagattactgtttttcaaaccttgataattcatctttttgtttttgatagccactatgttatctattggtgagtacctcaaaattcagtggcttaaaacaataagcatttattatctcagtttctgtggggcaggaatttgggaatgctttacctagttgatctggctctgggtctcaaaggaagctgcactcagattgccagctggaattttagtcatctgaagccttgtctcgagtgaaggatctgtttccaaggtgattctctcacaggactggagttggtgctggctgctggcaggaggcctcagttctttgccaaatgtaccttcccatagtactgcttgagcatcctcatggcatggcggcaggcttcccaaaaagcaagtgatctgagagagagcagggtggaagttgtaggtcttttacgcgctactcctggaagtcattcattgtcatttttgcagtatccaatgggttacacaggtcagtcctattcattaggggaaggtactacacaagaacataaataccaagagactgaaaaatcactgtgggtggggggagcatcataaaggctggctactacagctatctatcacctgtaacattatttacttaatattttccactttttgttaaaatcagccttatcctaaacaataatatcagttaagtcacaagattaatatgctaattgtattttccagcaaaaacaaatataaacttgtaattattattattattattatttttgaaatggagtctcactctgtcacccaagctggagtgcagtggcatgatcatggctcactgcaacatccccctcccgggttcaagtgagtctcctgcctcagcctcccgagtagctgggattacaggtgcctgccaccacgattcgctaatttttgtattttgttttttttcagtagagatggagttttgccctgttggccaggctggccttgaactcctgacctcaggtgatctgcccacctcagcctcccaaagtgctgggattacagctgtgagccaccatgcctggccaaagttgtaattattaatgaaaaaaattatctgtgtatcacctatgctcacttgcgtagttccagtgacacaaaccttacccttggggaaacaggaagcccagcaaacagggatctgtcagagagccctggtagttttcatcataaattccagctcttcccccactgtccatttggagccccagaagctacgggatgctaatgttgctgtttgctgtcctcttccaggaccgcctgtactttgtgatggagtacgtgaatgggggcgacctcatgtatcacatccagcaagtcggccggttcaaggagccccatgctgtgtaagtgagaactagtgctgtgctttctccttgggataaatgggtaggttagtggttcctttgagggtgtttttttgccaaagagggatctttaaacacctcgggcatctttttgaaaaaatatttagccagggaagaaaggtgttctgcttaatatgagatacttcttttttttctgacaccagctaagaacctgaagctcagacagacaccatggctcatacctgtaatctcagtgttttgggaggctgaggttggaggatcacttgagctcaggagttagaggccagcctgggcaccatgacgagatctcgtctctataaaaaataaaaaacttagctgggcatggtggcgcacagctgtagtctctcctaaaaataaaacaaaactcaaagctctaaaaccacagctatttatttatttctaattcatgtccctgactgcttagaaaggccctatatcttccttggggattatcattgtagattttatgtgtccatttgctaatatttattgagaacttactataagccaggccctaagtgcttaacaaacatcgtctcacttaaccttgagaataactctgggagggagatgctaccatccctgctttacaaacaaggaaatggagatgcaaggttttgaaagcttgcccaaaatcatggagctagtaagaagcagttcccaaattctgaccccggtttttctttgcccatgttctttatcttacaccactctccgtcttagatgccttcactccatgggggtgaaggatcaaggtgctcggtggcaatggtctgtggttcctgtgatggggagactgattctgggttgttggaaatgtgtttcctctgctgagtcaattccatccccttcggttcaaaaggcagctacagtctcttctttttagaacacagatttcatcatgtcattcccctgcttaggaacatggcaagttataggaattagcaatgataacctctcctggggagttttctaagatcttattgcctctccagagagcccccagagctcatctagaaccccaccttgtcatactagaggcttggtggctcctacccagttcagcttgccccctctcctcccacctggacaggttgtgagcactatgttctgataggatttgcattattcttgtgcttccaaatctagccatttgtatctcctggcatgactctaataggactagctttgcttttacttctaacatctaattgaccacaggctttaattccattgtcacacaagacatgtcaagacactttacatagttccccaaagccctgcccaacctttgtggcataactgggcttcccagttctcttgaaacctctttctttctgtgctgaccttcaataagaggttacactttagacagatgttgtttcttattccagctgcgccattcattcactatataacttgcccaagttaatctctctaaccctcagtttcctcatttgaggaatggggagatactagtaggacctaccttacaggattgttattaggattaagtcaggtaatgcctaaaatggtgctggggagatggtaaaccttcaacagatgttagctgctattgttaagataatttaacttgctatatagtctgaaagtataattctctcttttttgggggggtgggggacagggtctcactctgttgctcagactggaatgcattggtcctgaccatagctcactgcagccttgatcacctgggatcaagcgatcctcttgcctcagccttccgagtagctgggatcacaggcatgtgccaccacacccagttattttttttcttttatttttagtagagacaaggtctcactatgttgcccagctagtgaaactataatccttcatccagttcatcatatcccatgtccccttctccactatacaattgctgaacttctgcctacccccagtttgtccttaaggcaaccccatcaccctctaaaccaccctttgaatccatctgtactttcagcactttatgagctatatagctgaccatccatgggttctttaatgtcctacacctagttcaatattgtattgaattctgagcattgccaagcatatggtgtccttgagtttctccatcgctttttttttttttttaatttcagattttacgctgcagaaattgccatcggtctgttcttcttacagagtaagggcatcatttaccggtaagtgaacactgctgtactttccatctcttcatctccctcagctcctccctgccctgcctctttcttcagctgcttttaaaattagaatccgcggtgggggaggaatcctccagaactaacttgggcatgtgttctgccaggcagcatcgcccactgccctggcaaagtttgggcagctctatatggtggtagaaaatctcggtggactgtgtcaccaatgatggttcagagcctcaaacaggagactgtttgctctaagaggagactcacagagaggacctcagtacttctttctcttgcttgtggaccctacatttgaggagcaggcaaagaattttggctggcagaatgtgatggatcacattattatgaaacattttttatttatttatttttttctgctatgtaagtacaacttggaaatggatctctgagtggctgccctgaaagacaggattaagttcaggacttggcatttgctggtttttggaggagcaaatggatgatcatagctgcatgagtcataccattttatatttcatgcaaggcagacgattgcacccgaggctgctatttgtcagcaagtccagggcgtacaattctccttgtactacattgatgcaaatggcatagccagggcaggcttgggctggtttgttatgcaagagaggctgcaaggtatgaggcctccaaatagcatttggcatgggtgggggtctatttcaaagattatgaagaaccacaagagtctcttccattcatgtgtttgacacacatttatcaaatcctactatattctaggcactcttctgggtggtgggcatacagaagtgaataaaacagatgaaaccccttgcccccgtggagtttatctttctcatggtgggagttagataagtgaatcataaaaacatagtctgccaagtagtgataagtactatggagataaatcaagcaggggagggtgctggtgtacactgggtgttggagggttctctctcattctgtagagagcatgatgatgagggcctggagagttaggggtgacttgagagtcctgggccttttgccttaactgcgggatatgggattaaaaggcatgagggggctgggcacagtagctagcacctgtaatcccaacgctttgggaggctgaggcaggaggggtgcttcaagctaggagctccagaccagcctaagcaacatagtgaggcccacatctctaaaaataaaataaaattagccaggtgtgatggtgcatacctatagacctagctactcaggaggctgaggtgggaggatcaattgagcccaggaattcaaggatgcaatgagctgtgatcatactactgcattccagcctgcgtgacacagcaagaccctgtctcaaaaaaaaaaaaaaaaaaaaaaggcatgttaagattagccctggtaagtacaaggcagatagcggaggccaggctatgggatgctggtaggatggagaaatgggaagtggggaccttgtcagaggctttcagagtcctggggcttttagtcacacctgaagtggtgatatggaatctatagggggaaggatgatcttattctgagggcacaaagtccccgccattcctactttctcctaatgatggagggaagaaggtcaagaagaggagtggttttacttggcatgtgggtgatcctagtgaaaatgtaaaaatagagagaagaagaagaatttagaagctgaggcaagaggatcacttgagcccaggagttcgaaactgcagtgagctatgattgtgccactgcactccagcctgggcaacagagcaagaccatgtctctaaaaaaagaagaatttaaattttaaatagtatgatcattctgcccatgcccatgtttgccctcaatgaacacgttcactatgtgtgcatgaaatggcacatggaaatcctctaattcccttagtttctcttttgactctcatagtgacaacatctttttgtgctgaatattattctggttttgaaaggtgcacatgaggctgggcgcagtggctcatgcctgtaaacccaacacatagggaggccgaggcaggcggattgcctgaggtcaggagttggtgaccagcctggctaacatggtgaaacctcatctctactaaaaaatacgaatattagctgggtgtggttgcacatgtctgtaatcccagccactcgggaggctgaggcaggagaattgcttgaacccgggaggcagaggttgcagtgagctgagatcaccccgttgcactccaacctgggcaacaagaatgaaactccatttcaaaaaaaaaaaaaaaaagtacacatgatccgccatatgacatgatccctaaattcaagccgatgacttcagctggtgcttaaccaaagagacaggcatcatgggtgatttttcactctacatgattttcaacttgggtgctgacattaggacctaactcctatgtgggatgtgcctctactaaaatagaaccaactgggttcttgagaagattaaatatggaactacaagtttattggaagaaaatccactcccattgtaggaaacaggagaggaaataattagtgttccggtcaattgagttgtgattcagggctagtttctaatcaatcaggaagccgcactgggatctgggatccatggatccggctcactggccaggcaggtggtaaaattaaaagattagcatttcaggtgctaagatgatacctattccaaagccccttttcctaaactaactacacactctccctttcatcttccactattaatatggtctttaaaggggtatttatcaatcttttaagccagtctgcatctgaacccttcttttgtgtatgtggaagaacagagtcaatcttctactataaataatgaaaatgacagatactcatttcacagcccacctgtagccagggcaggcacacaacccaagctctgacagttggtcatacttactcaagaccttgaatcagaaactagcggccaaggaagcagaaagcatagaatcaagagtgaccatagtaattatcagcaactactttccagaggcaagagaagagggtcttaatagcaataggcagagtccagcattagggcttcgtggaacaaggggtgatgtgtgtgtcccatggcagcttgggtggtggtgtcactggacaagccctgagttgcagttaggcattgtttcaggctgtatagactcttaatctggttcttcagtctcctcaaagattctatgagctccccaatatcctttgatgaattccttttcaggtaaaaatcatcatagttggtttttgttgctcaccatcgagaacgctgatggaaatagagttcttgaaattgatagtcaaatggaaatggtaaaaaataaattacttgacaaaagatgtatggttttatcatttcacagagattgatttcatagtggtaagatcttttaagatgttacaaatcactacctccttcatctaaatctctacttaattgaacagttcttaagtaaagaggatgaaggattatgttagacttaccatctttaaggaactggagatgttgggttgtggggtgggaagggaaaaagattcttcctatcaaacttagtgtctgatttactgaccactgtctctggaatgtgtgttggttttgcccttgatggttttctgaaaaatgaaaataatttctccatccaccttttgaagcagaaatgcggatttattacacagaacaaaagattagggtgtgatatcaaaacactgtatgtgacagtgaagatgacagaggtgccctccagcctcaggactgcctggctcttggcacctgaaacttcttttctataatagatgaagattttatcacttccctagtctacccagctgcctgcttctgagcatgtggtcgagctgaagggttgtcatttgtcactattagagaaatcacatatatcacatatagacctacctagtaagtttatgaaaagcaaattgctgcaaagcctgggttttctgagttccaaactttcacacaaatcatggtggcttgtagatgagcatgaaggctggatatgagcagcaccacggacagcgccaaaggcatggcgtgttgggattggcaaacatcagtgggcaagtgcaagtggacctccccatccctttgaataaggagaccccacagacacagataggagatgccaggatatagttttcagattgtattcttttagttggaaatgatgacagcaactcaattcaaagtaacttaggttaaaagaggcatttattggtgacataactgaaaaatccaggtgcagatctgactttaggcctggataaatgcagaggctcaagtgacgttatgagggcacattttatcaccctccctctaggctctgctttctctatattagattgcttcttttcatctggtgacccctggagtttctagacttccataataccacctgaacaaccccaatgtaaaatgcacttatccctttcctgattatgccagccaaagtgccagcactaatacttaacagctttgattggcccagattggatcacatgcccattcctgaatcaatcactgtgaccagcaggatggaatatttccattggctgggacaggcccacttgaccactgctggagccatgttacatggaagccatgttacacccatgttacatggaagaattgaaggagggtggttcttctaagaaatattagaatgctgtcatcacaaaacactagaatagacagaaccacagatgcccactacccaatcaagatgaccgaagggaaagatctgaattaaggaatagatccccctacctctcaggaaatcggatttccccatcttctattaggaccgatccatctctcagccttgctcactggtgcagaaatataaagcattgacattggagtaggtgtttagggaggaggaaagtgtgttgatattggagcaatcttgtgtgctaaagacctacaactgttccccaaaatatcaagctcttctcatcaacacagatgaaaataaaagagaatacagcacatatcctttaggttagagctcagatgtcaccgccttagacaggtcttttctgactgacaccctgcttaaagtgacttcctccaatcactatcttatgtcctctttattttcatcataccacttatcagaatctgtaataatcatgcttacagagtaattgttatctttttcccagcactgaaatttaatctgaagaacaggaggcttgcttatcttgtttactgctacatactatacctggctccaggcatagtgcctgtcacatagtaattgtgcaacattttttttttttcaagacggagtctcgctctgtcacccaggctggagtgcagtggcgtgatctcggctcactgcaacctctgcctcccaggttcaagctattctcctgcctcagcttcccgagtagctgggactacaggcgcccacgaccacgcccagctaatttttgtatttttactagagacggggtttcaccatattggccaggctggtcttgagctcctgaccttgtgatccacctgccttggcctcccgaagtgctggaatcgcaggcgtgagccaatgtgccctgccaaatgtattttgattcaaagaattgatggaaactcctgggtcatgtcctagaaggtggcccaagagatcagggaacacttagcattaaatatttctttcaatcagcttctttttttctttgtaatttttagagatattttaaaaaataataattttctgaaaaatgtatcttcttacaaaatataaggagtctttaagtggcaaaggaaaattcttggaattttcctggatccaagaagcgtcatggatgctctgccctttgcttaactttctgtggatctccgtcttttcagaagtgctgtctctttgtgtccttgtgagacacttggcacagttggctgtgtagaaaaagaaaagcacggaggcttgcggacctctttttatctccctgccagactgtaagctgttggaggtcaaaggctggtttctactgacctttgtgcccacacaacacctaacacagtgttttatgcataatgagtggctgttggttggcttgaaatgcatagcgtttaattaaatctctaaattcttgtgtctgccatagtgacctaaaacttgacaacgtgatgctcgattctgagggacacatcaagattgccgattttggcatgtgtaaggaaaacatctgggatggggtgacaaccaagacattctgtggcactccagactacatcgcccccgaggtgagagctgctgggcacacgttcacattgcggtgatgtaccctctgctccccagatggctgtgtgagagctgggaagggttgagggtggtaccttgcaagggaacctcggacagattcttattctatactctaaatcctccctttgagatcacacatgcaaattaatttagcacacatccagaagcccaagcccaaaatacatcaaggtttgggagaaaatttaaataaaacccaaaagaaccatccaacacacatcagtaaaattcttcgtcaaactgttgtggctcacggccatgtgataccgcctaattatgacattgaaatgtttgttgagagaaaaagagcatatcccctgggctggcatatgacatgggatctgtgtcctgtatatgtccctcagcaggaaaatggacaatagcccgtgatttatttatagcatgaaatactaccaggcaccaattcagaagagtgagttagatatatatgtagatgtgaaaagatcttcaagacacattgttagagaaaaaaatcaaggtacagaatgacaaatacaaggccaggtgtggcagctcgcgcctgtaatcccagcactttgggaggcagaggcaggtggatcacttgagcccaggagttccagaccagcctggccaacatggcgagacctcgtctctacaaaaaatacaaaaattagccgggtgtggtggcacatgcctgtagtcccagctacttgggaggctgaggtaagagaatcacctgagccccaggaggtccaggctgcagtgagccgtgattatgccactgcactccagcctgcctgggtgacacagtaagaccctgtctcaaaaaaaaaaaaaaaaaaaagaagaagaatgacaaataacactatgatactatttatggatgaaacagaaatacacagaacactgttctgttttcaatgagtaaaagcatacaaaaatctggaagatttcaaactgattttataacactggttacctctgaggataagggaattgtaaagagaaatttagctatttctgtatactgctgacattttttacaaggtaaatgtatttgggtattacttgagtaataaagtaattctttaaaaataataaggctttactcggacccagtgaagttttccctatgtgatatgctttggtctattatcattttgttaattaattagataggacacaatccataacacaacttcctgataggccaggggttccataatctctggttctcaactctaactgcagtttagagtcgtgagggagcttttacaatgtaggatgcagctggggcatggtggctcactcctgtaatctcagcactttgggagcctgaggcaagaagatcgcttgagggtagaagtttgagaccagactggacaacatagtgagaccctaatctctacaaaaaaaattaaaaattcgccaggtgcactaggtcacccctgctgtcctgactactcaggaggctaaggtgggaggatcacttgagcccagcaggtagaggctgcagtaagcagtgatcatgccactgcaccccaccctgggcgactgagcgagactctgtctcaaaaaaagaaagaaagaaagaaagaaagtgtttccacacttttaaagtacttcaagtcttatttgatcctcatgacaagccaacaagttaatccttttacaaaggaaactagagcctgggatgtgacagcagttgccgaaggtgatgtggttagctcatgacaaagcctgacctgctgcttatccctcccatctgtgggctggaggggaggcaacttcaccagccacacagttgagggtttcttgtgcttgcctgaatcacgaccagcgaggaacttctgagaaccacagatcctgggcctccacctgcagagattctaatgggatgatgcttgggcatcccacattgtttcttgtgtgtgtgtgtgtgtgtgtgtgtgtgtttgagacagggtctcactctgtctactcactgcaagctctgcctcctggattcatgccattctcctgcctcagcctcccgagtagctgggactacaggtgcccatcaccacgcccagctaattttttttgtatttttttagtagagacggggtttcaccgtgttagccaggatggtcgcgatctcctgacctcgtgatccgcccgcctcggcctcccaaagtggaaaacacgttcaatgagaagtgttctcctggaatgctttcccttccttgtcttgagggttacttctcagaatgcatttcattcattcataattgaccagtaaaattgtatacatttatcatgtgcaacatgttgttctgaaatatgcatacattgtggaatggctaagttgagttaattaacatatttattgtctcacatacttatttttttatggtaaaaacacttaaaaatccctcttagcaattttcaagaatacaatagattgttattaactatggttactgtgttacacgataagtctcttgaatttattcctgctacttaactgaaattttgtatcctgtaatcaacatctctgcatttctgattttggaatagaaatcaaagtgggagatagagatcaagaaacaaacattcactttatagccaagtttgctcaaataccctttttgagttaaacaagcaataactgaattataaaacattctaggattagttaacattttgagggcataatatgtgaaagccaccgagtatctcattcatcctcacataacttcatgatatagagattatagaagttaagtaacttctcctgtggtcagacagccaaccggtagacagcagtcaggattcaaagtcagactgcctaaccctcagacctcagcctttagcctttgctgtattacctcttaacctctgacatggttagttttacatccctgcatactgaaagatggacaatcacatagctcttctagacttttccatgttcttgcagtttgggaatatgaattaaaaacttcacaaccatatataccatatgatacaccaattctacatctaggagtttatcttaaggaaatacttggacagatgtccaaatgtctaattacaagaatatatgttacagcattggaagaaacctaatcaactggaaatttataagatagattttggtatatccattcaacggaatgctatgcacagataaaaattgattatgttcatatacaaatattaaattagcaaggaaaacttaagtgaataactggctttattaaagatctattgcccataatcccagtgctttgggaggccaagatgggagctttgcttgagtttgagatcagtctgggcaatatagagagaccccatccctacaaaaaattaaataattagcatggtggtgagcacctgtagtcccaactacacaggaggctgaggtgcgaggattgcttgagcccaggaggccaaggctgtgagctgtgagctatgatctcaccactgcactccagcctgggtgacaaaaagagacactatctcaaaaaaaaaagaaaagaaaaaaagaaaaaaaatcgtccaaatactaaagtgtttatgtaaagcacacacatacacacagagtttaatatgtattcagagaaaagagtatggaatgaagtagaccaaatattagtcataatttttctcttaataaaggattatgggtgattttcatgttattatctcagctgagctatcttttataaagaaatattaaaatagtgacaaatgttgttatctcttaaacgtttttatgtttaattatgttttaaaaacatgtaacgtaaaatttactattttaaccagttctaagtatacaatttagtagtgttaagtatatttacattattgtgtaaatgttgtaacttttacagaggagtaaagacagtttttccttttaaaaattccatgctcactgttttgaaaataataataacaatacaccttacttagtgcttcgaaaaggcaatgtgacagccacaggtgtttgcccagctgcaggtgcctctgcaaagcatgtctgtcattccctgaatagctaatataaagaaacagttcaggtgggcactggccttcttgtaaaagaagagtgaaatctgtctccagaagaaacatgaactgcaaacctccctgatagggtgccttctcttttctagataattgcttatcagccctatgggaagtccgtggattggtgggcatttggagtcctgctgtatgaaatgttggctgggcaggtaattgaattttaagtgatcgataagagaagtcctccctacccccatccacatggtttctttaggagaatgcatgtttggtaacagctcataaattggaacctctatgactttcccggccttggggtcatacaagtctgtggtcatttgaaagcctgggtgtgtggcttcactgtgggccccagggaggagggtctgccagttgaggggagctagggggagggttcaagcagggattcttctcctcccaccctcccctgtcatacaggcaccctttgaaggggaggatgaagatgaactcttccaatccatcatggaacacaacgtagcctatcccaagtctatgtccaaggaagctgtggccatctgcaaaggggtaagtgcatctcttaaagctgtgaccaggaccaccacataaaggcatgtgggctgtaccttgcccaagaacaccccaccaggggggaacacagcctgaactccacccttcactccatttgccaatatgagaaccctgatgtggagctgctacctcccggaggagagagagctttttttctgatttgcacagaagtgctgtagagagctgcctgcagctgcgtcttgctgctggctgggctgcagtctctgaaccagcacaggggaatgcttattgaatgaatgaggtagaaagcacagagattttgtcaaagagctggaagtcatgggaaagggcacaagaggtcttttgcacaactcaggctatcttgccctgctctgctgtatgtgtttagttaatactaagagcgtgcaacttttgttctaaaaaataccacgccgtgttgaggttaaggaattctctagataagcagactgaaattcaatgtactcaaaatcccactgtctcctctccccagacacacacacaaatggctaaaagggcatgcacgcttggacatctacggtttatgcacagggcacctgtgaagaaagcaggatgtgtgtttatggggaaggattgtttgttttgcatcttgtgttggaccagggcatactcacagtgacttctgtgagatcctaaagatcagcgaccctcacctttggagccatcagaataacccgaagtgccttaccagaatgcacatgcttctgccttaccccagagattaagtctgggtatgagtattttggaaaagtctccatttggcttgcagaccactgcctttaaaaatactgtccaaatgaagtgatttttcaactctgatggaagcctgaaagcaatagaattagacgcccagaaaatatgttctacacataatatactaataaaggatttgctctccctccacccagtggtacaggttagaacatggccgtgccttaatcagtgggttcccacctgtgtgtctgaataaaccagggctgccagtcctagatctgtgggatgcttgcagacttttcatgccctactttgttcttcctgaccccagccagatgctggatgcactgtcttgggtgaaggaaagctgggaaactcaggcaggccaatctgaggcttggcccagtttggaatagctgggccagcctctcagcctaaaagcgccttgtcacactgcctaaattcccactctcaatgaatcacctaaggtttgcacctcagctgcataggctaagatgcatgtatccctggggaaaccacctgtgaattagtctcaatcccgaacatctaaagtgaattgcttgaaaatattttctttgagggtgtgaggcagggagaaagaaagtgaagaatagagaggggagtcccagaggtgcattaggaacccaagcaaagcccataaagaaaaaaaaggcacacacgaaggcctccacaggcccccgtagacaagttattgaagggtgggggcgggtagagagaaggtggtacctggagcttttagtttgtttaataattaccagcatataaggatccagagatttctcaaaaacattcagctttcaggtttctcttgaaaaatcagatcttgccacattggcctgtcattcttacaaagcaccagtcagctggattggaaaccatggccctctgtagttggagcttgccctctgtaattctcagacgttctcatttggccaattctctccaagttcaaatcctggttcaggcattaattgccgcaggaccttggggaagttgtttgacggcatctgcagattggggataataatagcactccacattgggttctttgatgactaaacagctgaatactgtaaatcacttagaatagaggctggcactctgctccaagccccttggaagttattattactattactagtgctgacgctattgtgttatctgccaggttcctcttggcatttgagtttgcatcccctggaattgcaacttttaaagtaggggattttggagatcaagggaccctttgcaaatcttgacccttctactttctaggcacaaggtgtttttgttttgttttgttttgttttgttttgttttgttttgttttatcaatgtctcgctctgtcgcccaggctagagtgccgtggagtgatcatggctcactgcagccttgatctcccaggctcaagggatcctcctgcctctgcctcccaaagtgctgggattacaggcatgggccactgcacccagcctaggtgcaagatcttaagccacttcctttgcatctctgggcttctgtttattttaaaaaatggaatagtagtactcattgaaaagagtttttgagagcattaaatgagataacataagagaaagctccttgcatgatgtgggcacatagtaggtgtttaatacatccacagggtcctccccttcacacgcccgccctgcctggacagctgggggttctaaatgggtcatggaggaaagagcattttccaggtcagctgccttcagctcctgctccaattagcagtttccctggtagagccgttttctattaattcaggacccataaccttcatgattaactggggtgactctcttactattgagtttggggaccattattaattgagtgggctgagtccaatggggctcttccttcaaggagggtactccaaaaacgagtgatgctcaagcaaacagccaaatgcttcctctggaacagcgagccccaggggatacgtctgggaggtgatcagagattggaacagtgattaaatccagctgtctacatggcttcgggcacattagagcagagtgcgggaactgggcagagactccgaattaatgctggatgtttttgcagtaccttttctttgcttggcatcctcctgcttagacagaaattcagttgagcttttgaaaacagtcacctgtttaattgaagcagtgtcctttatatgtccattcccttaaaggcccgattttctactaaaaaaaaaaaattagtaaaaccttactcagatggctattcccactttgaacaaacttgaagcaaacagaagcccaaatagacaggaccttagggtgaaaaccagcagacactgaacagctgagactgaacataaagctataagagtcctgagccaggcagagctgttcaaagccttgccctgctccttagctgtttgaccttaggcagatgactttacttctctgcacccacatcctttacctggaaaatgggggataatagttgctgaggccttagagtattgttgcaaagtttaaagagtaatgggtaatggccgggaagcctttagcacggagcctgaacgcatatgatgttgtcatactcagtacacggaagccgttattgatgttattatcagtgtgaaccaaaacctcactgccctttctttcctcccatcctaatcttacacaaatgtcaagccttggctcaatttcctcaccctccataaacctctcctgacaaagccaggccacaaaaattcctgagaaaaccacgtgtgaaatgcactcccatttttcttaaaagcccaagttttagagctaggcagaggtggagtctgcacccagctcttactgactctaccacttcctctctggagtccttactgttcctcaacttctctgagtgttcattgcctttttattcaaatgggaaaaatagtatactcacctcattgggttattatgatgatcagggaagctcatgcatgtaaataaagaagtagcagctcggcgcggtggctcttgcctgtaatcccagcactttgggaggctgaggcaggcagatcatgaggtcaggagatcgagaccatcctggctaacatggtgaaaccccgtctctactaaaaatacaagaaaattattagctgggcatggtggtgggcgcctgtaatcccagctactcgggaggctgaggcaggagaatggcgtgaacccgggaggtggagcttgcagtgacccgagatcgcgcctctgcactccagcctgggtgacagagtgagactccgtctcaaaaaaaaaaaaaaaaaaaaagaagtagctagcttagaatgtaagtgctcagttaatttccccaccctggaggatacactttatatgacaagtacatgcttgtgtgtgagaccacaaattatcttgcgagggggcaacaggctgagtgactgtccaacagtgtaggaatgaatttctgggttcattccttccccatcatcagcaagtcctgggcagaagattctgccatcatgggcttctcaatgtgatgtcaactctggaaagcttttggacttgtatgcttctttctttttttttaattaatcaccaactcttctgtctttactccctgtgcatttgctcaagtcttgagatcagagatattttcatgctgctttggactcatttacaagaggaagcctgtctggtttcatcttggcgcatctattcatcttgttatttagcactcagagacccaaagatggagggttttgataattaagtaatttaaacggaacaccaaagaaacctcagcggctttgtgtgtaatgtatgatacaagggaaatgagctgggctaggttttgactatttaatgggctttcagaaagtaattacttgaaacttgggcccctttgactaatactttttcttctgttttgtcatttttgcaagtgctttactgagaaatgcaaatggtatctgaatgaatgtagcctttgcttttgtcaaactccagttttcttgttgtgggaggagggaagtttgaagatattgaaactgtcctaattaaatgcactggtaattgcacaaaacttattcttaaaccaaaatggataaatggatcatgtggcatttatttttttctttctgtttttttttttttggttgtttttttggttttgttttttttttttgagatggagtctctctctgtcgccagactgtagagtgcagtggcgcgatctcagctcactgcaacctccgcttcccgggttcaacaattctcctgcctcagcctcccaagtagctgggactacaggtgtgtgccaccatacccagctaatttttgtatttttagtagagacagggtttcaccatgttggccaggatggtctcaatctcttgaccttgtgattcgcccgcctaggcctcccaaagtgctgggattacaggtgtgagccactgtgcctggccctcatgtggcatttctaacttgaagttcacggccacattcaggcttcgttttgattaaccataacagatgattggcagtgggtcctattatcaggtcctctcctgcaaattcctggctgggattttttgctgggataaaaagcaaaaaacaaaaatgagttgagattcttcatttgcgctttctttcctaatgcattggagtaataatttctgagtgtcttacatttcctcttctgaaactcagcaaattcaatgtttttctttctctcgaagctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagctgtaagtagcccattctctctgactgccgggtattcacacacaaggtattcttgcctgtgcctcatgttttccaaatgctccctgaggggtagacgtcaatgtgtctactggaacatgggtgtatgtattcacacatatgcacaaaatcactggttactaagatggacattttccattggcccagcttagtctctataaagatggaaacgacgatgcctattgaatttttgtttcttcgattcaattattgtaactgtcttagctgacaactttctgagaatggttcttgggtgagcagagttcagatccatttttggactgtgataaaggatctaattttgccctcattctttctcttggttcaactgtgtcattttttcttcatactgacattgaaaaggtcatgttgtttatctcaacagtatttaaatttaattctgaaacatacactatgtctgagtcagtaaataagatggcagttcagcagccagctcccacccaaggcaaaacagagtgaagcagagactgaagtcctcttgaactgaagaccccctccgggagggtttgggtgtggagatggctttgacataagttttataatgcaagaataaaactctcacatttcccacagtccatgtaccaacaggaaggttttctatccccaaagactcagcaggaagtacttgtcggcatcaggaaagaagagtttacacctgaattaatcaaactgttattctgctgggaggatatttccttgtgaaattaaatagagggcagacttggtgactcaatgatgggttgtaaaactactgactgaggctgaagagtgaacataaacaccatcattgaaacctaacgttgtaagggtttgagtgttaagatgaagaagataataatggtagttattttgatactagtattgttattcatttcttgagcacttacgtgctaggcacgtaatgataatagttttgacatcagagggttgttatgatgcataaagcactttgtacaagcctggtacagaggaggcactcacagagagctgatcatggttttcgttagctgtgtcatacattaattaatgtcccggtgtagagtctttgaggggcagaatcctgctgctgctattccttaagataacatctgtgtgtacattggggtcgaagagggccccacatgtcatgagcagcatcacagcttttatgggaccatttggaaaaagatgaaaaggtaacctggaaaggaagagtgagctctttgttcaggaaacagggaactcagaggtgagatgcataactcatatggtttttgtggggttatttatgagatcttgaaatgtggacctccctttcctctcttggccagatgcacacgctcccatccccaccagcatagaacccagcggacatctgggggtcatgttatagctgtagtgcagtggtttgcaaagtgtgctgtctatcagtatgcagtatcagtatgcagtgtcagagccagcggtattgacatctcctgagcactttaggaatgaagttcttggtctccaccccagacctcctgaatcagacactctaggtgtggggcccagtgttctgtgtttaataggctctccaggtgacttgatgagctctcaaggttgagaatcactgctgtggagtttggcattaggagctcagccagggaagctaggcagagaccagagggaggtagcatggagaatcatctccttttttttctttttttaaagacagggtcttcttctgttacccaggttggagtgcagtagcgcgatcatagcttactgcaacctcgacctccagggctcatgcgatgctctcacctcagcctcctgagtagctgggactacaggagtgtaccaccatgtctgcctaattttttatttttatttttaaataaatggggtcttggccgggtgcggtgcctcacgcctataatctcagcactttgggaagccgaggtgggtggatcacctgagctcaggagttcgagatcagcctggccaacgtggtaaaaccccatctctactaaaaaagtacaaaaaatagctaggtgtgatggtgggtgcctataatcccagctatttgtgaggctgaggcaggagaatcacttgaaccgaggaggtggaggttgcagtgagctgagattgcgccactgcactccagcctgggcgacagagtgagactccatctcaaataaataaataaataaataaataaataaataaataaataaataaataaataaatgtggtcttgccatgttgcccaggctagtctcaaattcctgggctcaagtgatcctccaaaaacctcagcctcccaaagtactaggattacaggtgtgagccactgcacccagccaagagaatcatctctttaagtggaagacactggtcctccttctagtcagggcatggggtgatggcttccagaagaggtcacagactcagatgcctacagaggccaagcagataatatgaatgagggaagagggctggtgagatagaagagaaagtgttggagatcgatgcaagccagagagcaggtgatctacctaacaggctcagctgatgttcacctcccgatggcctgccccgcaggatgcagcctcctcagggctgctccatcttcatggtatttggggctagaactcggtgctgtgggatgcagcagacctgtgagttgattgacagatcctgttacagtcagtgtagtatgtaggccctgtgtagtaagggcttagtgaaagggtgtataaagttaagatgtttatataaaatctcacaattttggctgggtatagtggctcacacccgtaatcccagcactttgggaggctgagccgggcagatcacctgaggtcaggagttcgagaccagcctggccaacatagtgaaaccccatctgtactaaaaatacaaaaattagctagatgcgatggcatgcacctgtagtcccaactacttgggaggctgaggatagagaatcgcttgaacctggaggcagaggttgcagtgagctgagattgtgccattgcactctagcctgggtgacagagcaagactccgtctcaaaaacaaacaaacaaacaaaaaaacaaaaaacaacaaaaaaaaaacctcacaatttcttttatatatcagaacaaatttttgaaaattaaacacagtttggggcaaataaaacacacccacacccatatgtatcccatgcattgttggtttatagcctcaggggtagtgatggttcaaagtcaggttgctatttagccagcatctgttagcaatggttatttacaaccagagtccattttgaccggttaaatattttgaatagccctgctaagcagtaatgaatataagaggtctagcctcgtgcctggctcatagaaagcactcaggaaaaggtagctgttattatcattgataatataaaaagattacaatacttagtcattatcaacgagatccctcaactgttctgcatttgatatgatttcccactgacctgtgtcttgaattcctccatgtgggtttaacaatgactttcaaagtacagtgatcaggctgtgctacatacttcaaagtgttctggtaccagctctaaaggagcaggtgctaccttcagtctccttagactgaattagaaataataataaatgatacattatccaggtacagtggctcatgcctgtaatccccacactttggaaggctgaggcaggcaaattgcttgagcccaggaatttgagaccagtctgggcaacatggcaaaaccccgtctctacaaaaaatacaaacgttggtgggcgtgatagcatccacctgtagtcccagctactcaggaggctgaggtgggaggatcttgatcctgggaggttgaggctgcagtgagccatgatcatgccactgcactctagcctgggcaacagagcaagaccctgtctcagaaaaaaaaaaaaagatacatcacctacccatttgatccagcctgcctgtatgccttttacattgcaaatgcattgcatgagagccctcctccccccaatcccaggattttatatttctccttcctcaccccttcttaactgtctgccacttccaaaaggcccatggtgagcgtgtgcagagttccatgtgccttgtgggatgtgaaaaggcatgcatgtatctgtcagcgtttctgattcatgcatgctattaaatagagtgtggtgagagaaaaaacaaggaacaataacagaggattatgttcaaacatcagtgaagggtgctattattggaggttcattaaaataactttaaatgggtttttctaagttgttctcaatgccatcttttattgtggcaaggagctgttcacagagcattgtttgaaactgtattgaaatacactagatttggtgtattgttgcagggaacaagagtcatttcttttttaatgttcgcctggttgtgtgttgcttttgctttaaaacacccaaatggctctctgttgccccagtctcgtatctattgctccttggcatatatggcttttgaggtcttccagtgctagatctctgtcctcttcctagctttagctcctgactccaagaacagcattcctgggcttctttcagtccctcaaacatgcagtgccttgttttcccttgcctgcttcatctgtgcagagccatgcacctgggatgcccgaagccctttcctatgctctcaccagccccctgatccccaccgtgccttgccttttccccctcatcaaatcagtagaacatcaaccgctcagggaggctcttgttgattcctgagtagatatctgctactgtcccatcaagaaattcatcacaggctgtaataacatgttcaatctcatgcctgtctttttgactactttaagattgtgactttctctgtgtcaaatcccagtgcctagcatagggtttagcacattataggtgctcaggaattcttactgaatgagtgaatggccatagaacaagatgctgtaacacagtgtgctgtggaacataaaggagtcttttgggatatatattagagtgcatggtgtttttcttatgtacagcagggtatcgcaaataaattggttgttgtgtaagttactaccctatttataaaggactataatttggctgctgattttgcaaactgtcatggcatcgtgtggttttgcagtgtgtgctgggagagggtgctggtgaaggatctgaagaggcaatgcattgaatcacaggactttgggtagagagatctgcagcttcctgcagcctaaccttgcacagtccaatccagtgttacagatgccatgatgtagccctgcagagtgtcttaaattttaatgtgcatgcacgagtcacctgggtatctggctaaaattcttactcagccagtctgcggtggggtttcagattctgcatttctcacaagctcccaggggataggacactgtggggccagggactccacctttatgtagcaggggctagaactcagtgctgcagggtgcagcaggcctgtgagttgattggcagaacctgttgtagcagtgcagtaggtagaccctgtgtagtaaggactgtagtgaaggggtatatacagttaagtatagaatgttctggtgaagttattgttcagggcacacagcaggctgttgctggccagcatgtggtaggaggaaggtggtggtttgggtactaaagggcagactctgtcgctgagtgcatgatggagcagtggcttgggaagaagcgtgtgctggttctgtcctctggtggggatgttgtcagatattgagttatccattcagtgggtgatgaggttaggtaatgttctaggtgatggaaacatagcactaaaaataattaacatccctgccttcatggagcttatattctagggagagtgggcaaaataataaacatagaaacaagtaaaatatacgatgtgtcagaagttgataaacattatgcaggaagctgaagtagggatggagattggaagagccaggtcagggagatgtccttatgatagagtaggtggagaaaatgacgtttcagcaaatacaggaagaagatgagggaggtgggagccatgtatatatctgggtgaggggggagagtgatttggttggtagtagcagatgcaaaggccctgaggcaggagcttgcctggcatggtcaagggagagcaaggagtgcaggtgcctgagccaaggggttgagggagaaaggaaaagggggtgtgagatcagagaggccaaaggaaagcacaggccactgaaggatctttggcttttacaccaactcatgagccaagaaataacatgttctgactttgggtttttaaaggatccctctgagtgctgcagggacaagggtgaaatcagggagactggttgagactcttgccataatccaggcaaaaggtgataggagcttgggcaggttggggctgtttgagaacccccaagttggcatcctcaggtcctccccagttcctggcatcttgtaggcactcagtcattgtctcatggagacatgaaggcgctgatgaacatgagtccctgcagactgcccacatgattgctcctcaagtataaaacatggtagccaagagtttggtcccagtagcaataggatgaatgaatgaaatagatggtcaggaaagcttctgtgatacagagcgctggcttgcagggcatagagcaggaggacatggttgtgctcttggttggacttcctcctgtccatcctgttgcaaagaatgtagtgatatcggagggtgcagtggctgagggctgtacccagggagttgctttgtgtctgggtgatccagctcagaattttgctgacttgtagcaaaaggtgcattgagcctttggcatggatgagcatattttattgcagaagtggtagtacatggagctataatgtcacaggacaagatatgctaggtaatatgttcacattgaaatgcctaatggagagtttggtggcattcatgtattgtcacgaattggcttaatgaagtcctgtcactcttcctctgaaaggctcccatagtgtccataacacctaatgaagggcttactgtgaaaactgggtagggggatgagcccagggtacaaggattcagccgcctcagaagacaacccaggtagcagcatagaagcagtgaggtgaagaggaagagaaagctaagtaggcttcattagagtccttggagtcttttctgctttttatttatttgttttttcattgtttttaattaattgcccaggctggtgtcaaaatcctggcctcaagtgatcctcccacctctgcctctgaaagtgctgggggttacaggcgtgagccactgtgcctggcacctgtggagtcttaagcgctaaagtgtgtgtacaatgatctgcccagtagtaaacatggctctagtattcttttaaaatattatcaatcagatcatcaattgttctaaaatatggtcaaccagattgtcaagtgttctaaaatatgatgcatctgatcgtcaatgctctctgggcagggcttgaggagtacaacctgatgagaagcagacgttaagatcccctttcctccactcctgacattggagcaaccatccagtcctgtctagacatcactacaatgctcattccctccttccttccattctagcctgtgtcaggcctcactaactccaaacccacttgtatgacagactgattccaatcatttctgctcttgttaccgattcttatctgcactttacttaaagccccataattttgaggcatctggacagtaggaaaggctgaaaacctggcaagcttttatagcttgcaaaggtccttgtcctatgctctgttagtatcatttccaaaatactacttgggctatctgatcacatcccattgcccgtatcctctgagagtctaaatgctgaactgcttcagaaactaaatcatactcacaggacttggtttctcagcaattttatcatctgaaaacattgtttatgtagctgaggtcaaaagcttcaagtactgctttaatgagctgcgaatctgttcatgtgacattctcttccaaacccaattgccctttacactgtatgagtaagtgcctctgtgtgtgtgtgtctgaatgtgtgtgtttgatgtgctgacatttctgaattgaatccagaaagtgtaacctttgtatgtttgctgttaaaactccaaattcaagccttaagaaaaggatctaacacttactcaatgtgatttatttaagcacagaacctaactcccccaaagtatcaaatactcaagagaacaattcatttttgaaaattgtgatttaaaataattctcataaaacctttactgttcaaatatattagaaaatatattgcatttttgtctgcatcaggcactgttttaactgccttccatgaattgcctcatttaattctctcaaccctgtaaggtagggttatcaccacagtatagatgaggaactagagcttggaaaagttaaggcatttgcccaaggtccagcaactagaaagcagaggagccaggacttgatccctggactgtacactgcacaagacccttgtaaagattattagaagcacttggagcccctggtaaggtttgtgattgtgctaccaggagagtcatgataacaccatcgaatggtgtctgttacataatagaaaaagactgagtattcttacaattcaaatgatttaaatttattttaaaatattgcaacaaataagtagcatcttcacagcttttataattcgttgtcaggattttaaaagatgcaaatcttatttgttccttagggctttgattttgaggctgacaaagacggcatgcattgactaacctctgaaagaagggcatggcagcattgaaatgaggcagccgagacaggctcattaaggagtagaggtttccctgctcatttctggttgttcttttggggtatccactgtgtggagtttgcagagatcttaataaaaatatcaacctacatttatatactgacaaacaaatagccaagagccatttaggacacacagcttggagtctgtttatctctctccacctatctacacacccatggagaacccatttaaacttcagatcaaaccaggctccctttagatggttggaattgtcaggttcctgagccaggtgaagttcctaaatcagtttctgtcttagtccatgttgtgttgctatgactgaataccacagactagataatttataaagaaaagaaatttatttcttacagttctggaggctgggaagtccaagggtgaggggcttgcatctggtgagagacttcttgctgtgtcatcccatggcagaaggtgaagggcaagagagagtatgcgtgcatgtgtgtgcatatatatgcatatgcatacatgtgtgtgcacatgcaggggaaagatacggagccaaactcatcccttttattaggatcccactaccaagataatgttgttaagttctcatgaggtgccacctctcaacactgttgcattggagattcagtttctaacacatgaactttggcggggcaagtcaaccatagaacctaccagatacatgactttgagtcatgtactattatattattatttattattattattgttattttgatactggtccatggcccagggattggggatccctgccctaaatcgtgaggaagattgaggcccatgggtgccactggttggtagccgtcagcttcttaccacctaccggcacctccatagtcatcttgacctccttgcccagcttccatctctgtcttagcaaatatgttttccctcccccaactcatgtgagacttaccctcactcctgctctggactccagcctcttgatccttcatgcttatctcccctgtttagtctgtctacagcttctctctgtatcaacaaaactcctatggtttcaaataggaatctgatttaaactgacttttaagcaaaaaataatgatagttagtattcagatgtagatggatcatctacatctggtcccaaacaatgccagcagggaaacatttatctatatcccttaggattactttccccactgtgttgacttcattcttcattctcagaaggctttcttgggcacatagcaactcccaatttatgtcccattatctctgcaacttctaccaaagaaaagggcttcctttttataaaatcccagcagcctaggactcaatctttttggaagattattgggtcatatgcccatctctaagggaattgctcactgcaccagggggatggaatgtgctgattgaccgggcctgggtcaccagcccctcttagccagagagctggatctaatccagacattttgaaaaaagagaaggaatgtcctatctaaatcagacattttgaaagaagagaaggaatatctcctttaagaaaaaaaagccactgtcatggccgggtgtggtggctcacgcctataatcccagcactttgggaggctgaggcgggtggatcatgaggtcaggagatcgagaccatcttggctaacacggtgaaaccccatctccactaaaaaatacaaaaaattagctgggcgcggtggcgggcacctgtagtcccagctactcgggaggctgaggcaggagaatggcgtgaacccaggaggcggagcttgcagtgagctgagatagcgccactgcagtccagcctgggcaaaagagcgagactccgtctcaaaaaaaaaaaaaaagaaaaaaagaaaaataaagccactgtcactagaagaaaagacaatgcctgctggctgggcaaaaacagcagctgtcctttctgactctatcctggccttctcctttgtgcataaacctgctatgtctttttcatgttaaaaatcccctacctcaaacctgggaatcctccttactactactcttactactgctatgattactaccctaccttactttgcatacaaacacacttttgaaagagttgccagttcctgctatttccacttgatgacaatttattgtttcctcagtttggtgcaatctggcttctgctcccgccatcctattgatatttttctcattgagtcatcaatgacctgaaaactgcctcttctcataagcttgtctcatctttcttgacctcaccatattattaggtgctctaatcctttctcctttaaaaaaatgtgaaaaaataaaatattcaagcagcatcagaagctacaaagtgaaattaagattcccctcacccatggctcctagctaggcttcctggttctccttcccagagacacccattgcaaccaggttcttgtgtgaccttctagagaagatgtgttcaggcccagaaatagtctacatcacacacaaggatgttagcatgctgtgtacaatttctgtatcttgcattattcccctctgtcttggagattgtttcttatctgcttatctaactctacatcaccctttgaataacttcctagtttcctatataagtgagtttatctgtaggaaaagttcagagtgccttctttctttttaagcccctcttctccttcatttttatgacattgtgtgtctgtcttagtctgttttgtgctgctataagaatacctgaaactggggcctggtgcagtggctcatgcctgtaattccagcactttgggaggttaacatgggcagatcacttgagcttgagcccaggagtttgagaccagcttggggaacatggcaaaatctgtctttacacacacaaaaattacaaaaatcaaccaggtggggtggcacatgcctgtagtcccagctacttgggtgactaaggcaggattgcttgagcctgggaggtcaaggctgcagtgtcgtggtcacagcttgctgcagactcgacctcccaggcttaagcaatcctcctgctcgagtgacagagtgagaccctgtctcaaaaaaaaaaaagtggataacttacaatgaaaagaaatttatttggctcatggttctggagggtgggaagtacaagatcaggggctgtatctggggaggaccttcttgctgcatagtaacctgatagaaggcatcacatggcaagagaacacatgagggagggtaacttactttttaaataaattcactcccacaataataacatcaatccagtcacctccaaaagttcccacctctcaacactgttgcattggggattaagtgtccagcacaagaactttgggagaacacattcaaaccatatcaccacatttgctgatgttcttcctaccttcacagccactcccaatagaaattccaactccacaaagacttccagtgacagttgaatttggagggttgagaccagctcatgacccagaaaggaaaacagaaagcttactttttgttttgttacaagtgcagtctcttaaaaataaccacaaaatgcccccccaaatggcatatggaaaacagcacagagatggtgtgttaatctacctgaaatgtctttctaaggaagtgaggcttggatgggaacggaaatgcatccctttttcttcccagggtacacgtctttttctcacttcctctaactgggagccccagggcctggctttgtcttgtagcttcctgccgtgatgcaccaggctaagtgggaaggtttctgttctatgtctaaagtagcactggcaggtcctcattctgcttgtaattgggatgggaatatgggtaggaatttagggtttggcagagcgtacaggacctctttcaagccagagcacagccctgtcagacttactcactggacatgaatgggtcagtcagccctcagcagtaaccaccagctaccatgttaagtatttgatgtgaattttatcaagtcattctcgccacaccctacaagaaacttgagcttaggggacttagctaacttgcttgaaggttgtatagctgggaattgttggagccaggattggtacccaggttagcttaacttttaagtccgtgccacacaatcagatacatagtatgaggcaatgggatgtaatggaaagcccatgggctttggaattgaacagatgggctctggatcttggctctcctacttgaccctatatgaccctgaacaaactgttaactcttaaaattatctgttaagtagagataatccttttcctgcctatctcacagccttgtgggaatcaaagctataaaaagataggcaaatagaagggataattactatttgagggtgagtttacttgaagccaacaatgtgggtttaggatgaatggtgaagaatagataagaaaaaaaatgatattctgttgacatgggaagatgtttagagtgtatttcatctagtttcttttaaaaagcaagcaaaagaacagagtcatgattccacctttgtctaaaaactaaaaaacatccattcatctattcatccagccatctaggatacaaaccaagatgttaacataatacagagatttggggtggcgggattaagaaggattcttttgtgtgttttaaaattttttatggccaggcacagaggctcatgcctgtaatcctagcactttgggaggccaaggcgtgcagatcacgaggtcaggagttcgagaccagcctagccaacatagtgaaaccccgtctctactaaaaatacaaaaattagctgggcatggtgatgggtgcctgtagtcccagctacttgggaggctgaggcaggagaatcgcttgaacccgggaggtggaggttgcagtgagccgagatcgtgccactgcacaccagcctgggcgacaaagtgagacttcatctcaaaaaaaaaattattattataattccttttttttttttttttttttttagagacagggtcttactctgttacccaggctgaagtgaagtggaacagtcatagctcactgcagcctccagttcctgggctcaagggattccccgtgcctcagcctcttgaacagctgggaccacaggcatgcaccaccatgcctggccaatttttaaaaaattctttgtagagacaggttctctctatgttgcccaggctggtctcaaactcctgatctcaagtgatccttccacctgggcctcccaaagtgctggtattataggcatggcaccaccatgcctggcatcttggtgctttttaatagcttgtttgtttctgcgataaatgtaggagactgatagaagagtctggatctcttgtcaaatctaggatcaaatcgtggtcagatacttaaactaaacccattttctcattgcacagcaaggacttcatagagcttttggggggattaaaggaggtaaagcttgcaaaacacttaacacagtatctggctcatagttagtgcttaacatacactattatttgtccatttgattttttttcatccctgggttctagaaacgcagtggtgaataaaacagatgtgattttgctctcatgtggcttacagtctagatgagaacatagacaatcaacagagaatgaacatgtattaataattatagactgagatataccagattttatttctgttaaagaaatgaacaggatatcttgacagagaataacaggagggaagaatgagaatcctctttatttgaaggtggtctggaacagcttctctgacagggtgccatttaaactgagatctggaggaaatcaaaacactggatgttattttttaatgaaaattaagaaaagcaagagcaaaacaaaacagacttagtatcaaacacaaaagacccctctcctactgacttcctccctaaataaacataagagataaaagatccctgattgtaagggaccttcattattagcagaaaaaggagacttaaatctctctttttttctgccaaaacccagaccacaaatgactttttaaaatgatcaaatatgtatgcagctttgagcatctgattctccctggagtgggtccctcctgtattcggctgtgggaaactggaaggcataggaacgaccctgcatttcactggatgtgcacatgtgaaaaagaaagatgcgcttgtctttttgcctaggctatgtagcttggatgtcttttcatcgtgaccttctggtcttgttaacctgaaggtgtcctggtgtcttgatggaggctgggcaggtagctcccctgagccactagcctcatgttatcaaagtcggctaggcaacagacagcagggaggagccttatcctctcctccaccatcttaccttgtccatgccctctttttacctccatttcttctccaggctctttcctttcctcctccaaagaagcaatgtctctcttgcaggtcccactcaagtgagatgtcactccctccagacagagttcctggcccttcttgggttcctttcctctgtgctcaatggcagcacctgtcccatggtcccatgcagtggcctgtgtgtgcatctgtgtcctctgctagatcttaagctcaacggggacaagaacaggtaccctcttatgtatcgccagagtccagcatgctgctcggcagaggatctacaacagccaaatattagccttccttattatcccttagcaccaaaatacacgtcaaagcagccacttgttttagagtttttttgcttcattttgttttgagacagggtctcactctgtcacccaggctgaagtgcagaggcacgatcatagcttgctgcagtctaaacctcctgggctcaagtaatcctccaacttcagccttccaagtagctgggactacaggcatgtggcgtcatgccctgagaagttttaaatttttgtagagacagggtcttgctatgttgcccaggctggtctcacactcctagcctcaagcgatcctcctgctgccttagagtgttttactaagatgaagcatgttaaagtagcatcaggctaaccttaacaatttacccaaatactcccattctctttatttctatttttcaatttcttccatgataattgctgtctcatttaaaatagctttcacagcttcttttcttattacaaaataataataacaatacctgattgttatgtaaatttttaaaatataatcaagcataaaggggaaaaggaaaaaattaaaaccatctgtaattcttcgaatctccataagcctgtgtataaaatgtgtacagatattacgtatacatttgtgtatataatttatagaatgggaagatattgtacacactgttagtaattatataactatgtcatttaatattcttctacatcttcttttaatttttaagaatgttttgcatggtaatacatcaaatagatgtatcattatttatttaactgttttccctattggcccatagtagattcccaatttttctttcctctgacgattctttgatgaacaccctgtattttgatggggtaaatccaggagtatagaggacaggtcagggaaaacctcgtggaggaagtgacactgctctggagacagaaaggatgcacaggagatagctggatgagtggagaaggagtggaaggcaagtgttcctggcagaggaggcagcctgtgcaagggcctggagtcacctccaagagttcatgagtgttctaggaactggaaatacttcagtatggctggagggtgtctcagggggtgggggacacaggcagggaaggggccattgaccaagtgtccaggaacaggtcctaaatggccccttaagccatgctaaggagtgtgggctttgggcaatggggagctattgcagataagagcagggaaatggcatactccagtcagcgtctttaaaagatccctttagctggccatggtggtgtgcagctgtggtcccaagctactcacaaggccaaggcaagaggatcccttgagccttggaattcaaggtggcagtgagctatgatcacgccactgcaccccaacctgggtaagagagcaagaccttgtctcaaaaaacaaaacaaaacaaaacaaaaaagagatccctgtggcagtggtgaccaagccaactccacattcaacagcaagactctgttattaattcaatgaaacagaaattaaaagagaagagaaaaagaaaaagagcttacgtgtaacaggtcacagataagcttttcaaactgtctagattcttaaattcaggagcgtaattcaacaaatcaaccttcttactcctctccttaatcctgaaagaggtgcttgtggtttaaataacccagttggtttctggcccccattcctgttccaggagccccattgatgtaccctgatgacaagggagtcggattttctttttttttttaagctgagtgaggctgaagtgttcacccaagacaagccagagaggcaggtgcaatccatggtgcgtttttaattagatcccagccactgagctgcccatacttcaaggacacagcaggcaggaaactgatctgggctgtgtctcccaagggctgacgtctccatttagggagcgctcctgaagctaatggtcagtgacagctccatttgaaaaacacagaaacacttaacagggaggctgtgatctgccagccctgtaagctgctgattagcagggaaatcacgctccctctgtatcgcacccccttggttaatccctgttcttgtgtctcctctgtgctatctcacttaaagatttcattgttctctgaggcaggagggagtggggagagggagggggaggttgtggagctgccagaagctgtttcactgtctcccatcacagcctctggggaggcccaggcgaagaaacagccttctggtgtggatgggaaattgatggtttttaaagaaaaatggtccctgaagatgctctgtgtctcagcaaatgtgcttcctagactggctggcttgggttccaacacccaggccaaagaaaaacacgcacgggtctgccttatagtcacaccaggatgccataccagcagtccctgccaccatcacctctttgttgtctgctctgcctcccctttctacagtcctaagccaccattcctctcctgtggatgactgcggcagtctctccccgatgccacggccaccaatctagctccccaaacctctgcaatccccacactgcagctgaggggactccttgacgtgtcctctggaattttgaacttatcaaaaaggaaagcaaatactaaatttcccccctcaaataggatctcctcctcgtgttcctctcttactaaatagctcaggccaaaaatgccagggtcaccaacaatgcctctcttcctcacataccccacacccaatccatcagcaaatcttgtcaactctgaattcagaatataccccacatccgaatgcatctttccatccctccaccaatcaccttccttcaagcccccatcattcttaactggattatcataaccacctcctcactggttgtactgtttccactattgtcccccgctcatttaatctatccttgtacaccacaccagtgatcctgtttaaatgtaaatcagggccagtcttggtggctgacacctggaattccagaactttgggaggctgaggtgggaggatcacttgaggataggagttcgagaccagcctgggcaacatagcaagaccccacacacacaccctgtgtctacaaaaaaaaaaaaattagtcctgcgtggtggtgcacacctgtagtcctagctactcatgaggctaaagtgggaggattgcttgagcccaggagtttgaggctgcagtgagctgtgatcatgcctctgactcaagcatgggcaacagagcaagaccatgtctctaaaacaatgaaatattataaaaacaaaacatacgtcatcatatcattcagggctcaacattctccagcagtttctcatctagctgagatgaaaatccactgtccttacatggccatcaaggaccctgctctggctcgtggcccgctgtgtggccccttggtcactctgctctggccataccatactgacctcattgctgcttggtgactgtgccaggtgagctctgtcttggggcctttgcacttgctgctccctctgcctagcatgcctttcctcccgacatccaaagggcaccctctctcacttcactgaggtcttgctcaaaggccatttcctccaagctgaaaatggcatcactctcactccatcccctggactttcttcttcttttttttttttttgagacagagtctcattctgtcgcccaggctggagtgcagtggcttgatctccgctcactgcaacctctgcctcctgggctcaagtgatccccccaccacagtcctcctgagtagctgggaccacaggtgtgcaccaccacacccagctaatatttgtatttttggtagagacggggtttcaccatgttgcccaggctggtcatgaattcctgagctcaagtgatccaccatcctcggcctctcaaagtgctgggattataggcgtgagctaccctgcccggccttggctttatttttcttcacatcacttatctccctctggcactaaaacatatattcacatttacagttacagtctcgtttgttgcttctcttccccagtaaaatgtaagttccatgaagcatggattttgtatcattttctactagcacagagcctggcatgtagtgggtgctcagtaaatccgtcttgaatgagaaaatgaataaacaaatgaatgaatctggacaacaattctaaccacagtgagtttaccgaggggtcatccttctgtgggagcttccctccactggccagcagaaaagaccccaggtcttcatactatgtcagagagttctcattttctgagacctgaagccaagataacaaaaacagcagaaacaatttagcttggaatgacaaataggtttccttaagtctgacaagagtcttttaaaaattcaagactgtttccttagtatttaaaacttaaacaccatgcaaatgccctattataggaaacatacgctgtctgtctgtagggatttgtagtagaaaatgggaactaaataatacttggagccatgatgcgttgatcacatactcagtacctgttacttgcattctctcattttatcctcatatcacaaccccagtgtgataggaattaaaattgctcccattttacaaaagaggaaactgaaactttaaggaacttgcccagagttgcacagatagtgggtagcataatgccagggtttgaattcagtctacagactcacttttttttttttttttttgcgatggagtttcccttttgttgcccaggctggagtgcaatggtgccatctcagctcactgtaacctctgcctcctgggtttaagtgattctcctgcctcagcctcccgagtagctgggattacaggcacctgacaccacgcctggctaattttttgtatttttagtagagatgggatttcaccatgttggccaggctggtctcgaactcttgatctcaggtgatccacccgcctcggcttcccaaagttcagggattacaggcatgagccaccgcgcccggccccagactcacttttactcagataagaagtgagcaggaggcagaggctcttggagacctaagtcccttgcatgcacagcaaatacttctgcttccctcaacaaaaaggctttgaagaagagcgtgcacctcttgactttctcaatgtaccttcactcctccagcaactgaagttcagtggcagccctccatttctcatcagtatcaccccagttgccaattgcaatgatcctttttcggcaactctcctatttgacctctgaaagatattttagttataccaatgcccttcacctggggtttctcccagtccttagcttggctgatactgttctctcctggttctcctcctgctgtcctaagacactttaaggagcatttttatcatgggcaaatggaaataaaacacctatttcacagagtttttacatgaatgaaaaaggtcatatattcaaaaacacttggcaaatgtctgtttcattgaaagtgctcactggtttttattactcttgttatctctttccactccccatattctgtgctttaaaaaaaaaaaaaaaaaaaaggtttttcaagacctctctcctcctgtgcttttttttccttttttttttttttttttttttttttcctttttggagtcaaggtctcaatcactgcccaggctggagtgcagtggtacaatccctgctcactgcaacctctacctcgctggctcaagcaattctctcacctcagtttcctgagtagctgggactacaggcatgcaccaccatgcccagctaattttttaaagacagggttttgccatgttggtcaggctggtctcaaactcatgacctcaggtgatctgcccacctcggcctcccaaagtgctgggattacaggtgtgaaccaccacgcctggcccagaacctgtgcttctgactccctctggtcatcaccaggactctcattggcctctcaaagtcgttatccaaaatggaattaatcatctttctcagttttcacactttctctgtctcagttcatacaaccacagtctctgtcattcaaaccagagacttcatcatccccatccttgtcttcccgctggccccttccccacttcattagttagtcagccaccaggctgccaccgtacttgtatatttatttatttatttatttatttatttatttatttatttattttgagagagagtctcgctctgtcacccaggctggagtgcagtggcgcgatctcagccgactgcaacctccgcctcccgggttcaagctattctcctgcttcagcctcctgagtagctgggactacaggtgcccatcaccacgcctggctaatttttatatttttagtagagacggggtttcatcatgttggctaggatggtctcgatctcctgactttgtgatccacccgcctcctcctcccaaagtgctgggattacaggcgtgagccactgcgcccagtcactgtacttgtaaaaatggagccaggaacttgggctctgatgtcagatggacctggttcatcttgctctgctattggtttgctgagattatgaacaaattacatagtctccgtggtctcagttccgtcatctataaaatggagatcataataatgcccacttcatagggccattgggaagattaaataaggtaatgcaagtaaagaactttccagtaaacagcattttgcactggtatatagcaaatgcataataaatatcagcagtcataattgttattactcctactactattatactattaggttgtggttacctcgtagagatactgtgttgaaaacacatagagcttttgtgcaaatgggttttgctggcaaagaacaaggaaccccaaattagcggtttgccccttctcattaggtgggaattagcatgtacaggtgtgagcacccatgcatgcatgcacacatttgcagacatgtacatacacatatgtgttataactctgcctcagatgggggcctttttaatatagaaacaccagcaggatgggtgagaaatggcaatggttttctctctagaacctgattgcttcaccaaacaatggtttgtatttcctcccacatccctccttcctaattgaagagggaatggctgaatttacctcctggcaccttgcatttgatgttcagtgactgatccagctaaccaggggcctcgtggttgcccaggcgttgcaagcatcaaacccagatcttcactgggatcttcctccagtggctggagtttataaattgtattctgttgagttggaaaacatccactgctcctgattgagagctggaggacagcactttgaggggtctgctgctataaatactgggatctcccaggtgatgtataaatgggtcactactttgcatcttgcaccacctgaaacatctcaggtgccttaatcccatgttttccaacagatgagcttggctgacttctcggggtgggttggggggacatgccacatgcctctggccccaccatctcatgcctttgccatccatctcctgactggccagaaggacaccaggagcagctcatgagctacaaaaactgaaggtcgggaacccaaggtcgtgcaccaaaggtcatgagaattttgcattttatgttgctctcatttctgatcatttgaaacaacctctctgagtttctgaaagggaagggaatggagaaaagcacacccaattatgctaggttctgttttattttggcttttgtttttgttttttttcccacccaccacaagttcttttcttcccctctcatagtgtgggcgaaatgctgaaaacttcgaccgatttttcacccgccatccaccagtcctaacacctcccgaccaggaagtcatcaggaatattgaccaatcagaattcgaaggattttcctttgttaactctgaatttttaaaacccgaagtcaagagctaagtagatgtgtagatctccgtccttcatttctgtcattcaagctcaacggctattgtggtgacatttttatgtttttcattgccaagttgcatccatgtttgattttctgatgagactagagtgacagtgtttcagaacccaaatgtcctcaggtagtttggagcatctctatgagatgggattatgcagatggcctatggaaaatgcagctgcataattaacacattatcaaagtcctcttacaatttattttccgcagcatgtcagctaagtagacccaatggggagagaaaatgcctgctttctttccctctttttctgcactgccatattcacccccaaccatccaatctgtggataattggatgttagcggtactcttccacttccgggcctggagcttggcttgtatccaagtgtatggttgctttgcctaagaggaatccctctatttcacctgttctggaggcaccagaccttgaaaagaacatgctcaaaataaaatgttatctgttatttttgtaaactcaaagttaagatgatcaaagttctaaaattccaagaatgtgcttttagacggtctcaatctaaaagcacttcaaggggtcaaagggcaaccagcttgggtgctacctcagtgttgtagtttctgatactttatgtctttgctcaccctcatccccaaactacttgaaaagggcatttggcaccactctctgaaacaacacagtcactctagcaaggcccccaaagggccctggttttacattacatttcaaactttatttgctttggggttttgtttctgttgttgttcaaatgcaaaaaaaagaaaaaaaaagaaaaaaaaaggtgactcacattgttacacatgctttaaaatatgtattcaaatgttattaaccacaatgacgacctgctttgatttaaccaagaagacggctgcggagcctagcagactcaggcctgtgggaatgggatttgttacaaatctaggtttgttactggcttcagaaagctaattaagtgctctgaaaaagacaccgtttcttgaaacaaagatggttgtattcctcactttgatgttgttttgcaagatgtttgtggaaatgttcatttgtatctggatctctgttatgtgccatttttcttctagcatcgagatacaataaaaaaaaaaaaaaagaaaagaagaagaaatactatttcaaggaaaactgctctttttgagaaacgtggacctaaactacaaagtgggaactgaggagggaactcaggagaaaggaactaactgcggagctttaatcttggccccagtgttcagccactcggaggggcgggggctgtggcccattcaggggctgctggtgggctgtagtggggtgggatgacctggccagagccaacgaggatactggagcccaaagtcaagtttagagaccagctgggaacgtgaatggggctcttgattttcttatcaaaatcaccactcctcccagcttggactaaatattctttctagcaagcagctttgtgagctccctgaagcccaaggaaacccttcggtgggagaaatttcatttctgtctgagaggattaaggcagcaggtgactccccctcctcgcctgccgtgtcctgctattctcaggcagctctaaggagaattcttatcacagttcaagtgatttccagaagttccagggcttctgagagaccatcaagggaactttaacaacttgacaaatgtccttgaagtaagatgcctcatctttagggaaaaatggggtttggatttctgcttaggcaaagtctcctgcagttcatccttctctgtcctcttcttgcttcaggcttggggaccgtccctgctgtccccactgtggtggcaatcaggacctaaggtgaagcaaacttgaagttctatctgacaagtttaggcagtaagagaaggagggaaatcggagcaaagctccctcactttattgttgagaaactggcatctggaaagaggaaggaatttgcccaaagtcagtcagctgggataaaaacctgggtgtcctgtccagaaagtgcagggtgctttctgctctgtagcaaggcagcagacatctctgagccaggcccaccaacaggcccttatctggtggttggatcatgatcccattttgcttggacatgctctcaggaagataaaaaccatggagaaacactaggccattgacaaatgatctgagacaactttagaaaacaatgtaggatgaatggaaagagaaagaaaggaaagaaagaagaaaaagaaagaaggaaagaaagaaagagaaaggaaggaaggaaagaaggaaggaaaagaaggaaggaaggaaggaatatagtgttataaatactgcactcaacattttccaaattcttgccattatttttcaaaagtttaatagtttgcagaaatagatactcaagccaaagtctgttttagagaaactttccatggaaagtcagaatttctaccacttccttttctatccacatttccagtgcagaagaaactgagaaacagagctttttgaagagaggacagggccatagcaacaaggaccttcttgggggattaatgggaggtcagtagaattaataaccctccttggatgagtgctactgttttcacatggcttcagatgctatcaacctcaaagaaatgatctcaacagagaagcttattctctcccaacttctacggtaaaatccaggagtattttctctggggatctgcccacaggacaaagtccataaaagcaagtcctgtctggaccatgtggttatctgaagcattagccatcaccagcacaacaaacggggcagggctttccaaggtggggctggtcagaagggaatctttgataagaggcccacaggcagggaaagcgaaatagggttgatgagaccaggggagacctaaaaaaaaggcagctttgtgtcttctagctccaaatatacctgccttttagctcacacactgtcctggagttctcagacctttaggggccctaacacagttcagttcatacaggggttcaaaagggacagtggcccatttgggagacctttaggatcaatgggaatcaattccattgttttgcctcagagtaaagtttctggctcggggacaattataagttgcaaaaaggatagaggcatatcccaagtcttccttcattccacaaataattacaaacaacctactgtgtgccaggcactattcttagcactggaaatacactagtgaagaagcagatgaggaccctgtttattgtttctctccaagaaattctccaagaatattgtttcttggagagaaataataaataaacaagacaatttctgaaagcaataagtgcaatcaagataattaaaggatgctaaagtgtgacttgtggggattgggagagagatgcacagacaatattaaagaggaggcattcgagctttgttgtgaacaccggaagtaacatgccgagcgcctgggggatggaaactcctatagcaccccacaggctaacagcaagcaggacaagacaaaaagggcaggtgggacatggtagagatggaccctacccaggaaacagctccatcagcatcttagcctgccccactctagccacacatacccacgtgtgctcctgagttcagtgtgcccacctcactcccacaccctcacatagacttggcaagagtaaggagggaactccatagagacattttacctatctcaggggagcagccacaaagaagcaagtcttgtaaaaggtcttttgcaaaggagagtgaacccagcaatgagagatccttaacagctagtgcccattagggggctaaacctaaagcctgggtggtgatggctcaaacgctaatgagtcagtgaatccttaccgaccccctggcctttataatctgaggcaactttggctgcagcccgggaatgtgcagggcactagggaatacaaggccttcttccctggttgtcttgtaataaaacagccatggggttgtccctccagtccgagagactgtgatgaggcctacatagcagcgatgtggtcaggtaaaaatcaggaacccactgaaatcttgggcaagccaccctgcctgcttgtgcctcggttctctcatatgtcatatataggaggtgaggactccagctccacctgccccaggtgggtgtggtgatgatgaggaaagacaagaggcttgcaaggaccctgaagaggtcggagcatcatacagattcctttattagcccacattctgatgttccctggtgagacttgccccaagcaattgctagtaaatgggggttaatttcttctccacctccctactgaacaaaaaaagaaatgccagacttactaggagaatcgagttgctttgagtttcttttgttttgttttgttttgttttgttttaaggctccccttacacaccctcctttaagctttgggttttctctcttatagtttgttgacacatgctaaaaatgtctttggagagaacttctgcctgataaacacccaattctagactgtgggtggattttcgagctgacggtggtcaattcctttcattaagcagtgatctgatttctccacatggccattctgccttcttgggggcagagtagatgggcagcagttcaccttttcagagaaagaggtcttctagccacctgggctgctactgaatggttttctccaggacgctctacctaatgattatttctataacattaagcatggtaataagtagcttccaattcaattcatcctaaagccaaagaaaatacagcaacacacacacacacacacacacacacacacacacacacacacacacaccactttatggcaattcttaactgacattcaatgacttacttcttttcttagaaaatttccaccacatttctatccccaagccaacatacaatgtgaaatgaaagccagtgcgtggagtgcagctgctaaaaattttcagcacagggctctttctgactctgctcatgagatggtatcagccacccaatgactggcgtatcttggtcctgtgtctttcttcttacgctgtgttaatgtgtttactttccatttggcagagagacaagagagacacctccaacttcgacaaagagttcaccagacagcctgtggaactgacccccactgataaactcttcatcatgaacttggaccaaaatgaatttgctggcttctcttatactaacccagagtttgtcattaatgtgtaggtgaatgcaaactccatcgttgagcctggggtgtaagacttcaagccaagcgtatgtatcaattctagtcttccaggattcacggtgcacatgctggcattcaacatgtggaaagcttgtcttagagggcttttctttgtatgtgtagcttgctagtttgttttctacatttgaaaatgtttagtttagaataagcgcattatccaattatagaggtacaattttccaaacttccagaaactcatcaaatgaacagacaatgtcaaaactactgtgtctgataccaaaatgcttcagtatttgtaatttttcaagtcagaagctgatgttcctggtaaaagtttttacagttattctataatatcttctttgaatgctaagcatgagcgatatttttaaaaattgtgagtaagctttgcagttactgtgaactattgtctcttggaggaagttttttgtttaagaattgatatgattaaactgaattaatatatgcaa

SEQ ID NO: 343 - DNA, 384633 bp, Homo sapiens; identical to SEQ ID NO: 342
